United States Patent 7,868,149 (PLANT GENOME SEQUENCE AND USES THEREOF) - sequence listing, part 40

SEQ ID NO: 20923 - DNA, 21356 bp, Oryza sativa
aacatcgctcttgttaaggtaaaccaattttttttgtggaatttccagaatttttacttttcaacacacagctctatgccttatttgtatgcactccattgtagaatcagaatgatttaatcactgctgacttttattcatttctcttaagagcatcatagggaactggattcactgtcatgtaccttgtttttgtgcaccgtataactattttagacaagcttccatttgcttaagaggtgggactggtcctttctcaataagcgagagtctgatatgaattctgatgaattattgattgggcaaggttagcctgaattcattctcattgaaactaatttgaggattaagaatcctatgaattaagaaatacttgaagcagacaacagtagtgtaaagattgcatcagtggaatcagaaaaaataatatgatcaaccaatctaaagttgaatttttagaagactttgaatttgcacgatagctttccagctagaatgtaaaatggaattgctggggaattcagaatatttgattgcagataaaatgtcttcatacataacttttttttaaaaaaaagaaaacgagtaactaattgctgctgtgctgtttcagaattggacaattcatggtttgtactggggaagctacttcactcatcggccacctgtactcattgactccctcaatgaactcttttcatggctttcaaaggggttgataaaaatccagatttcccacacttacaggctccctgaggtaagcgacaacattttaacaaaccttattataattacagttcttgtaacactaaccacatgtcacatgaaacgtcgcatggcccaatcaatcttgaagacgacacataagtcttgaatgcaaaaaacttacataaatttcattagagacagctctgcacaatatttatatataactcccatgttctgaatggatctttcatttgtaatgtgagcttttcatcagctaggatagcttaaagttgcttggcactttttgcatcatttggctgccatattggtttttgagattacgatccaatcttgttgatacttataaagtcaaagtagttccagtatactaaaatgtacttatgaagcaactaggcgtgactgcctgagcatgtcaacacggacacacgtggtaatatatgccagtggtgcatcttatctaagaaaatggtactgattttagtcaatttctggctttgtatgctgatcaactgcccagattatactgtactgtcagccagtcagaataaggaccaactacgtgggttttttaccatttgtaactactgttcatatcttcaagcttgtaaatggattactgtgtatattgaaaattctcttatctttgtgttttgttgccttatcatttataagtgaactatgtgatgttaacttctctacaggcacatctcgctttcgcagccctgagagacaggaaggccgttggtaaagtgatgattgtgatgggctcaccagcaaaatcaagactctaacgcccttcagggttcatcagggttctattcaaaaccatacatctatgcacatgtcatatgtatagaccatgacggtattatttaaagcagcggtagtccctttcaataatgtggtttacaagtactgctagcttgcaaactaccagagacatgaattattttatgtatgtagattagtggagaataaatttgaaaaataaaatagagttatctgtaggttgggccgtcccctgtaatgtctggcttctgcaatgtaaccgacactgtgtaccaatgctgcaggatgtatgagaagagaaaatgtgagaaatatgtgaagttattaattgtagtataaatttcagaaagcatcaggtttggagtcacccgagaagatctcatgcatgtaagcaaaaaatcacccttcgttgacagtccaagcatgattgtgttcttattttccacgtgcatgtacaaactattaaatgtatgtttgttttaaacaaaatccttaaaaagattgttcccttaaagaaaatcatattaatctatttatatgttttaactaattttaaattaatcatccacgaaatttgcttcccctcgcgggccaagccctcggcaagggctgggctgggcccatctattccctcctccttgggccgttgggcgcctccaatgcaaatcccctcattttcgctacgccgtgacggggcggccggtggccggcggcggcggtcgaggctgaactgaactgaaaaggtcggagggtttcaccggtgcaccggcggcggatagctccacggttcgtcgccggcgatgatccgcatttcctcctcgccggctactgcctctgcgtcctcctcctacggtcctacctcgcctccaagctcctgccgaaatgccgctccctcgccgccatcaagcaactccacgcccacctcctccactacgcccaccgtgcctccttcccttacaaccacttcctctccaagctcctctccctcttcacctcctcctctgccgccgctacaaccgactccaccgccgctgcctccgactacgctctcctgctcctcgcatcccaccccgcctccaccgccttctcctacaacgtcgccatccgcttcttcgcttcctcccgtccccacacctcgctccgcctcttcctcgaaatgctccgctccgacctccgcccagactcctacacgcttcctttcctcctcctcgccgccgcccgatgccccgcgccatctctcgcccgtcgcgcacgcgctgcttgagaagatcgacttgaatagccacgaccacactgtccattctcttatcaccatatactcctaccttgatgatcctggagccgcacgaaaggtgttcaacggaattcccagccgggacgtggtctcttggaacgctatgatgaaggcatatgggcgggtggggatgaacggtgaggtaggcaggatgttacgggacatggtgaaggacggtgcagttgtgcccaatgccgtgacgttggctgtcgtgctagctgcatgcagggatgagggagatttggtgcttggaaggtgggtggaagagtggtcaaagtccgcagggatggaaacggactctcttgttggctcggcacttgtgggtatgtatgagaagtgtggagagattgcagaggcgcggcgtgtgtttgacagcatcattgacaaggacgtagtcgcttggaatgccatgattactgggtaagaatataaaactctttgattattacctgaaataagctaattagtttatcccttttggcttgtttatttatatattgcatttaagattatgcagatatgcgcaaaatggcatgtcaaatgaagccatttccttgttccacaacatgaagaaagcaggcgtatgtccagataagataacattggctggagtcctctcggcctgctctgctgttggagctctggagctaggttctgaactggacggttacgcctcatgcagaggtctctacaataatgtttacgtcgggacagccttagtggacatgtacgctaagtgtggagatcttgacaaagccatagaagtgtttaggaagatgagatgcaagaatgtagcctcttggaatgcccttatctgtggccttgcctttaacgggcaaggtgatgaagccattcagcattttgaactgatgaggaacgaggatgggctcaagccagatgatatcactttcataggtgtcctttctgcttgtgtacatgctgggttagtgaaagatggcaagcgctggttcaattccttgacatctgagtttcagattattcctaagattgagcactactcatgtatggttgatccattggcgcggagtggacatttggaggaagtgtgggacttcatcgagaagatccctgacaaggtagatgcagtgatgttgggggctttgcttgcagcttgtcgaaaatgcaagaatgttgaaattggtgagagggtcatcaacaggatcattcagctggaacccacaaactcgtggaactatgtggtgtcgtccaagatatacgccagctcaggtagattggatgactcagcaaagatgagagggctaatgagggaaagaggtgtcaacaaaactccaggttgcagctgggttgagattagtgggaaagtccttgaattctatgcaggggacgaaccacagcatggtgcagatgatatgtatcaggtcctagacctactggttgatgagatgaggttggaaggatatgttccaaatcttgatgtggtgtagcaaataagtttcagttgttgccgtcttgctgaaagttgcttctgcattggtgtttacgtctctgaggctgtgactttgtggatatgtgatacaagttacttcatgataccaccttcctaactgaaatgttgctttgctacagaattgggatgggcaaacacaatttagaacggcatcacactagagaaaattcttggcacaattattcaggaaagtgactcaaggttgccacctggatatatcaacttgatcaggtaattattttgcagttccttatttacttattcaggaatatgtcatgtgccattcagttcttactaacagaaatattccagaaaagtagaaaactaatttgttgcaccctcaaactcttcaccactcggcaccctcaaactcactgtggaagatattttgctttgtctgttatatcaatgttcagttaacatgcaaatcctagctaaattagcacccatgtgcgcaagtatcttgttttctcttcttatgttatatgcatcagtcaaattcttcttaataagcatttgcctcatgaagcatcttgaattaacattttcactttgtataaagcatgtatgggtatgctgcttccagatctcatataggccccaatgcaatcgcgaccaactgttccattgaatcttgcttagaggttacacaggagatccagaatttgcgatgacggctacctacaccctacgtgttgacgaagcaggcaagattgttgctgttgaagatcacagaattgtatttgggataagcaatccatcaatgtaccctgcaagcattggcttcccaaaaccagagaactctcacgaaggcggtaatctgaaataggggcactgatcatcctgcactacagatgcaacaatttttgctatgctgcttttcaagtggcaagcagcaatgttatctttgttattgaggcatttgcttctccttctctgtgcatgcagtagcatcctctgtttaacacgattgtttctcctctattctgtttattaacatgtaaaaatgctgttcctgctcctcacttttgcatcagctgttttatacaaacatgtgaaaactcagaattctgcgtacaattgaaataactaggaacacttgcctaatgcaattctagtcaaatcgtcatataacagaccagatcattaatcagagcatgaccaatgtgacaagaatcgtccctggaaatttctattttataagaatctacagaagtagataaatcattgacaaatcctaccctgctgtagctcgtcaacactctgctggcctatgtttcaggaagaagctgagcttctgtagcataaacataagcccaagcgtacaattgaaataaggttgaaacaattgtttaagacaaatcatatcacattcatatatcatcagaataatgtacagtatacatatgatggggctactgccagcacaagttggctgcaaataaatcaatggcttcaagtaaattacattaaacagatttctaaggttcaaagcaggcttgacaagcaaccaaagaatcgaacagacagcagaaacagacgagatcatggtcctattcctactctgctctagctcatcaaaactctgctttcaggaagaagccaagcctctgtagcaggccgcctccacggcgacgcaggctgtccctagatttcaccgggctgacaatgtactgcgcctcgccggagatccccagctgcttcatgtctctgggatcgatgatgtcgaagaccggctgcgccgtcctcttcatctcctgcagctgctcacgcgccgcctttctctcgagctcacgcgctgcctctctctcgagctcacgctggagtttctgcctctcctgggcccttgcaatcagctcctgcatctcagtgcgaggagatgctgccctctcagtgatcagctcctgcatctcagtgtgaggagatgctgccctctcagtgatcagctcctgcatctcagtgtgaggagatgctgccctctcaatgatcagcttctgctcctccattggcttcacttcagcttcggtgggatgatcagcggtggtgtctggcctgctgctcgcactgtcgtttctttccgacgaggaggatgaaccgctgcaagatgaactgctggaagagtcgctgctgctcgagcgaggagtttcagggaacttgctgaccgatacaggggagtcgatgccgccacagatgtcgatcaactcgtcatcctcctgttgctgcttcgggagcggcgagaactgagccttgtccacgaccaggggagagacgccgccgcagatgtctatgcccatgtccgtgatgcagagctgagatgcaggagatgctgctgccctctcagtggtcagcttcttgtcttgctccatgacctcgtgctccaccattggcttcacctcagcttcggtgggatgatctgtggtggtgtctggcctgttgctcgcactgtcggcgtcggcgtcggtgtcacttcccgacgacgaggaggatgaaccggcgcaggatgatgatccagaagaggcgccactgctggaagatgaggaggagccagagccattgctagagctggaggatgatgaggagtcgctcctgctgctgctcgaacgaggagaatcagggaagttgttgactgatacaggggagacgccaccatagatgtcgatcaactcgtcatcctcttgttgcttcggaagtggcaagagctgagcactgtccacgatgaggggagagacgccgccgcagatgtccatgcccatggccgcaccctcatcggctatctcaccgtcctcgaggaggtcgcagatcgacgagctgctggtggcgtcggatgcctcgatcttgggcggttcttgctcctcaataatcttggtggtctgctgttgagcgaattccacgagcaggttcagcaactggaacaaggcagcatccttcgcggagctaagatcgacatccatctcttcgccgttagggtccacgacgcagcagcattggcttcgcatcaggccgacgatgtgcggcggcaatggcgtgtccgccgacagcgaggcgaggaggccgtagaggcggtccctctgcgccttgggcatggtcggctcgatcacctcaacctccacctccacgatcgggctcgcggccgtcgtcttcctcctcttctcggggggagagacatccccgtcgatcgcggtggcggcctccggtggggtctcctggcggcgcaagaaacgaccgctcttcttgccgcggctagggtgatcggggtgctgctcccccgccgccgcggcgccgccatgggcgcccttggcgcgggccgccattaccaaggcctccgccttgtcgaggagggcggcgaccacctggtgctccgagtggatctgctccgtcaggcggcgcccacggggcgccatgtcgcacagcgcgtaggccgcgtgaggtccgcggcgcgggggaggagatgaagatgggaggcgcttcgcgaatccgcgggagatggagatgggagggggaggcccgcgcaggcgcagatggatcgaggtgaggagtgagtgcgatggaggatgggagagaagtgggggaaggacgagacgaggagcgcggcggctatttatggtcggctatacgtgacagactcggagtccgagtcggagtcccctgcgctcggttcttgtgcatttgatatgcgcttgaattgagtcagggtcgttgaagccaaaaggtgccatcctacttcggatacatacacaacacgcctttctttttttttcttttttttttagaacataaacaacacgcctggatgctttcgtcttcgaaaaggctgatgtggagtgttcacgcgcgtatggacatcagcgacaattcaatcctgggttgggtctggggtgggagggagaagagaggaggtcaagctaggcttagagggatggatgtaggaagtggtggatataggtggacgatgccaaagctatggagattgagaaaagcgagatggaccggtattggtggctagggcgaaccaaagcttgcggtgaggaggtggtgtctaagtggtgggaagccaccggcgggacaaaggcacctcgtcgtaacctgtttgagaaagacaaagaaagcaggggaagaggatgaggaggtcaatcgaagggcctcgctcatgcctactagctagccggtgagaccgggtagtggcgaaggtataagagtaaaggaatcgagcagcggtgaatggcgatgcatgagtcgaggcaatggtggagtgaggagggatgagagaagttaggcttatgtggtatcacacaaatcttaaagcaatctaatagtatgaaatttgcaagatttccttggatgttttctgtcaaattagaaatagagagagtgcctttatttcctgttcatattgcacacaggtatctatacttttttaaaaagacttcaatgataatggcaataaatctgtgaccccacctactccaattatagattttacacattagcccttaaacttcttaatatatgctcagtctggtttttaataaatgatgtcgttgacttttgaacaaatgtttgaccattcgttttattcacaaaattatgtaattgtataagatataaatcatacttaaaagtactttgagtgataaaacaactcaaaacaaaataaactataattacatatttacatattgtaggtagtacataaacaactagatctaaatagatagatagcctcataaaattaaatcaacgtgagtattcctcgtagcaaaaaggtggataacatattgatgaaaaatatacttttatttattttaggcaatattatgattttttttttcatagcaaagctcagacatttagctactagtactgtaagaaaaataataaaacccatttcaaatcaaagttgaaaaaacttgccccctcataattctttcaaagaaaaactctgctagctgcactatatttatgccttgtaaggagttcctattacaaaataaataagaaataatgtctaccacaaacaaaatacaacaaatgttggatgagaaaacatatcgcagtgtctgttcaaagaaaaaaatattctatgccatcgagtttgctcatttctactgagtaagcccatttctactcaataccatcgagtttgcaaaaaatatttactctatgcatctatatcaataagttatggtgttgtttgtccacattaatattaatgttagatggatctcaacggctcaagggggccttgacccgcgccctgatcgggggtgcctaacccaatggctggtgggcccccgtcacactgcgccatataaaagggggtggaggacggggcggcacacagtacgaggttcgtcgccgccgccactccaccccacaaaaccctaaccgatcgagagggggcacaaccagtgacgggaaacgccaccgccgcgccacgcctcatcgccgggacgtctacgaccaccattgccgcaaccgtcatcgccgtcaacctcaccggcgccgcatccacgacaaccgcgcgaccacgacgacgatggccggcgcttcttcatcctccaacacctcaaccggtcggtctatctaaaccctctcccgttttcaatctctattgttcaaacatcaatcccaaatagaaccacccgactagatctaacctgggtgatcctagtgcaaagtctaacaatggtatcagagcaaccctagtgattagatcggttcggggaaagaaatccaaagaaagaaaagcacaagatccacacggatcaaaagatcgaaaccctaaccctaccttgtcgccggccgtcgccggcaaaagggggggagggcaaagggcaccgccgaggagccactcgacggccatgcacgcacccgtcggtgcacgcgccggcgagggggcccgcggcggcgccgccatctccgtctttcggccgccgctctctctcacacggtgggggttagagacggtggggggagcgtagaagaagagaaaagaaaagaggcgccggccatggcgcggcggtggcgagggccgccggcgtcggtgacgccgctcggcgcggccgcgcgctcgcaagagagagaaagaagagaagctagggttcggcgcggcggctgggggggtcgggggttttgtttgcccgatctccccgcccggccgtccgatcgaaccctagtggatcggacggccggtgacggtcgggccaaaaacggcccaagaaggagagcgcgcgcggcgactttcccggcccaggcccaggttgcggcctggggggaggagggagcgcccgcacgcgccaaaaagccgtgggccgctggcaaaagttcaaattaggtccctcggggggccgaaaatgatgaaaagagggacagtagcaaattttccttttattttgtataattttcatgcaaatttcaatagaattttgaattgattttgcatgttttacctctgtttaaattcgaaccaacgggagaacttttacagagagtaaattacagagttttgttgttgttcatatgatttttatatagtttttccgctgcaaatagataaatttgatgaaaattagtgtttctaaaattaaatttcgaaccaacgggagaatttaattttaggaacattaattatgtgctatgatgttgtaattttctgaccaacgttgataattgcaatgttatagttatggttatatgtgttatgtctaattctgcccaatggtgatataggcttaatgcataatattttaatgttaattttgttctcaccgtacatgattatttcaggtggctactccttgatgggttgcattaaaaatattccaaccctaaaaggagataactacacagaatggaaaagaaaactcgaccttgctttcatcttgggagaggtggactgggtgttgactaccccatgtcttatagaacctgctgcacttgtcagaggtgaaaatgagtcagatgctaaccggcaaaagagacaaagggacaatgctcctctcgtcatgtcgtatgacattgaacaaaagaaatggtccttagccaacaagaaatgtttggctgtgggaaagaacacgattgagccaaccatattaggctcaatcccagagtgtgacgctgtctcaaagtaccttgaaagaataaagagtcagtttactggctcttcaaagactaatgctacacagctgatcaagcagcttgtgacagaaaggtaccatggaggtggtgttagagaccacatacttaggccctctttatttaggcttataagccaacttataagtccaaaattctaagcgaaaacaaacaagcagcttttttatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggctaataagcctaagcctaaacaaagagggccttaggatgaacaacatggcttccaagttgaagccaatggatttgggcataacagatgaccttctggtccatctggttatggcctcattgccaaagcagtttgacaattttattgtcaactacaacataagtccagataaatggaagtttgaaaagctcatcgctaattgtgtgtaagaggaagagagaatcaaagagtcaaatggtggttcaattaactatgttaaagataacaagaaaaagaaccacaagtctcccacctcaaaagctaaatagtctcagcatctgcctcagcaacaacagttcgctattgagaaagatcagtgtctccactgcaagaagacaggacattacaagaaagactgtcctgacttcttgaaaatgatcatggcaaggaaagatgagaacattattacatttgtaaatgaatctcattatgttggttactctagatccacatggtggattgattctggagcaactattcatgcttgtaattgtttaaaggcattccgttcaacgaggactacgcaaagaagagaaagctccattagagttgccaatggagttgaagaaaaagttgaagctgttggagatcttcctctagagctcgcgaatggcttcacacttttacttcgagatgtcttttatgttccttctttgcaaagaaacttaataagtgtatcaaagttggattttgatggatatgattgccgctttggaaatggcaaatgtgaactatggtataataatgcatgtattggtcttgctgtgttgcgagacgagctttatttgttatctctttctgacaatgtgaatgttgtgtcctcgttgacaaaagaaaacaagaaaagaaagagaactcccgatgtctcatcgaaattatggcactgtcgtttgggccatatttcgaggggggagaattgagagactcgttaagaacgaaattcttcctccattggagttctcagacatagaacaatgcatagaatgcattaaaggaaaatttgtaaagatcatcaaaaaggatgcaaaacgaagcgcaggaattttagagaccattcatacatatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtggggggagtactatggtcgacatacgccttatgggcaagtccatggaccttttgcaaggttcttgttagagaatggaatagtagcccagtattcaacacagggcgaacctcaacagaatggggtagctgaaaggcgcaattgtacccttatggatatggtgcgcagcatgatgagctactctacactaccactgggtttatggatggaggcgttaaaaaccgccattcatattctcaacagagttccaagcaaatcggtgcccaaaacaccatatgagctatggataggaagagtaccctcgctagctcacctccgtgtgtgggggagtcctgcagaggctaaagtatttaacccaaatattgggaagttggaccccaaaacagtcagctgccattttattggctatcctgaaagatcaaaaggctatcgtttctactgtccaaacagttaatacaaagtttgtagaaacgagacatgccgtcttcttggaagacaaaatgattagggggagctcggtagttcgagaaattgatcttgaggagaggcgggtgtctgtacccgctccgtcgactcaggaacctttcttctctttacctgctgatgttgtgcctgcaatgcctgtcattgaggtaccagcacctgttgttacctctcctgtggcaacaatgaatgaaaatgaggaacctgttatacaggattcaacagaaatggttgccacaccagaggaggagctgcaacatcctcaaacagataatgtgacagtacaggagactcaacaagagcctcaggtacaggatgtgccaaatgtggaggcccctagaaggtctgaaagagtcagaagatcggctatccgtgatgactataaagtttataatatagaagagtcacatatggaggatgatcccacctcatatgaagaggccatgagaagcgctcgctcatctgaatggttggaagccatgaaagatgaaatgaaatcaatgaaactaaacgatgtttgggatttagaagaaattcctaatggagccaaaacaataggttgtaaatgggtctacaaaaccaaatatgactccagagggaatatagaaaagtttaaagcgcgacttgtggcaaaaggcttcacgcaacaagaagggattgattacaatgagatattttctccagtctcttgtaaagattcgttcaggattataattgcactggtggcacattatgatttggaattacatcagatggatgtaaaaacggcatttctaaatggagatttggaggaaaaagtatacatggcgcaaccgaaaggttttgtcatgaaaggaaacgaaaatatgggatgccgtctaaagagatccatttatggattaaagaaagcttcgagacagtggtacttgaagtttgacgggacaataaagaaatttggatttcaagagaatgtcaaggacaactgtatttattcaaagtttaagaatgggagatttattttcctaattctgtatgtggatgacattctactggctagtagtgatgtcagtctacggcaggaaataaagaaattcttgtcctcaaactttgacatgaaagacctcggtgaggcttcatatgttttgggcatagagattcactgagatagaacaaagtatgcattgggactttctcaaaaggcatatatagaaaaggtgttgaagaaattcaacatgtacagatgcagtatggggcattgcaatgtcctagaaatcagtatgagctcaatgaaatgaaaacaaagccatatgcatcagctgtaggaagcctacagtacgcgcaagtgtgcacacgacctgacttggcatttgttaccgggttacttggcagatttcagagtaatccaggcccagagcactggaaattggtaaagaaagtattgcgttatttgcaaggaacaaaaggcctcatgctgtcttacagaagatcagaatcgctccagatagtggggtattcaaattctgactttgtaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagttcatacccggtttaaaggttgacagtattgagaaaccactaaagttatactgcgacaacgaacctgcagtaatgtacgctcacaacaatcagtcaagtggtgctgccaaacacattgacataaagtactatgttgtaaaggacaaagtccgggatcaaacaatcagtctcgagcacattagaccagaaaggatgctcgcggatccgctcacgaaaggcctaccatccaacatgttcaaggaacatgtagccagcatgggtctaaggggagccttatgaatcctagactacagggcccaaaagtaaaagtatctgtttctgaatagagatgtgtatagtggctatcgaatccatcggtgattgaccgtgacgatgaaacatgctctatgtgcaaatctgtgatggaatagaaaacttgaccttgctttcatcttgggagaggtggactgggtgttgaccacccgactagatctaacctaggtgatcctagtgcaaagtctaacaattaaatgataaaattgtccctagtgccatattcacatatggaagtttgactgtgcactcctagcgtatcccaattcccaacaggaattttgtccatcatgctgtagaggagcaaccttgttcgttccaacccagaaaagatttcacttcctacattcatccaggatatactttcgaaccataggtggtgttccaccgaagctagcaagagcacagcgtcctgtaagcttcgcgcttgccacgcaagattgcaagtagttgaactgtcttcttggatctcgagggccaccacatattagtaggaagaaaggcttcagatattgtatttggtggaaggggaagaacgggcgacctgttctcaattggcaggttgtgaatgtagtccatcttcctagcagccgcgcagaaagaacctacaaactcaggctgaatatcaaacaagaaccttgagatggtcgtccatacacctttcgaagatagggcgacgttttcatagtaaaagaatggtggtccaaaagctggtttcaggaaggtttctgtggactaaccttaaactgtcactgggcaagctgaatcccaccaatccaccataggatttggcagaggcattggctcttcatggctgtcaccaaatggcatttgattcccttgtggcccacttccataccactctttttcttgcttccatccatgaatcttgtattctttcttcctccaaaggaactgaactctgcatcctgcaaaattataaacatgatgctagtgccattacatttaaagaaatgaaacaatttcttgattcggatgcattataatcacaaggtacctcatagtcagataggtttgcagagtaaacatttcctgcagccagataatattgaatcagccaacatatctacatatgcattgaaacctgcgaaattttacccaacgtaggcagtataaggtcccttcctgtgaaagcagcaaattcaagaggcataccacatctagtaatagccgtctttgcttcatcttctggaaaacccatgctgactaaggacttgattttctcatcgttctctgacagctcctgtaagaaatcctgcataaaagcacatgaaaggcagattgaaaacatttgctaaatctcacagatgacttgcagtttggaataacaaaaagtagtactcacacaaatatacctgctttttccatgctcgtaaatgttctccttgtatacccactcagtaacagataaagcccacctccaatttcctcttgcctcaagcccttccagtatttgtagtagattaccttcactataaattaggtcagattttttttcatcaatctagtaagcctccaatcatgtaaacttagatcatattagttcagtctgacaggcaaacattcttatgcaatatggggaaaaaaaatgcaacacttcatgcaggttcaaatgtgtcttagcatagattaagaggagaaacctcagtccccagactaattatttaatcaataagaaaaacttaattcgataatagcactaggatttaggataagtgaagtttacaatgaagttaagtgcataaccgcatataggtgcatactacactgctgtctcaatggtaaaatatccaggctttgtaaaaattagacctttcttttctactaatagtgaatggcagaactcctgcctccttcctcgaaaaaatacactgctgtctcaatggtgaaaggaacatgtgtataccagtcagaaacaatccatgctaagtctacgcaaattctaccatatctcatattcatgaaaatgtgattatttaagtcataaagcaaccagcactactttgtactcctacttgaaagcaggacaaaggccaagaatgccagaaaaagcagtagcacgaacatacctggcaccacagagttgacaccagtataagctgcaggaaagtagttgcacgaagcagaaggacatgtagacagaagcaatgaacaatctacagagcctggcaccacagagttgagaccagtatatgctggctacaaacaaagacttgacttatgctagtaaccgttatcatttgtctccatctttgttgtccaaagtttgagaacttgaaactaaacctttatctacaaatttcaggatatctgaggaagttattccatctttcgacagctccacaactgcttcatttattaatcctaccattttcaaattattgccgtaggtatctttttggagaacctcttttaaaagctcacatcccttcatgggatatccatttgatatcaaaaagtttataaaatataagagggaaaaagtatccaactcaaaaccttttgtcaccatctcttcaaagtaggttagtgcagtctctattcggccacatttgcgcaacccgtttataaaagcagtatatgctatattgtttggagcacaacctttctccctcatttcgcaccacaacttaatggcttcatcaggtcttccagcactgcagaatccatctatcaaacttgtatatgtaattactgttggttgcttttcttcataaaccattttatctaagtaagaaattgctttctcaatcctgccagtcttgcaacaaacatcaatcataaggttgtaggtaacaacagaaggaaacagacccttctctaacatctcttccataattttttgtgcttcatccaatttacttgattttcgaaacccatttatcaagatattatgtgctaccacatcaggaagataatacttacaggaaatgtcacggaagaggtgtaacgcatcgtccacctctccagtgttacacattccattcatggctgcagagtatgtgacaatgtcaggaagaaaaccaatttgaagcattccatctaaaaattgcactgcttctgttactctgccactgaagcaaagctgttgcaccatctccgtgcagttctttatccatgggggatgcccatttgtctgcatctcccttagtaaatccagagcagcctttggatcttttctcctacaaatgccatagaacaatgaattatatgtgaactctgagggtgtcaaaccaaggtccttcatttggttaaatatcccatatccttcttctaaccgatccatattgcacaactcatggatcaaatcattaaacatcaaaatcttgcccttacaaccaaggctaatcatgtcttttgtgagagctaaggccatatccagcttcttaaccttacataggccacagacaacaatgttaaaggaatcagaatttggtttagcatcttcacggatatgcaacatatgtgcaccaccagccacatcattgttaaccgcttgaccaccacataccatggagcggagcaactgataagctgcttctacctcaccacaatggacaagctcttctaaaactacattgtatagtgggacaacactgccggatttcaaatactctgcattctcattaatgaacggaccaataacggcaaaatccccttctctacaaaaagcctcgatcaccttcttgagtaagcggacgtcaggagcaactccactgctcttcatttccttgaacaacttcactgctctcgcaatgtccttctgctgacagagcccctcaattaaaacgctgtacattgccaaatcgacaacaaacccgtaactgaccatcttggcaaacatgtccatggccttgtcaaccctgccttgcttggtgaacccgtggacaagcacgctcaatgtcttctcactcaacctcatccccagtgcttccatgctccctagcagctcaaccgcaccgtccaccttcccccacttgctgaacgccaccatcagcgtcgtaagcacatgctcgtccacccaccccagctcgctcatcctttggaacacgtcgttggcgtcatcaggacgacctgcattgcagtagcaccgcaggagtgaggtgagcgtgtacttatcaacgctcccgtcgccgcacctcgccaccatctcccggagccttgcctgggcatcgtccgcgcggccggccttggcgagcgcgtcgaggaggcagttgtaggtgtacgagttgggggtgcaaccgaaggaggccctcgcggcgtcgaaggcgcggacggcggtgtcgggcagccccgcggcgccgaggcagcggaggaggaacccgagcgcgcctggcgtcatgaggcagcgcgcggagatcgcgtcggcggcgaggcggtcgagatgcgcgcgctggtggcgggggaggagggaggccatggcgttgagcgagtagcaggagtggcggaagcccggctggtcggcggcccagcggaagaagtcgagggcgtggcgccaggacgggagccggaggaggacggactccgcggcgggggcggtgagctcggcggcgagccggcggaggcgcgccgcgtcgcgggtggcgcgcgggcgggagaattcgtcgagcaggtggtgggcgaggtaggaaggggatgcgggcacgggagcgcgcggaggcggagaggcggaggtggagaaggagaaggagcgcggggcgcagagagagcgcgacgagggggaacgggctaggcggcggagcgacatggaggagggcgcggaggcggcgcacggcggagtggaaggcagggaggtggccggaatccggaagggtagagagaattccaagcaagccggaccaactgggcctgggccgaccagcctgactaaaggctctcacagtggatttatatatttatttatttattaaaagatttaaaaacataaagtaccgttcaaagttctacaaaaatatgctcctcccacccaaccgtagggcgaggacagaaggagcatattaatgtgaagtggcacctcaggagaggggcgtgcaatggcaattttctagataatctcctcccggcgataaatcgttcttccctagggtgatttattgctggaagggggtcgcctacaaaattaccatagcgcaacgtttagctatgtatgggacgcaccatagcaattgtgtagtggctccttcccaacaatgaatcgccctcccctagggcgattcattcttgggaagaagccgcctgcaaaattaccacgcacacctcccacagggtaccacgtcgcgtagattgtcctaccgtaggacgatttatctacccccgccctacggtagggcgggaggatatatttatgtgaagctttgaaatgagaatatatttttgtaaatcttaaaaataaatataaaaataaaaaattttcctcacagtgcatcccacctatataagaggcctcagagtgtcacgtaggctagagctacgaattcaaaatctgcgttgctcaccgtgcatgtggctatagaagtggctttaattttataattccagctcatgattttttttcagttcttatactttctctaatttacatagaagtaccaattttacattgcacaccctaaaatccaagaaataatatcaaatcccctcacctaccctccctctctctctcctttatcccctccctccctctcggttcccacggaacacatcggtgccactcactcctctacgtcaaccccccaccatcggcaccgctccccctccgccacaccgctagcgccgctccccttccccc

SEQ ID NO: 20924 - DNA, 12788 bp, Oryza sativa
ttgccagatctaacctagactcgctgatctagccttgggtggaggcggtggtagctcgacggtggagatggtacgacgacggccatcctgcgccccctccacggcgggggcggctcaccctgagggagggggggagatgctcaatgttggtggcgatgggaccattgcttcgcatttggggacatgtcctttccaaggcggtttcgcccctctccttgtgcatcatggagattcctcctgacaagttctgattaggtttgcatgaccaaatgaagctccacgttcttcacagggactcactccacaccgacgtggatcgaatctccgagctggcgaggtgaggccgaatgccatctcaccgcactgtgaatgccctaatagcgccacgcgccctacactcttccacctaaaatcatatttattactccctttgtcccaaaataagtgtacctaatataggatatgacatgtcctagtactacaaatctgaaaagacagatatccagattcatattcatagtactagagtactaggatatgtcatattatatacaatgtgtatttatttttggaacggaggaagtaatacatttccttctttacggtttatatataaaccgttagatcacacaacacaatgaatctcaagcactgattgactttaaaatgcattcgtgcagccaaagcatttgcagaaactggtaaagttggaaatgggaatatccagaagagttggaaatgggaatatctggcaaagtagtagaattaatctgagccatttattttttttaaatcgaagggatcagatctatttctactaccaacttataaatggtagtagaattgtgcaagctaaaacctaaacctgggttttcttgttctccatggtgattcaaggcggcggcacgaggctttttgttcctggtcgaggacagatcaacaatcttgtggcctgcaggctacccattagcagctcccgtgttggttttgatgtgaacatgtattcatgcatcttcatccaaacaaatcatataggaatagtaaaaaactgaatagcgctattcaagtgcatgagttgcttgacatatatggcaagtgatcctctcgccgcaaatcaaaggcaagagataaaagataatttctcgttctacgcgagatctaatcatgtgaatttctcgggaaaagaaaaagaatagaaagaacaaatcatacaaagaaaaattaccatcatagcctaataaatcaatggctaagattgtttctactggtagtatggtagtactatactaccaccagtagagagcactggagaatcactctattcagaaaggcctttggaaacaaacgacggatgcaatgaagcagatcttcaaggactgtgtggactcaaaaaatccctaagacttttttccttgtgagattatttgatcatattgtggaaggtggagcaaagaagcttcagaattatccacttgattggagtgaaaaggataaggcgaaatacctccttaagatcatggcaatggacatgtcgcatgtacagaagcttcaaggcataatgcaacaagcttcaagagagagtagtaaggagtagtatttgtcgaaacaagatttcggcaataataaaagggggtggctatcaagctaggaaagtggatgggtttagagacaaggaattttatacaggttcaggccttcttattcaagaagtaataccttactcctgtccggggatgattccgccgagtgtgttattgattgtatgactgggagaaaaagaatcgtcccgagaggaacccggacccatccttatataggggaagggatccgtattacaaagtacagtccatatcctaacagaacatgggattacagataaaatacaatcgtaaccgactaggatcccgggtattttcttgacatacaagtttagaatctaacccgagtcctcataaagatattctatctatatttggtaccatatatccagctggaatataaccgccatgtagatatggggtaaccataatctccacagtagcccccgagaccttcgcagttgaccaaaatagtcttctcgaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagcgattttatatcgaagcatgcatggtactcaataaaatacccagccgactgcttctcacttgaatatatcaaggacaaaaaatatgaaaagggccgaatgataaacattcaaaaggtccaaaaatagatatatttggtaggaatccgagtaagaaactcttaaaatgatccaccaaatatgataaagatcatggtaattaagaagttcattagcctaggctataacccttactataatcaaaataagcatataacatgctaggagaatgactactaataaaccagtcatctcaaactaacccaacagctttcgtagcctaaaaaagcttacaaaaatggtataacacctttctgtcgggcaccttttcatgtgcatcataataattccaaagaattattaaatcgcgttaaaaaggattttaatagcatcgggccgcatcattgtgagcacatattgccaaagcaaaaagcgcctaagtccctagggatcacaatgagccacgctgaaaacataattgggctgaagtactatacaggcccaggcccattagtactcccgataccctaaaaacgccgaagtccaaacgtcgtttcgtcttccccgccgagactctcgtcattccccactccgtgctacagtacagaaccgcgccgacgaagctagggttcatcaatctgctccaacccaccctcaaaaacttcacgaaatttctccccgcgtccaccgctccgattccccattcctctctagccatatcccggaccaaattaaaccatccagctcacactcatggcggaagaaagagaaagcttcgagagtcagtgggcgccctccgatgtgacagaagacaatctgaaggagatggtggcgcacggcgttctcccagcgaaggagatcattgggtggcgaccggcgttcggcgaagcattcccgacccccgacacacacgaaatcgtggtatttgctcatttcttctatggcggattttctcttccaacctcaagattcttccgggggattctgaacttctacgggattagcttgcatcatttgaatccaaactccatagtgcatattgccaattttatccacgcctgcgaagcttttctgggcattaggcctcatttcgccttgttccgccgcatcttcttcctcaagccccagccaaacaaaagcaaaccgtgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgccgtcttcctccggtttactaggacacatagaactcattgcccatgggagatgaagctgctcaggcaatggaattgatggaacgcatgctaaaactgaaggaacaaggtttgcagggagaacagatcgctcggcacttcatcaaaagccgattagctccaatcaaagagaggtcccgcacagcttttgagtttgacggcaagcatgatccaaatcgggaagatccagattctcttgactttaaggtcatgaaagaaagaatgtacaagatcttctcaaacgctattgttgtcagctattcacatctgctgcctgttgtgccattcaatgcattcaaccctcctccaccgatacgtattcatatacttcaacctttctcaaaatatgatcttgttttcttgttgaatcagttaacaatgaaggatattacacctaggaatttgctttgatgaagtcggatcccccaatcgctcaactccgatctccccgtcaccaaactgggcaagggagcggaggaccaagaattcggtctaaaactcaaccaagtgcttctgatccagtcggccagttagattctcgaaagaggaagctggttctaagcgacgacgaagccgatgataccatcaggaggcctgaagaccgagagacaaccaagaaactaccaaaacaggctactccaaggaagaaaacatccagtcgccctgcgccaaagatcaggaagtcttctaggtgcaactcatataacgacctctcttatattgatgcgcatccatcgcggcaataatactgataatcaaatttgcaggaaaccatctgatatagacccgtctggaaaagactctgacccgaccaacatggacacaaattcttccaaagaaaccgggccaactgcagagaatcgtccgagtgacaaacaaccggcaaccgacaatgtagaacctagcaacgagcccccgactgggaaccagtcggccgaagctgaagtaggtgctaaccaggagcccccgactggaaaccagtcggatgcagggccaagccaaaagattcccgaggttgaagctcaaacgaacagttctctcgggaaggatgctgacattgaatcagaaaccagatctcttgtgaagacaccaaagtccactcgtccccgaccaggaatcatcacaggtagacacgctatctgaaatcattttgatccaacagactttatttggctgcttcatcttcactcatgaatacactagggccaatgattggtgatgaggaggaaattctccggatagaagcagctgaggattcgcgccctcccattctagtcaagtggtgggatgacaacatgcatcctcaaggaaatgtaataaataagcaaaaagaggacgaggaggtatgcttgctgaaaaaggcgctcagccaagccacccgcattgtaaatgtaagctctttggtgcttgatctcaaccatctcgtttgccatttaatctaggcgctaattaaactgtcttgtagaggattcatcttaggaacgaagctaaaacggcaaccttagagaggctagtccctcatctcgggaccctcgaagccactaggagtcagctgcacgagacaaaagagcttgccaggaaaaatgagcatgatctgagggaccgaattgctgagctccaggaatccaattttaaactgagtggctcatcaaaaggtttgcgcaaactctacccaactgatatgtgctgttatctctgtaatcctgattaaccgaagttaatgtagtgcaagctgccaaaatatctcaattggagaagcagatccaaactctggaaaatgacaaggctgagctagaaagacagagggattcggctttaaaagaggttgaaggtaccaataatcaacacttcaaaagccattatcttctatatgctgattcattaatgtgaatctgttgatgcagaccgcaagatcaagtctcaagcacagtttgatgtcttagttgacaagatcaaaaaacttgagggagcccgggatgaggttgctaatgctgctgccctaattgttcaagcgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggacgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgttgtgcttaatatcttaacttagttcctgatttcttaaaagtttttgtcaaaccttgttgagcctaaaacccgcaaaagttgttaaaaaactttcagtcctcattgactaagccaagaaattaaacagggcaatgatacatcaagtaagcaaattgaattgataaaaatcacactccattattattatagtagccccctgactgaaaacttcaagaaaaaacttgaagttagcagtcaaagaggaaagatacaaacgaaatgcctaagcgtaaaatcgacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaatttttcgcagaaccaggtcaccgactaaaaaggctcgcgatcgaacattccaattatgataacggcgcaacccttgcaaatatcaagtcgactgaattaaagctgcttctcgggcttcttctagtcggttgatgtcgtctactcggccctcttcatagccctcctcattgaagttccgaaatcgtagtgattcaaattccacttcactcggcaacattgcttctgcaccataaaccaaaaagaacggcgactggccggtagcccgactaggagtagtgcgtaaagaccaaagtacggatggcagctgatctacccacttgccaacataggggcgtagtcggtcaaaaactcgtgctttgatcccttgcggtattatgccgttagcgcgctcgacttgtccgttactcatagggtgtgccacggaggcgtaacaaattttaatgccgaagtcttcacaaaagtctttaaatgctccgccagtgaatactcggctttaattccacgtgaggaatctgcatatcgtccagggtcttagcgaaaaggatgttgagcgcgctgccaccatcgatgagagtccgtcgaagcttgacattgcgaaccactgggtctagtaccagggggtaccgccccgggtggaccactcggtcgggatgatccgagcggtcgaacttaattgctatctctgaccaccgaagatattggggcgtgttaggctgaaccgcattgatctcccgttctgtcagcttctgctttctcttagactcataagccatgggtccgccgaagatgtgattaagttctttgcgatgatcttgaaaaccagtcggggcatcgtcttcatcatctttcttctttgttgtgccttgatctccgtctgaaggtttacgtgcgttcttgacgtattgctccgcgaactgtttgtagacgaagcaatctttggccacgtggttggagttcggatgatgcggacattaggagttcattatcttgtcgaaggtgttgacgcggggacgttgtcgggaagatggagaggtggtcgccacaagttcttcgggcttacgcttgcgatccttgtggttgttacttccactccctcctgcagtcggcgtgtccttctttgtttccaagtggtgcccgactgtttggacgcggtgatagcatcttcggctttggcatactcgttggctttttcgaacatctgcttaaccgtcctgggaggtttacgtccgaacttgctgactaggtcctcgtggcgaatgcctttagtgaaggcggcgatgatgacgtcgtcagtgatgtcggagatcttgttgcgttgttcggagaagcgtcggatgtaatctcgaagggattctccagacttctgaacgacgttgtagagatcaaactgtgtgccggggcgttcgaaggtgccctggaagttggcgatgaagtgatcacgaagttccgcccatgatccgatcttgccacggggtagtccgtggagccaggatcaggcggagtccgctagggccacaggtagatagtttgccatggccttgctgtctcctcctgctgcgcggattgcgagtctgtagacggtgagccaagactccggattagtggtgccgtcgtacttctcgattctagtcggcttaaagccggctggccaatccactcgacgcaggtcattagtgaaggcagctactccatccacctcgtcgtcgtagcgatttggtgaatgacgatgacctcgtgctgcacggcgctggttgattgtgtcgcgaaggtcaacgggacgctggtggggtggagagcgaggccatttgactcggcgctccctgtaacgttcgggaggcgagtgaacagatcattcgtcgtgacccctgctcctgcgactagatcctgtgccgatgatgctgaggcttggctgatgataatcatgagatcggaggtgagggactcggctaccagtcggggtgcgggtgcttgcggagttggttggaaccgaggcagcgatcatggttttcgtctggttcaagatgttgacaacatgatcagcttggttgagcgcgtcttccttgaggagggtgtcgaggagagtgattgctgcaactgcgttctgctggggggtgcgaaagaccgctgttccatcgacgtcttgttgcccaatgagctctctcgctcggcgcccagattccaaggcgcgttgccgtcgatcttcagcctcctttgcaatccgttcgcgatcttgttgctcacgctgtagtcgttctcgctcctgtcgctgtcgctcttcctctagtcggcgacgttcagcttcttgccatgcgcgatcttggtccgcttctcgggcttggcgctgttcctccgtttcgttgtcagccatgaatacgccgaagaagaggggcgtgtagttgtcctcatagctgtcgtcgaagttgtcgaggtcgccgtggtcgtagtggtagccgaaatcgtcgtagtcgaggatctcggtcggtcgagaactgacgccgggagagctaaggtaactatccaactcttccgtcgagactgtcccaagaggttggagtataacgccaacctctctggatatagattggatcggggccgaagccggagctcgcctagatcttcgagtgggagatgtcttggcagtgaagacagtggccaaatcatcaggaagtttcatcaggattgagggataggacccgtcgtcttgatctggtcgcggaagagtagattggatctcgtccgagtggtttgaagtcgactcgggagagatgatcttggagtaggcctcggccgagttcggaataccgaacggcacagggacctggtctctccccgactgatttgaatccgagtcaaggagagagatcttgccgaagtcattggtgatgaagttgaggctgccgaaccggaacgcctgcccgggagggaagacgaagtcgtcgatgctagaaacgggacccatcgcacttagttggcaaaaacttgacgctacccctacctggcgcgccaactgtcgaaacaagatttcggcaataataaaagggggtggctatcaagctaggaaagtggatgggtttagagataaggaattttatacaggttcaggcctccttattcaagaagtaataccctactcctgtctggggatgattccaccgagtgtgttattgattgtatgactgggagaaaaagaatcgtcccgagaggaacccggacccatccttatataggagaagggatccatattacaaagtacagtccatatcctaacggaacatgggattacagataaaatacaatcgtaaccgactaggatcccgggtattttcttgacatacaagtttagaatctaacccgagtcctcataaagatattctatctatatttggtaccatatatccagctagaatataaccgccatgtagatatggggtaaccataatttccacagtattacatcaagtaaatttagtatggtttaaaaaaataaatcagcaattagaatgtagtaagaactgaaatatatttttggatgttaccctctaatctatatactactattagaagacagtagtggtgggccaccaccaccatcacggacatgtttttttttaaaaggaaccatcgtggacatgtgggccacaatattaggatttgggggagtcgtctgtaccatgtagactgtaactctttaattttctaagcatgacaattttgttttttcagagatgaaaggttgcgcttcaaccaattaaaagtattgttttcaaggacttaattttcccattctcaattattcgttgcaacacataggcatcttaataaaagatgaaatccagcagcactagaagcaacaagcagtcgaaggaaaacatagaactaacagataaacacacttagaaaagaaggaaaacaatggagagagaggtggcttgggcacgcacagcagcgcagcagaggagagggcagtgggcggaagaatgaaacgcgtagagccaggttgacaattggaggagccggagggagagccgagcgcagtggagacagcggcacgggcggtggctcggaggagcagcgacgcagggtgaggccatcggctgccgtcgttgtttgagaggaggaggtgggtgtcggccgggtgaaggaagcgcgtgcgtagggttagcggggtggacgactgggtgggtgagcgggcccctccccaccatcgggcctgctccccttcgccaggcctgctctctgctgccggtccagcttgccgttgtctagatggcctatcatagatgcctcctgctccccccctccaaaaaaaaaaagaaaactagttgggccaccaatgtcgccttctcctggctaggtcatcgccgccaccaccgtagcttggcctagggttcggggatagggaaaggtagagaagggcacgagacgagtagaggaagagcagtgacgtagcgactggtgtgggagggagggcattaggtggcggcaaagtggacattagccacggacggcggtagcggagccgatgcgaggcgtgcatggccaggattctttagttgtcatgatttattcggtttccaggctcctgatagaaaagattgtaattgataatgttttgcgataggaaacgtataggaggttttgtgctcatatggtttgagaaaatgattcgaatttctatctagagtacaaatagatagaaattcgactattacttgcattaatttatgtacgagaaaaacaaatttcatttatattcatgatacaagctgactaattttaattgacaaacttagtacaagacaacaaatcttttgaaattttttgagttgtctctaaactcttttattttgcctcatctcaaacgaattcacttttgtccctcattttggtccaattctatcaattgaaaatcgatgtttttctgttggatgtaaaagatgaaaaaggtggcatgtgtgatgtgggaaatatttaatttgttactagttagtcaaggaccttggccactatggtgatgaaaaaatagcaattagatcatagcagtattctctcttagtctctttttaaacggagcggcacaaaatacaaactaaggttgtactaatttcattgaatataaaacgtcaccatctgtactataatgtagtaatttgagcaaatacgttaaatacggatcattcgatcattagacccaacggtccagatacatcccacgatcctccggatgaaatcattcgtgcaactcccccaaacccattcccgtcatttgctcaaccacgatgcacactctcccccttcgccgtgcccggcctccgcctactaccgcgcctcctatgccgcgcccaatggccgatctcctgatcccctttgccgctttgcacccactgtcagccatccactccatctcgccgtcgtttggatcccctcccacactctcacgactgatagccctgcaagggacccatgagggagaaggggtgtggcaatgacatctcccatcaccgccattttcgtgctcgatcgacaggtgcagctccctcgccagcatgatgcaacggcataggtgaaaactacaggcaatgcccatgcccatgtcatggacatctttttacatcctttcacatgtcgagctcactctcaccatccatttctcgataattctgttgttttaaccatagatttggtttttttttttttgaacgaaagacacagcgtgtctattcgttgaatatagaaggagtgttatttacaggtaaaaaaaaacaaggagatatttacagacaaagcggcattctatggcaatatcttagctaggcgtttggctcccaccagtgcccaagatctggactccttaatttttgcaataagatcaggggatagctccttgttcctaaagattctctggttccgctcttttcatatttcccaagagattaggaagactagggatcgaataccttttctggggacaccctagtgtgttgctagcttttccaaccagtcgtggactgatgtcgcttgtacccagttagtcggcctcatgtggttgcaggctatccaggtagtgatcgcttcttaaactctccttgtgaatatgcactccaccattaggtgaagggcagtttcccctgtgcaatggcataatggatagtaactgttgttttgccatcctcaagtttcgagtctgtctgatgtccataccctgttttgaatgattagtcacgcgaaggttttgcatttccttgaggcctagtctttctagattaaggtatcgaagtttgttttgagtgatccgaaggattgcgctttgtaagctaaggaggcgg

SEQ ID NO: 20925 - DNA, 12501 bp, Oryza sativa
agtacatatattttggtagtttagtttcacaataccacagctatcgatgaatggattcacccgtgagatgacgtggttattccatctaggatgagaacgtggcatcctattaatttcgtgcgatggctggtaataggatgtcatgtcctcgtcctaggtgaaacagccacgtcatctcgcgggtgaatctattcatcgaagtgtggttttgtgaaactacacaaccaaaatgtatgtacttaagttccaagtgtcaaagtgtgtgtggttttctgcaacttggaccacaaaacgtgtagttttgtgaaatttactctataaagagtaatgcctgattccagtagtgatttttgtacacacatttttgttctgtttccaattgaagtgattgatagttgctgtcttgtacttttttatgtttatactgttcagtgtagaaaaactgactataatttattgatggtttaacactttgctttacttaatagcttggtagcactaaggttttccttagagctggtcaaatcgcaatattagatatgcgtcgtgctgaagttttggagaatgctgcacgccacattcaaggtcgtttcagaacattcattacacgcaaagagtttgttaaaacaagggaggcttcaatttctatacaagcatattgcagaggtaaaatttctgttgctttgtcaccttatttcctccatgaattctgatatattgctgctttcagtgctaaattgctgctacattctggttgctaattttaatgactttgcaggctgtttggcaaggaagatgtatatggtgaaaagagaaacggcggctgctataattgttcagaagtatgtccggagatggcggcttcatcggacttaccagcaagctcattcagcagctcttcttattcagtcctgtattcgaggatttatcgctcgccgttatttctcagttatcagagagcagaaagctgctttggtgatacaggtgtgtccctcctcttaagtttcaacttggttatctggaaacagtgctaggatagtaaataaataatttttaagctctcttttgaagtcataagcatgttccttaatttgttgttgagctgttggctaaggtaagtctagactaattagaatattagcttcatagcttggcatggaaggttatattgtattgtgatgccatcaattgtttatacgagaaaaaaactgactcatatggttgagttttcaacactgatttctgttggcaattgcagtcattgtggagaaaacggaaggttataattcttttccaacaatacaggcaagccactgtgaaaattcagtgtgcttggagacagaaacttgcaagaagagaactaaggagactcaaaatggtaaattctttgtgctattcgatatattatcttttggcgattttcaagccgtactgcaaaactaaaatggaccattgcctgttttagttttttttggtttttctacctcaaacactaccgtattactattacttgttattctttcttcctccacatgctcatgagggatacatgtttctgtgtacttgaaatgatctggtccaattttccttccaagttactctgatctgctccctttgtgtcatctggcaggttttattatcctgtttacagactagttttgtttctagcctgttattttcatgcattgtgaatactcttaggcttagttcatttctatgtatagaggttagctactacctcgttatttgtgagcacgcttcccaaactgctaaacgttgtggtttttgtaaaaactttctatatgcatttcttttataaaatcaaataaacccaattttcaagtttttaagagttaatactcaattaaccatctgctaatggcccgcctcgttttacttgcaagtgaaaagctgtcccaaaccgttcattcgaacatagccttatacttggtttatgttataggctgcaaacgaagcaggtgcactgcgtgaggcgaagaataaacttgagaaaaagttggatgaccttactctgagactaactctagaaaggcgactgcgtgtaagtgttgtctatcattttttacctttgtgttctatttgttaattagtacttaataagatttgctgttgaggggagaccacacatgtatatattttactaatatgcttgttcctaacagtattatgacacttatatctgtcatttggtatttaatgcttccataccattgtcacatcatgagattaacctaaatgtttcagaaactgattctgtgaaaaaaaatttcatgtttaataataatcataataatgtatttcgcctcatggggcatgaactttaaaatgtaggctgctggtgaggaagcaaagtcagtagaaatattaaagcgcgacaaaatgatagaatcattaagtgccgaatgtgctgcagccaagtcagatgctcaaagtgaacatgacaaaaatcggctactccagaggcaattggatgattcgttgagagagataactatgttgcagggtagcaagattatgacagcagaagcagaaaaggagaactccaatctgaaggttcaaaggctttccttgtcattttaatcgcaatgatgcttggttaactacattttcagttattctctgctgttttttttacacctttaattgcatctctcttatttaatgatttttccattgtctaattgctgtacttctaatgtgataaagttaccacaatcatttttttatttagttttaccattagttttcattgctgctgtaatttgctgttagcaatatgcttctgtgtttctcttaattgtactttggctgaaattattctatattactctgtacagaacttagttgagtcattatcaaagaggaattcgtcactggaatatgaactcacctcagctcgtaaaggtagtgatgatacgatgaagaaattgaaagatgttgagggaaaatgcaaccatctccagcaaaatttggacaagtatgttttccctttcatttattaaaccatagagtgctagaaaaatatgtatagtattctaaggtttattgctgctcgtttgtattgggatgcaaagcatctaacagctactggtttgctaattttagattgcaggagaaacttacaaacttggaaaatgaaaatcatgttcttaggcaaaaggcattaaacatgtctccgttgaacaatatgtccatggctacaaaggcttttcctcaggttcttttctttgctctttattaattgcttcagctatctgtttgttgctgttaatatttgatctagcatttaagttcttttattgatactcatatttgggacactgggtactgctctagtttgcatctcttcttaaatagtttactgacatgctgcttgaatgcagaaattcgctacaccgattgggcttccaaacggcgagcagaagcacggatatgtaagcctattcttttgatcgacgtacagaactgctatagattcgtctgacatattggatctcaatttttgaattgtaggaaacaccaccagcagcaaaatatctcgcttcacttccacagagtttaactggatcaaggagaaccaggatgcctgttgaaaggcaggaggtaaattccacatcatatttttcatttgttaatttttgcttgttctagctctgttgataccaccttagataagatggcaaataatttgttctggacgatgtgacattattcaacaaaatttcttatgcatcttggtgatgattttgtgtcatgcaggaaaatcatgaaatcttattacgatgcataaaggaaaatctaggattcaaggatggtaaaccagtcgccgcatgcatcatctacagttgccttttacactggcgtgcttttgaatctgagaggactgctatttttgatcatgtcattgaagccataaataatgttctcaaggtaaacttacttcagactcatctattttgctgtttgtgctaaatgtttatttgcggatgtcaaataatcatggaagttctcctgttcttactccagggggaagaggctgacggtagattaccttattggttgtccaatacctctgcattgctatgccttctgcagaagaatttacggtcaaatggattatttgctacaccatccggccggtctggtggacctctagggataggtgacaagatagtgcaagtaaggaaccctgaaaattatggatcattttcttaccagtactattgaattatgctcagtgtgctgatatccatatgaagtaatattttgaaagcaatgtcctagtttaactctacattattttatcatgtctgtatattttttggacatgacctggctattgacccagtcaacaactcaacgtattgggtcactggttgaagctgttggtcactgatggggcccctggtttcattttagcggcaaaaacaatagcatgacggtgcttagtaaggtcttaaatagcttattcggttcaactggaataagtagtagctaccttagttggttaccaggcagatgcagcacacatttttggaatctttaagctggtggagctagccagcagttgtattagtctatgccgtcagttacgccaaaactacctggttttaacataggtctttggatttgccacttcaaagtggccatcaatcagatttggtctggttggactgtcatggtgaaagtgctggttctcctcctccctcctttctgacaggccactctgctgttctggggcagatctggtaaatcatgtgtacctgtagaggatctatacgcttcccataatgggggaaatggaaacatcatggcatcatgctcttcaagtattcttaatttgcacaactgtataagcccagtaacatgttttgctggtatagaaatttgttgtgcaatttttattttccttttttttcgaaaattcgggtacgataaaattattgtttccctctgttactgaaatggctcctgttttgtttcttgcagacactcagatctccttcgaagcttatgggacgcattgatactcttggacaagtggatgctcggtatccagccatattattcaaacagcaactaactgcatgtgttgaaaagatttttgggcaactcagggataatctgaaaaaggaaatatcaccacttcttagtgtctgcattcaggtacttatccactttaaaatctggacgacaaatagatacattggaaacctagatatgtcagtacaccggctcccatctgaatattttcatgcaggctccaaaatcatcacgtgcacagcctggaaaagcatccaaaccacctggggttggtgcccaaccaccatcaaactcccattgggacaatattgtcaattttctggacttgcttatgtccacgttgcatgcaaattatgtgagcattttcttaagctttttttcttcatcagtggatttaaaggctcttggggtgaatcattcttttttattattatttttttttgctgcaggtgccatcattctttatacgtaaacttatcactcagctattctcttttataaatatacagctttttaacaggtaatttcctcaatttttaaatttatccttgttacatttacatacaagcaaacaaaacagtttgcacatggtaaccaatcgatgttattgaatgggtagttattccttggatgatataattatgtcttcattagttttgcaaatagcgtgatcattgcaccttttatttatgatataagcaaagggcctttttgacagtgaactgatggaattctgttggttaaaagttataataggagatggtggtagaattactttgggaaaaatcggagatggtggtagaattactttgggaaaaatcattactgtattatgtttgagataaagttataggtaaaaataaaatgatgaaatcatatggtttgtaatgatattaacagtcctgttcccattgttccatcagccttcttcttcggcgcgaatgctgtactttctccaatggggaatatgtcaaagccgggctgtcattgctggagaaatggatttctgatgccacggatgaggtaggtgtttgcattctgcttgtgaagttgttttgcactctgagaatggactatgagaaggcctgataaaattgttagcttatcccactatatttgttcccagtttgcttatataccttgtgttttaggaacttaggagcaagcaacattattatacattttatcggtgctctgactttttcacattgctttactagtttattatccttgtactttcagtttgcaggaacatcttggcatgagctaaattatatcagacaagctgttggttttttggtaatttcttgtgcatgctgcatttgtttccatgtttctgtgcttcttttgtatgcctgccgaacatctcactaattgcataacacaggtcatacatcaaaaaaggaagaagacgcttgaggagattaggcaagatctttgcccggtaagacttgctgcatgtatgacctccgatttgtgcatatccattatttatgccatacctcaactagttattttctgctcttgttctttgtagaacttgagtgtacgccaaatatacaggatatgctcaatgtactgggacgacaaatacaatacccaaggaatatcgaatgaggtaatcacttttggattggaggctttccattttttggggattcactatgcttttttgttctgagaatttcgggatctggcaggttgtttctgcaatgagggaggaagtaaacaaatatactcagaatctcgtatcaaattcctttttattagatgatgatttaaggtatgcgtgatttcttggttaaaattttagacagcagaatcagcctttttgtgtatgtaaatcactactatccttattgcagaacatgatttactatctgttaatttgcccttgtatgtgatgctttctttcagtataccgttctctacagaggatttgtcaatggccatccctgctatagattatgcagatgtagaatttccagaatcgcttcatcactatccatcagtacagctcctagtcaagcatcatgatccacagcctgtctaatagtatggttggggttgccttgaagattcgtttatttttgttcccagtttttagtggggtttcatcttttgaactgttgtatggttgttaggcttgtagtcttaagtttatccggggtgaaaaggttgtaacagaaatggtaggatgtcgtttcaaagcaacaattgttgctcggtgaaaattaaacaatcgtggaccctggttgtccaccagtcctatcttcagatgtacatagtgttgtagagacagttaagcatttgctatgaaaaatatccatgttctgtagcgttagttttctactcgtgatctgatgtttggtgcaatgtttggcaaaaacataactacctttgggctcgtcaaaacaaaaggagaataggaaaaaaaacgcaattagtatacctctgccattacccgattagtggtacctgcatcttaaaatttaagcttttctggctatggagtagtcaacactaacatattaggattatttgataactgttataacggttataaaaagacttgcaatgggttttaaggagcgagtgcgctgatgtatctgtggcaaaatctgtcgtaggtaatgtgaaatgtacgtgaaagtgttgggaaataacgggaattgtttgtattcagaaatatccagggaagacaatcccttaaattgtgcgtttttttctgactaatgtagaaatgttcatcgatggacatgtagtattatgcgggaaaactgatatgcatacgactcaattgtttaactcacgtacaactgaatttgatcagcggttgtaaacagttacagtgtatatgaacatgctctccttatataattgcatatctctagttatatatgagtagtggtgaaatcgggtcgggttcggtcggatctcactcttcccatatccgaacccacattttataatcggaatcgggttggatacggatagtatcgaatacggatacaagcacggataatatcgggcacaaatatgagacgaatacgtaccaagacggatacgaccactatcggttacgaatatcttttcggatatcaagtcaaagcaacgatcatctatactatatagataatagctatatattcaaccaaccccatataaccataatgcgactatattattagggcttaagatgtacgggcaatacgacaatgaacaattgatttttaactggaaaaattgaaagtttggttgaaattggaacgatgtgatggaaaatttgaaagtttgtgtgtagccgtgtaagaaagttttgatgtgatggaaaaattgaaagtttgaagaaaaaatttggaactaaactcggcctgacatgtgatgagctgctaacttcctgttcctgaagagatgaggatcggctctggcagcaaaggcatgtagcggcggtggccgcggctcagcggacgcagcaggtggcgcaccggtggcgctcgtagtctcggcatcattgctcaatgggattagtgaacagtaattagtatttttggttattgggttgttaggcatggtttactggttgatggtggtcattgtactagtgggccttttggccactagtgctttattgggctagacatgttatctaggtattatccggatatttaaccgggtaaaacccatatttttgctggataactcgtatccgtcggataccgtcctcccaaacccgatctcatatccgatagaaaatacccgtattcaaacccgctacccgtaaaaacttccgggtacccgaatttttgacccgaaattgtctcgaaataatacggtcaggcgggcaggcgggaaatacccgccccgttttcacccctatatatgagttgtataactggatcgtacttatagcagtagaactgaagtttagttcttttcaattgaatggctgcttttgactgaaccctcttttcatttttcacatttattattttccgggattcagcggtacaagctgaaaacaaagggaaaaaaagaacaccattttcctcaagaaaacaaaaggcaatattacattttttgctcttgggatcgaaaatagcatcaccaagaaaaagaatcaacgaacatgttactgcacctcctgcactttgcatccaccgtagaaatatgttaccactattatgtacacttgaaacgatctcgaacaatacacgctcacacgcgcgcacacacgcagtaacaggcaaattcacgccctgccgcggtcgcactttgcatccaccgttgaaatcttgagctagccgcccctgtccctgctctgcctcggcgagccggacacggagctcgcgtaccggtgctcccccttccgcatcgcgccctccgcgtgcaccgccgacgccacgtacctcctcttcgccttggccgccgccgccacctcctcctcgccgtcctcacccgcggccgcggccgccttcttcccgtcgtccttggcagcaacaacaacggcggcagcggacgggacggtgtagacgaagggcccggcgagcacgtcgccgcaggacgtctgcagcagcggctcgagcgcggcgacgacgtcgcgcatgtgcgggcgggacttgggcacgctgtggaggcagtggtacgccaccatggcggccttccccgccgccttgtccgagtagccgccctccaggctggggtccatcacccggtgcagccgctccggccgccggaggtacggccgcgcccagtccacgaggttctgctcccgcccgcgccgccgcttgtccacgctccgccgccccgtcagcagctccagcagcaccaccccgaagctgtacacgtcgctcttcgccgtcaggtgccccgtcaggatgtactccggcgccgcgtacccgtgggtccccatgacgcgggtcgtgacgtgtgtcgcgtccccctgcgggccctccttggccagcccgaagtccgagagcttcgccgtgtaatcctgcatcgcccaacataatataaatctctccgtcagccacaacatcataattaactatagctaagagcaagtttaatagtatagccaactactaactttaaatcatttataactaatctaatagtctattcatacaatagttaactataaaaatatactcacaattaataaccggtcccacctctcatacacacataatattttggagtatgtgttgcagctgtttttctctctcttctcttttcttctcgatatgtgattatagctggcttatagcatgcgtaactgctctaatgtagcattgttgatttgaacttttgtttgtatatggtgtcagcttagtctatgtttctgtgtaacataaactgtaccagactcgataatgttcacgtgtgattttgctactacaagacgatttcgtgtcaaaattcgatgctacctgccatgggccggcatgtgtgttttactcgtagaatgttctctttactgtttaggtgggtaattaactagtcaaagagagtggttagctttgcaattaattgctcggacaaacgcttgacctgtacaattttactgttctagaggctttgtagccacagtgctcatgaacagcctttgcaacaaccaattgtgtaatctggccggcgatcgatcgacaccaaaccgtacgtttccctaatttacatatctgcttagaataacacggacgtttttgtccgattaggtaggaggcataaataaacaaccaacccggaggagagtagtcctacataatttgttcatttctttaagttttggatgcactagtacttaattaattctccatttcttaagttggccgccacaactaataaagtttgccacaaagaatcgacagagattggccaaaaactatagttcaaatcgtgtactctctactctatatacgtgcgtgctgcccctgcagctaaggtatagcttatggccttattagattcagaaaattcagaattgactagtggcgatctggcgattaggcgaacgggtcgtagtcaccaacgcagattaagaaatcttaattattggagccgatcgtacgtacgtgtgcaagatagacctggtaaaactaattaagcataattaataatcagaggagtactcaccgagtcgagcaggatgttggatgccttgaagtctcggtagatcaccggagtgtcggcgtcgtgcaggaacgcgagccccttggccgcgcccaccgcgatcttcagccgcgtcgcccacggcaagctcgacagcaaatctgcaagattaatcaattaaccgcgctcagttaatgatagcaattactggttaataatgatagtgcaattgattagtgagggtgattaagcttactcttgaagaggtggtgctcgaggctgcccctggccatgtactcgtagacgagcatccggtggtcgtcttggcagcagtagccgatgagcttcaccagatgcggatggctcaacatccccaggtacaccacctccgcctgtgcgtgacaaaaccacgcaattaattagctacgaactcgactaattatcgtcaaagagtaccacggaattactctgtacgtaccagccattcgcggtggccctggtcgccttcgccgtcgaggtacttgacggcgacgtgctggggttggaggaggccggggcggagcttggcgtcgatgaagcccttgtagacggggccgaatccgccctcgccgatgaagttgctgccggagaagctgcgcgtggcggccttgagctccgccagcgtgaaggcctgcagcccggactgcgccagcgtccgcgacaggtcctccagcgacagcgaccggagccgccccgtcgcgctccgcatccgcctcaccgccttcttgttcttcaccaccgccgccgccgacgccttcttctcctcgtcacctcccgtctcgtcgccaccgccgccgaagaagcaacgcaacatcctcctcatctctggcaccgcgccgccgcgcgcgagtgcaacaacaacgacaacaacaacgacgagagaagaagtcttttcgcgggagagagtgcgggtgaggtgaggagggaggacttggtggtggaatggatggtttgacacggagtggggtatataaagaggaggcgggagggagggaggcgtgtggggggttggttgggttgggttgggtttgttcgttgggttggctctcggagtctcgtgcgcgctcgcggagtcgcgcgtatgaaacggccggattgacctgatcacctaggcgatgcccacacgccggccggacggctgggttaacttggtggtttccgcggggggtgatgtgatgctgagctctatagcctctatgtccccctatgaggccgaggccgtccaggtagcttgacataatggattgtttctctcctgttttttttgtaaaatattttataatagac

SEQ ID NO: 20926 - DNA, 10267 bp, Oryza sativa
aaaaacgattgcacttttaatgtagcagagagaaattacactttaattccgatgaatattgtggaggagctataaaagtttcagagccaagacaaaactaaccagtacattgagtattttcttaaaaaaatatatatgcctaatttatgcaaaagaaaaatgtgttcaccaacgagcccagctcgtcacccaaaagttgttgagaggtggcttcgctattggatgaattaatataatagtaatgattctagattaatcctttcacgatcctcgaggtggtataattgagtgccacagtaacactaaatgtgtactccctccgtcccaaaaaaaaaggcaaaccctgggtttccgtgtccaactttgactgtccgtcttatatgaatttttttataattcgtatttttattgttgttagatgataaaacatgattaatattttatgcgtgacctgtctttttaatttttttttcataatttttttaaataagacgggcagtcaaacgttgggcacggaaaacagtgtttgtctttttttttacggagggagtactatattttcaaaacttatttaaggatcttaagtattctcttttcatagtaacgttacttcgtacatacgttacatgcgtataagaaattaattaatattttaatgcagcattcttggataactatgacaatatttgtgctggaccacactgatgttgtttaaactaagaagttgtaataagcgttggaatttcacacatttgaaaaatataaagtagtcaatctctagcatttgatggatgtaaaatggtttaaagatgatgtgactgggaggggctatgtatgttgcttgtggaaagaattaaagcatggatatggtcggcttgttgcttactacctccgtcctaaaatataactatttctagcacagtactttatcccaaaatgaagctatttttctacctacctttttctctcaaccaatcacaaccattctttttcacctactttctctttttaaccaatcacacaccttcttcaatcattctcacctactttcttaatacccgtgccaatctaaaaaatatttatattttgggatggaggaagtatgttttgcatccgagtcatggtaagacagagacatcttaccttcccttcaagtttctattagaagatcacttcatttatgttgttttctactagatggtttattttatttttaaaggggaaagcgaccatgcaaaaactaatgatgtgtttatggatcttatcatctggacttgtagagtttaaacagacctaatgatcagggtgtagaacatctgatttgaatatctatctatctatctatttcatctgtagctaactgaagccaaaaacaattcgactagggcttatgatcaaccgattgatgttgaaggattatagcaatgaacgtaacgacaatagaagtagagaactgccttatttttacctacatcaagctcgtcagttcaccctaaaacatatggatgcacaatatatagtctatctcatattataagtcgttttaattttttttatagtcaaacttttttaagtttgatcaagtttataaaaaaattagcaacatataaaacattaaattagtttcattaaatctaatatttaatataatttgataatatttttgatttgtgtttaaaatggttctatatttttccctacattttgataaaattttaaaaaaattgactggaaaaaatcaaaatgacttatgatagggggagcgcagttaattggacatctagaaagaaagcctcaaaatagagaacatggataactagctatggcgatagctaattaattaatcaaatgcttttatgctaaagataaacacgactaaactttagtaaaaaaatgcaggatcaatatcgatgttgaaatacaaatgtaggggggagttactccttaactagtggaagagcagcattctatatatattatgcatttggtgaaatagtgtcaagtgcatgggtttgcttcgaactaaactatttggtgctcgtgctcaccatgcgatcaggtagaagaatctcatgcacatgcacacatagttccaatcaaaggaacggggaatccaggaaggctggaggaaagcaaggcgctgatacgaggaacagtaaaataatcagccaaccaaaccaacccttgcactgtactagactgttcatctatctgttgttagatttgcctatggctggacgattggcctagagtaagtttaatagtatagcccactactagctccaatttatttataactaatttaatagttaattcatacaataattgcttactatactattaatatatggtctcactgtcatacacacagtgtgtactggagtccgcgctgcagctgactacagatctatagcccgctgctcttctctcttattttttatctcattaaaatatatttacagctggctaatagactgttattgtacctgcccaaagaaaatatgtttagatcaacagatagatggacacctgtaagaccatatcataatacttctggtgagaatacatgatggagaccaggatgaatgattagccgtatctgcactcgatttgtacgatgtgtaatctctcaacgattgaggtgcacatgtgtgtgtggatgggtgtttgtcgaggaatcttggaatggttgatgaaataatggccattgattggctctcgtttctcctgagtcaagtagataatcactttgtttacaggcgttgttcactcttcgccatcagcataaccttttaggttgaacgaattatttcgccatcagcataatcttccgtaaaattcttgctttttgaacgggaaaagagcctgtctattcgtgatgcggaaacaagtggatggtgttaaagtgaaaagaatgaattatttgtagtcctacagataacgagatcataggtgaaaagatagcgtgaaagccatcctgtcttcctgattttgtaaaaaactctcactctgtgtccctataagaacagagcataaagatggctactcatactgatttttcaacctcgattttcagtgatatatgtacgattggttgatgaactaactgcacgattcaccgtcacaattactcagtacattcgcattcttatccactaattaatccatcccatttttcaaaataaaaaatatcagccttgaatatatcttgacttcaatcatcgttcgctcatagtataattcaatcccagctctcaggaaaaacctgtgcagtattttttttctcataaccggaaattactactgctgctgtactatgtacttgcatcagcactaaaccattttaattttaattcgccactaattgtaaattcgggcgtgtgccctcgcggacacggtgtctggtttgatttaattttcttccaaccaaactgggccatgagacgctccccgacaaaattggaggattattacagagattctttgcagaaaaaacacaaatctttgtggattaataactaactaataatgcaaacacgttctccaaccaaccctgctcgagatgagtacgagatgaaacatggttttggatttttggagctgtaccatgtttctagaaatggagcggctagctaagacattgaccatttctgcttaacctaactactccctccgggttgataatacttatcatttcggaaaagggtgaggtcaaactttagaatctttgattatcaatcattttcaaaatatttctctttcaaatatggtgactatatgtatagattggtcttaaaaaaatactttaataagatcatatatttgttaacacttttatatatattataatagaaaataatggttaaagttgtttttttgacaccgtgccattgtccaaaacgataaatattatcaacctggagggagtacccgtatgagctagccatgattaggggaccagcactgtactactgttgcattagcacttagccgcagctacttatctgtgagatgatacttcagtactttgtttgtttcttaaaaaatggatttgggttgtcatgtagtatgagttggtaggattagtcttaaatggtattcagtagttggggatgagaaaaaacaatatcactcgacgcggaacagttcatcaagttgtaagtaaaataaaattacgattggcaattttgtaagtatatacttgtgggcaaatgtatcttgttaggtcaatggctgctttgcaaggatttccttgagctgcacaatacaagcactgatcatttgagaggatatcatatcatgtcacaagattgtaagacctcccttgtgggcctgtggcagtgtcgtaattctgacggtttatacgggttgtttaagtatagtcatgttttgaaatataaatatttctaggttttgtaattatagattatgtacatgttttaaatgtaaactttgtaaatttgtagaaaattaaaatttgagatgaaacagagattgtctggctagaatagtacaacatactccctccatcctaaattatagggtgctatcctttaagaaactaggtgataccccgcgttttgctgcgggacttatgtataagtatattttaaatattgttaaaatgataaaagttgaaatgttgagaaaataatatgaaaaagatgatttgacacatacttgttgatctctataatataatattgtagatgatgtatcatgtttgcatgaaatttaaaatatactataatagtaattgctagtgagtgaaaatatgacatgtttgcatgggattttaaatgggctagaaaagtaattgctagtgggtgatgatgtggcatgcttgcatgttgagctttagcttctaataattgttagtgggtaccaactatatagaaaatatagatattaaactcggtatttttttctattaattatattaactatatgtatatatgctaggtatatcactagatttatattttaaaataatttaatacgatgctaattttatattcattagcaatataatatgaaataaattaatgatctatcctatgcacacagaccctcacgtgtacacacgtgcacaccaactaaaaaatatcaccaaaaaatctaaaaaaaatcatacacatactttcaatggtattacatttagggctaaaatcttaacgtcaaattcattatgttttagccgtaacaaaaaaaaaacaaaaaatctgacagttttaaggttgtaattttgtcagaattttatcttttttgttattctctatgtagaatgaatttgaagatgcgattttgcacgtagatgtaatactattgaaagtacatgtatgaatttttctagaattttttgtgataatttttagttggtgtacacggtgtgtacacgcgagggcctgtgtgcataggatacgctcccctatatcttggaagatcgttcttataatttggaaggaatggatagagtaccgtacaagcagccttccaatggaagcgtagaagcaggattttagtactgtagtgcacatacatttcaacctccaccgtgtgcagatgtcaaagggctaaacgtttgacgagagctcccaacattcagaaaccggacagcttcctcccttgaagaattcagtcatgtgctcaatttgacctgtctcagtactcctacggagcactagtgcccacacggctctacagcctttggactcttcctcctcctccgtccagacaagggagagcttctgcttctacgcgttcgtgacgctggatgtttctgcatacgagagaagagaaaaaaaatgagagctctgcatggtttggtttctgtcattctgtgggcaaatgcaggccatgacggctgtaatctgtagaagtattgaatttgaccgagacctgcagtagttagttccggccgatttggtcaaattctaattttcgtctcaaagtgctgctttgcggctggcacctggctagcgagcagtatggtcctttcttcaggttcaggttttgatttttttgaaattttccccaacttgaaaatgcaaaggtttctggactttaaaagcggtatgattgtcatttgtcaacgtttgaattctctagagacctctttcgttagcggctgcggcaggtggtttaaacagagtttttgagtttcacatgcctttttaagttgctattgtttcgtatcctgaaacacttggtgagttctagctgtttcggaaattaggcaccaaaatctgctgttaggtccagtgaagattcgcctttttttatcgattgtgtgccggcttttcttctctgtgtccagttccaaattgatagcatatccaaatctcaactttgcaacgcacttttcagagagaaaaattctccggttgaccaaataggcttcgaattagtaatgttcagtccaaagttcaaatccttgccctattggtgttgctcatctccaaccaaacaagaggttttaatttacagcccacaggtataatacataggtaaccaagttgggtttcattgtttcacacgtcttctacctggtcaatgcaaagaactgttctttctcctggtttcaaaactctccaagtacgccacctaggcttattaagtatgtgacattatactttaaccattaatattatttataatatatatataaacgactacaaaattagtatcatataaaaatattttaaatacgaacataatggtgctgacattaaacacatgtattttttttactttaattattaaccaaaattcctgatatcttatattttagaatgtacagacactcataacgcacgcacactcacttctatgaacataacacacgcacgcacataaaccctatctctataagcatcttctcaacgtcgttactaccgaggctcttctaaactaggctacatgtactttcgctctaaactttaattttattctcgtttaatttcgtggcctttgcatgcatggagagctaggattgggaagctggcaacaaggagaatcagtatgcagcttcaatctgacgatttctctggacgtgtcatgtttaacaacggaagcaaaagcaaacgcttgctgatgacgtgccacgcgttgtgtggctttcagagcgtttaaagacggtttttctctgtgctctgaatatacgtacatgtgtagtacgagagatcggaggagaaagcgaaaacgacggcagctagttgtagcagtagccagtagcaagcgtacgtacgcgaaagcgaaatgacaactaaattaacctcgaatccgtgctgctcaagatgcccggagagcttcaacgcttttcgttttttttcttttgtttaattttatcacgcttaagaagataactgaaactaaaacgtgtttgcctcttcataaacatatatcatcgattaatctgcttttccgagttgtttcacgcgacgacttacgcacttacatgagagtgcaaaacttatcaaataaataaactaatatatatttttattttctgtaaagttgcactctttttgtttcctctgttgcttataagccgtgcaaaaataacgaagtaactaaaaatagcctatgcgtgaaacctttatctatgcgcatttagcaatttaaaagctaatataaaaaaaccacaataaaaacccttaaaaataagtttcaaatttaaattttggctatggcaaataagccaaaagataaacgatgtaagactttggcattgggatttctgaactcctgaaactgtacttatcgtctgtcctttctttctgaagctacacagaaattcagttcattgcggcccagatgtaaacacgtcccttttctcagtcactgtggcagcctagtcatcacgtgaagaacactatcgagctagttgcactgatcgtatctcaactcaattggtcgtgatcagataagattggcaccacacgatcaatcaattctgcgacggccaaattgcagccaagccgttgattggtttaatttcagatgttagcgtgtcaccggcctcttcgccattgatggcagcaagaacgcaagaacctggagatcgaccggtctgacgacgacgaagacgacgcacacgcgcgtagtaatcctcaaggcaagcagaggatctagctaataagtttcttgcttaattaatccatggaggggcataagaaaaatgatcaaaaatgtcagcaacaatgataacaaaaagacgggtttagctcacataattaagagatgataatgacatggcataaacaacaaagggtcgggctaactcatgtcgaaaacgaaagtaaacgggaagcacgtgaaaagcaggaagacgatgcacaactaaaccttacaaaatttctttcagtaatcgcttagcattagtcaacagcaacataagaacattcttatcaatgtctgtccctatgttaattaatctgccgagtaaaccggatagtttcacactatggagactggagataatacttttttgcaggccgcgtagttgaaattaagagggcagggctagtccatcaacgagtgattgattgcatgacatcagtgtatattcagcgccgcggtcagagacttcagggttaaactaatggcgtttttgtttagcctgacgaaactatgtagtagtagaagctgaaacacgctttaaattgcacgaagtcaggatacgtacctactagttaacctgaactgcatatctgaagttctgaaacgtgctgacaatttgtgtatgatcgttcaatccattcacattgctaaaagtccgtggattagcactgtaaaggaaagttcatgcgttcgtccaggaattgaactcttttctgtcaaatgtcagcattccagatgaacatgaaaatctagcgtttttgaaagccctgcaacaaatggtgtgtttagttcctgaaaaaaaattggaagtttgaagaaagttgggagtttaaaaaaaagttggaagtttatgtgtgtaggaaagtttttgatgtgatatgatgtgatggaaaatttttgatgctttttggtttttgaaaaaaaacatcgacagcaattgggtcggagttttattctccgactcgcatcatctccgatcggtatttttttattttctccgatgggcttgcagaaaatccatatagatgcagaaactagcactgcaagtctgcaggagaaaaagttcatgcgtttccctatgaatatttgagcatgttttctgtcaaacgtcagcattccagatagatgagtctgaaaatctagcgtatatttctgaaatccctggaagaaaacatcgagggcaaagggggcagtttgttttttcaatttccgatagcctgaacacgttggtcagtattatcgggatcggagttttaatctccgaccctccttgagtcagtatttttccttttttggagccctcaaaaacaagacgaacagattgaaactccgaaccccttcggtcgatatttcctacgagacgagacaagacatgcaatccggcccattaatttgtgtccaaatcgtcattcataaacagtccatattacagccggcagaaaacgttacaaacacaagaacattcttatcagcgtccatatgttaatcaatccgtagaactcactcactcaggtatgctggacagtttcgcactacagatagacttttgcaggctgttgtgtcgaaattaagaggcggttctagacttctatacttagctgctgacgttagtcctccaacgagtggtatgagaaaattgacatcagtattccgtgggcagaaacttaaaggttaatctaagacgttctgttagcctgacgaaactgtaatagaagctgaaacacgcgctcttcaggaaaacctatcaatcaaaggacgtgactatcaaccgtgctgacatgctgtgtaactgtgtatgatcgctaactccgttcatattgctgaaacgtgtctaattgttttgagccttttggggtcaaagatgtgacgtaaccgtggagagttttgccgatgagcagtgtgctcaagaaacgcagcagcaatcttgtgtttatgtgttcctccaggagtattttatatttgctcagtttctgtaaaacgtcagcattttaaatgaacctggaaatcttgcgtatcttttgaaattcttgaaagagaacattgagggcggtggcagtttatctttcgaattttattgatagcctgaaaaattcgatctagtgtgttggagttcctgatagagggcaacgcggccgccggcaaaaaa

SEQ ID NO: 20927 - DNA, 1877 bp, Oryza sativa
gggttgtgtgggtgttaattctccaagagtaaattgcatcggcgatacacgaacttgtcagttatgtaaaatctagtgtatgaacttgcaaaatgctcattttggtgcatgaactaattatcttgtgcgtgcaaaataaagtcaaaaggacattacatgactaattttgttgatttatgtgctgattaggatactacgtaaacatatatacgagaatgttgctacttggacatacacctgttcaataaaaagatagaatgagatatagtgattgtagagaaatatataaaaaaccaagcaatgatataagggttagaaacatacgaaattcaagataaagtagaaaacaaatttataaatatagcatgtttttatgcgtaattactatacgtattcacgctacatcctaatcaatatcagctaggtggaattaaccttgccaagccattttggacctagtttgcacggattagataagttcgtgtaccaaaacgaatattttacaaattcatgtactaaattgcacccacctaacaagtttatgtatcaccaatacaatttactcattctccaacctcctttagactttttttcttttttttaaaaaaaaaggcaaaaggggcatatgcagcaaatcaaggccaaccctgccaccatgtcaatgtcatgggtcggtgtagccttgtcaaaaaggtaaaaaaatcgaggtataggggttcggagtttttatctctgaaccctcgagtcggtatttttcctttttaagtcccaaaataggtcagtaaatgttttgtttttactcgcggaagcagtatacttggtttttatataggcctgtaattttttttatggaggcctgtgaaaaattgaaagtgtaggtggtaggagttttcatctctgaccctccttatttggtgtttttttggtctaaggccgagtttagtttctaactttttcttcaaattttcaactgtttcatcacatcaaaatttttgtacatacataaactttcaacttttttcttcaaacttttaattttagttaaacttctatttttggcgtggaactaaacacagcctaaattgtccttccaaatacattggcttctgctgcgcaacaattcagcccacttttgcggaacggcccaagatggcacctgcagtaggtgcactggcccgtagccaagttttcccagcccagccatgactcccttgagggatttagggggttcggagtttcagtctctgaaccttattgagtaaatatttttccctttttggagcccaaaataggtcagtatatgagttgttttactcacaaaaacaatattagctttctttggcctgattttttttcctgatggagaggcctgtaaaaattgaaggggattgtcggagtttcaatttccgacccttttatcagtggaaaaagtacaccggaggtccctcaacttgtcaccgagttacaaaatcgtcccccaaccgcaaaaccagatatccggcgtccctcaacttccaaaaccgttcggtccttcggtgtttttggctccggttttagcctacgtggcgactgagtcagcgtgggccctacatgtcagtgtgtccacgtcatcactccctctttttcccatctctcatcctctcttatcccgtactactcagttactcttttgggcaggccgaacccgccggcgcaaggtggggagagggagggcggccggcggtggccgacgctggtgcggcgacgacggcggcggcggcggccgatgctggggcggtggcgactggcggtggccgacacgggagaagccgagacgatggcttctcctaccgcgggcgcgaggcgggtgggagggcggctcgatggtggtcgacttt

SEQ ID NO: 20928 - DNA, 6259 bp, Oryza sativa
acggccacagccccaccgtttcccaccattgccctcgttggctctgggtcctcatcccaccttcggccacggcgacctcctccgcctcgccctcccagctgcgagcgggatggccagcgactcggcgagggagtggggagtccggcggcgagcgcgcacaaggaggaaagaggcggggaggcctctttatccgcacggccgccgcccgtcggccctatccctgccgcccccgctcctccgccgtcgcctacagcctctgcgccgccggcctcctccccaaccggcctgctcccgcgtcgtcgccgccgccgccgcgtcgcctgtcgccagccgtcgggccttctctcctctcccttcttgccccggcgacctcctcacgacccactggccggcctggtagaggagaaaagcgagagacagagagaaagaggaggaagtgaaaggagggaaggagagagagggtggtacgtggcatactgacaggtggggcccgcgtgggtcccgcactgactcagccgccacgtatttcaaaaccggaatcaaaaccaccgaaggacctaaagtaaacggttttggaagttgagggactccggatatctggttttgcggtttggggacgattttgtaactcgatgacaagttgagggacctccggtgtactttttcctatatcagttatactatatgtttgggcccaaatcgtccttccgaaacggcccataatacagcggcttctgctgcgcaacaaggaaaaagtacaccgaaggtccctcaacttttcatcaggttacaagaacgtcctcgaaccgcaaaaacagatatacggggtcccttaactatacaaaaccggtcacaataggtccctcggtggttttggtcccggttttatcctacgtgactgttgagtcagcgtgagacccacgtgggacccacatgtcagcctgtccaggtcagcttctctttctttcccctcttctctcccttcctcttccagtcttccctctctctcactcttctctctagggctctgggcaggccggcggaccgacgaggcgaggcgggagaggaggtccggcggccggtggcggcggcggagacgacgcgggagcaggggagcaagtcggcgacggcggcgagatgcccatggcgaggtactggaggcggagctccgtcgggacggggagcgggacgatggcggcggacggcgggcacggatcgcgtcgcccgcccgtggcgacgccagcgccggcatcgcccgcccgcacgcgatctcccccaccgccgatctaatgatcagcactatgcactacatggcaaccattggtggtagtgtggtactagtcgtggctaactaactggaggatttcctcatcattcctgtaagtaaacagcagcagtcaattcacaacaatggcatctcaccgtcaccttgaacacataacaggtgctgaagggtttggtagtgacgatggggtcatgcagtgttgttgccactgcccactggtgaaggctttcaccatcgattgctgcggcatttgcttcaagagattcctcaacgtccatagaatcgacttctgtctcatcagactccattggcacttcaaagaattctctcttttctgaatctgaagaagaccaattagatgccgtggcaatttgtggtggcgtccaaggaactaaagccaagaagttgctgcacccaggagatttgtcctccagcccgtgatagttcctttgcataaaaacctgatctgaaagatgagaaagaaaatggtgagaagcaatttcaaggtatggatgataatcctgtcctgacatacaggagatcttggtgggactcgatgaggaggagggccgagggcaccagcacgcattgcggcgagccgcatggcgccgggcggtaggaggcggaggcggtcaggttgaacggcgacgaggcggcgcgtctggccgctgacaggggagaagcgcaatggtggcgctctgcccctcgctgtcacctccccggtcccatctttggccgccgtggagccccactgcggccgccaccgccgccgccgtcgccggccatcgtcacggcgccgccctcctcctcttccgccttgccccaccgagctccgggccggccgccacccttcatcgccagagtcacgaccaccatcgcctcgccagttcgccgcgccgagcaacaggaagagaggcaagaaaagaggggaacagagaagatgacgtgtcatactgacatttggggcccacgtgggtcccacgctgactcagcagccacgtaggataaaaccgggattaaagccatcgagggacctattgtgaccgattttgtatagttaagggacctcgtatattggttttgcgatttgaggatgtttttttatcccgatgacaaattgaggtaccttcggtgcactttttccgcgcaacaatggggaccattaccgcggaccggcccaagttggcccaagtgcactagcccagccacgagtcaatcggtgtcactgaacagcgggccccagggagaacggcgcgttctgggccccaccctgcagcgactccggctcgctcgagcgagacagcagccaaaccctccactcctcgcttctccggtggttctcttctcttctcttatcccccggagacgccgctgcggcgccaccccctcctcgccgtggacctcggggtgggagcgtggcggcctgcacagccggagctcagctcgcccgccgcgtcggatggacgccgcctcctgctgccgcgtaagcgcgggcgcgctcccccgatttccgttctcgcttctcgaacgttctagagccttctacggtgggggatccgtgtggtgtgacccatcgtcgcttctctcgctctcgcaggtcttctcgacgcagagatgccgcttcccgctgcggaggctggcgccgccgatttcgcggcggccgttcggcacggagtcgacgagtgagctgttcgccgcgtcgacctcgaagcggcgctcccgggggcccgtcatggcggcgaagaaggccgccgagggtgagtcgacttgatcccattgctgtactgttcttatttttggttcaggttgagggtttggtgagggttttagtagggggattggtgtctatatgttggtatttcagtgatgtgagttttggctgtggagtaggtgcattaggcgtccgatttttcttgggattactctgtgtctgtggtcaatgtatatcgtacttgctctgtggattgtggggatgccagccatttttgtctggtgaggcgttggaggttgaagctggtctatggcctggagattttcgttcttgctgttcacgttttgatgggattgatcacagggtgaggcacatgattacagatattgaactcgtgtgacgtacagcttaaactggttggttaatttaggttcaaatatgtgattgtagtttccacttctgcaattgctataattattttcagcttaagcacgtagggcttattaaactcattaccaaacttgttttactgcagttttctgttacatttgtacttttatgattgatgtgtgttacttaggctcaatctgcttggtttagccttaagtatgctatgacctgggatttttgtaattggtgtacttttcagatttaagaatgtacacacctattggacttctcagttcgcaccaaaatgcacttattaggtctcaagcaccatggttggaagattattattgttttgcgtatcagattaagcttaattctcattttctccatttggagtagcatcaactagtgctcgaaagtcgaaacttgatgcttatgcttgttaggatgaaagctgtttaagcttaaatgtgttttgtatacccagaattcggtaatcagattgatttttgaaaataactttgttatctggtgttagttgaaactttgttatttcagtacattccattgagattcaaatgcagtgagaccctctgcttacttagtaggtgtcaatactgaagcttttactggcaaaagttatggtgtattttgtaatgaaaatctcgtagagacatgtaattaattttatctggctgttttataatgaatagtagttggtagtttgacaggttgagtcccagtttcaatttagtactgcttgcagagttaaattcattaagatataattatatatttagcttcttgattctggctaggtgctaaacaagaagaggggaaatacaaacacacggtggatctaccaaagacaacttttggcttgagagctaattctgttgtgcgggagccggagctccagaagttgtgggaggagaaccaggtgctcaagagggtatcagaaaggaacactggggtgagtatttcttcgagtaaagctaaaagtaaaattaaaatttacctgactttgttggttttcttgactgttggattaggctacatttgttctccatgatggtcctccttatgctaatggtgatcttcatatgggccatgcactgaataaaatcctcaaagatattataaaccgttacaaggtatcgtttactcttcaatctaatctgagtatttttctttaaaaaccattgatgtatttttcagggcaattactgatgcagtcatagtatgttgtcttattcagttcaatccataggatattctctgttctgagatcaatgttactgtacggatgattggtgcatagattttattgtcttttccaatgcagtgcaatttctgtcatttctttatcttaacatgtagagctctttagtgtagttgattgtgtacgagatttggatgattaatgaactttttgctaattctagtagttttttcctgataactctcttcgctgaaatgtctttaactttttttggctggatgactatgctttttatgttggtccaaaccaaaattgggaacataaatcaactgacaccaaaatttgcttttcttctgtgtgcagctgcttcagaatcacaaagtttcttttattcctggatgggattgccatggccttccaatcgaattaaaaggcaagttcatctttatatccaatggaaacaccctatgtttacaagaagttaggtaggggttggttttaacacaatgcttgcatgtgttagaccagccaagtaattattgaatatccttccaaatgtaaccattgactatttgctgcagttctaaagtcactggacaaggaaacattgaatgctctgacacctataaaattaaggcagaaggctgcaaaatttgctaaagcgacggttactacacaaatgaattctttcaaggtaaccatttctttattttaaagtactttagtggtgacatgatctaatagcaagttgcccttatctatgttttgtggtatttcctggtatgattgctgacttgcagtcatctaatatctggaattctgtctcatgttagcctttagtttcatatttctataattgtattaaccaatgacattgtgcctgcagcggtttggtgtatgggcagattgggacaacccttatctaactctgtcaccagagtatgaagctgctcaggtctgatcctattgtttatagtaattttgccattgcatcaaaacttatttatccatttcacatgaatgaaagcttggaggtttggaattaccttagttagatcattgatatcatcttggtcacattatagctgctagctctaataaaaaaaatagagctgtttactttcagttccttttagtccatttaccatcgttgatataaaatatataacgtgtatgcaaattttatgctgcgagaataaatactgatgttttctttttcatccttatcatatgtttttaatcaaggctaaccgtaacaactcttgttctccattttgatatgccagctagaagttttcggccaaatggttatgaaaggatatatctaccgcgggcgaaaacctgttcattggagtccgtcatcacgtacagctttagcagaagctgagttggaggtatgcttgaactttctacttgatgctattaatttgctgtcaaaggctttgttgtgcattaatttttaagtgactattaaatattcgaataaaaaattgacaattccgatttgtttcctgtttaatttcaataattttcttgtgcttcagtatgtcttctcagtgaaaagccactagatgtgtcacttatttcttcctgttaagattaggcctacaaaaggggatccactagtggtagagtaaaaaccaccgcggtg

SEQ ID NO: 20929 - DNA, 8249 bp, Oryza sativa
tggatcccgcttttttatgaaaccatcgagtacttgaacattactgtggctcaccttctgccaaacaagcatgtagttctaacgtcggtagtatctagttcttgtcacattatgggtttgcagcatggttgtatccgagctatttaagcaatataaaattcttgtttctaataaaaagaataaaaagtgaattagaatgagatgccatcttttaaagttgtcgcatctaagtgtgttctctgatttgtatttccacaatgaggttttagaaaatttctgttctaggaaaaagcctgaagttattgtatccaataagtgatccttttagataatggaagctttattacgactcagtcaattacaccaagatggtacaatccaactgagcccacccccggcctctgcattgaatgcacacagccaaaaaagaaccataaaaaaccccatcccaagcacaggagtgtgaaggaaacataaaattagtggttatcaatccgtagactagactgccacccgtgctcctgggtaaaaaactcctgcgccacctggtccaaacgtcgtgataccatttgtcatgaagctgttaaccatttatgtttgcacttttctgaattagcataggataagccttatgcttgacaatgcttcccaggaatttaatttcattggcccagttatctctttattttgtgtgtgcataatagaatttctgggttattttcctctgcttggattttagaatcccaaaacatatgttaataaatatagtttgcttgttactcaggtatagtgtcaaagaaagggagtgatgcctggtggtatatgacaattgaggaacttcttcctgaaaaatatcgtgataaagcatctgagtatcgcaagggaactgatacaatggacgtttggtttgactctggtaggattatgttttcattcttcctctattaatggttttgttaacaaagctcaatgtttgatgctggtcacaatgcccaaaatcaatgttcttaggagaattccatcttgtcttgctctgctctccctctttgaaccttggcagttttcagatgtttgtagttttaactgctttaaccttcaaattgaaccaaactgcccaagccatgtgctataattctctcttttttatactgtggtagtgtaccgtttgctttgattttggccatacgtatgtcacagtgtggcgccgcttaggaaattaactatttttaaggtgtagcaatagacacttttagtagggataagattaaactctaaaacatcaaatgaaaaagactggaggtaattacttgttattgagtcgtcatgcattgtatagtttgccatatagtttttgtttacagacctcaacttttatttattgactctattaagggctcaaggcgtgcatattgtcatgattttctgggcgaagatagagctttgcatagtgtcacaatgttctaggaaaagatagagctttgctatagtgttttcttaattattttgccatcttttcttgtgtccttgactttttacttctgcatattttcctaatttaggctcctcatgggctgctgttttggcacaaagagatggccttaattttccagcggatatataccttgaaggttcagaccaacaccgtggatggtttcagagctcattgttaaccagcattgctactacaggtaattgtgggctagaaactcgaatgaaaatcccttttttgaaaaagcaagttgttttgcaacattaattgcccaaatcatggttcatccatgatgttatttattctagatatataagatgttttttgagccatattcggtttagtgtctgacatttcaaccactagttgtgcaaatggtgaaaatttttctgtaggcaaaggcaatagaacaatattgcttgatatagttgcataatctgaaaccacatgtgtgttttctcttgatatatttggaacattatattctgctggtggacacaataggttttctatttataatttttccattaaaaaacaggaaaggctccatattctagtgttataacccatggttttgtactggacgaaaagggtttcaagatgagcaaatctcttggtaatgtggttgatcctgagaaagtaattgttggtggtaaaaattcaaaggtacgttcctagaaaagcttccgttctttctggacttctagttttgcctaatgaaatatcaatcaaccttttgtagcaagaacctggctatggagcagacgttcttcggctatgggtttctagtgttgattacactggagatgtgttggttggtccacaaattttgcgccaaatgtctgacatgtaccgaaagctacgaggcacaatgcgattcctattgtcgaatctccatgattggaaagtatgttcagttcaacaactaaaatttatttaggttttggataaggaagattcagtaccaggcagcagaggccattttatatgttttcaatatttcaaacccatatcaaaatgccatcttttactagttttacattttgcttaactttctattggctttattctttcctttatcgatgcaaagcactgaagctatttctgtttagataacatattgcagtgaatttaatattttatacagcctagttgaatacttttgctgcacataattttaatctcttaattatctatctgttttcccttcttatgttttgtttgcacattcgtttcaatgatcatttattgctctttattcttatcatccttttctctctttcctgtcaatagccagaaaattctgtgcgctacagtgatctaccgaaaattgacaagtatgcacttttccaactggaaaatgttgtgacttccatgaaggatagctacgagaactaccaattctataaaatataccaggtgggttaagagtttgttgtgcttcattactttcattttacaatgtgtgtgatctcttctatactttttgagattgtgtgatcgtagttggtgtatgttggtcaatggtcatctttctgagaaatgggaagtgcgcttcatgattatgatttagtgaataagagtttgatggtcaaaagtgaaaacttttagcttgaaagtggaatgttcattttctaattactgtccttttctgttctccattctggatcttgaatgatatgtttattggattctcaaatcacatgcacattgaatgattatatcatgccatttatatgctcagaatggtatgatatgcatacattattaaaagcaaatcctattgctaaatctctatccatgattggcaaagagctgcattatcatcatctctagataacggcatgcctgctgcatcatttgtttgtcctcttcacacttttgtaacaagagattattgacttgtgtttctatttcagatcctccaaagatttgctattgttgatctctccaatttctatttggatgttgcaaaggatcgactctatgttgggtatggctttgatatcttgttcattggccatctgattacgtttcgttacactgaaagctcagtcaatgtcatttattaatttagcttgccagcttcacaactttgtttttatcttcttatcagtggccgagttagctttacaaggaaaagctgtcagacagtcctcagtgcgcatctgctctatcttgttagagccattgcccccattatgccacatctagctgaggatgtatggcagaacctaccgtttcaacacacactggatgatggatctgttgctgagtttgtttttaatctaaaatggccagttaagaatgaagaatggctctcggttccaaaggatgatgttgattttctgagtgttatcctcgaggtatgcactgtttctgcataactttgaagcgttcacttatgacaacctcataggttatatagctttgcagtttttttcctataggtcgaatatcaaacttacgttaaaaaataaaactctgccttcaacttggagacgtgcaactcagacaagatttcttgtatacacgagtaactactacttatgatctgaaatagcatcatttctgctaaattacctgatcctatagtttataggacattgcggctattcttgatttcatggtgatgagcgaacttgcatttatgatttcgtattaagattaatttcatgattaaaaaattccattacttggcaacagttgagatcagaggtgaacaaaattttggagagtgctcgaacaggaaagctgataggctctagcttagaggcaaaagtttatctccacgcggaaaatgctaacacagtgtccaaactaaaggagctggtttcggcaaccaatgacgctgatgctctgcaccgcctgtttatcacatctgaggtaaattcaaaactagaggctgcccttctgcattcaagttttttttttacaccatctttctttgtttctgcaggtggagatccttccttccgtaagctccgaaactacatctggtgtatcctacactggaacttttagcagtgagcgcaccggcaacatctggattggtgtgactcgcgccgatggcgaaaaatgtgagaggtgctggaattatacccgagacgttggatctttccttgaccatcctactctttgtgcccggtgccacggtgtcattgatctgccaccagttcctgctgccgcggctgtcagctgaggctgctcgagagtgacaaggaccactatcagcttcatttgaagattataggtggaattaattgtttttgttctacaattttgttcccctctgaccgatgatgctagaggaaggggaaacttgaagagggtttcggaaacttagtttctaacttcatttgttgcgtacaataagttgtaccttgatttttgaccattgcttggcttcctggagctgtaattgtatatttgtattgcagaactcacacggattaaagatggaaacagttttgcacacgaactcgcatctccttacttgacgtaatgtcagagcgctagcaaacgaaggggcatttttatacaaaaatcaggaaccaaacgaacgagacggtccgaaattccgaatcacgttaccaaatactactcctagcgacccaaacgagagttttgtttctctacagaacgtatcggctcctgtattgggcttagctacaaagttataatgaagatgacgagtttatgaaggctgtatacgataggcttgagacaataattatgtaactttttatcaattatggttggagattcacaaatagatttcaataatgtgttcttcttatcttagatgagttattttttattttaaatgcttgttctcaatgatttattgaactacactcttttttgagtgtaactttgtaataaattggaaaggctgggatattctattcctctataaaaaacgagttttgtttggtaaaagtcaatcggaggggataacgcagggtgcgagaattatggccgttggatctttagatctccaagtctaggccattccccctctcgtggccggtcgccggagatccatcacccgccgtcgcccgctctccccggcgatcctccccgagccgcgcgctcgcttcccccgttgtcaccaacctccacgcaggatccgcaccgccgcttcttctctgcccccaaccgcccaatcccctatccctcgcgagactttgcacgcttaagccttaagcttctactaccatttggatccggagaccgggagaagttggagggcacggactccggaggcgtcacccgcgggaggtcccctctgcaccggccggctgcgggcgcggctctgatggcgcacgagcgtggcggcgccgcgtcgtccgccgcggctcccgccaccgaggaggatgcgctgtgagtctgtgttgcccaaatccctaggtccgtgtattcctagtagacgtttcagtcacgcttctggtgtcacttgatctgaaggccgtggcgattgcagcgaaattcagggtccttctcttgttagtgtcgtgatgcgttcagtgtagtcgaaaatttggtggttcacttgggctctggcattgcgatgtagtactaaattttgggcgtatgcagggaattgagactttgagagaagggaagagaagagcacaggtgatgtttgcttgtggtatccctccagttggtattaattcataaaattggccgtgtacatccaaaccggatgtagaggccaggttttaatccatcttctagtagaaaatttaattcataaaatgaggagtataagcaagggtgacatggtgtccattaaggcattaatacagggtcacttagttgagctgacttagcattcacatgattcttctatgacattgttctaatgttgatttgtctcgatgccttcaggatgtataattcttctttcatgtaggtttattgacttgctacatgaagctcctctctctggtcatcgagagcctagaagcattgttggtggcaccttgtactgtatcttgttggttagtgcaaatttcttaattacccattgtttttatttgtgattatgcctgaaaattatttcaaatgtatgagttcatttgataaattatctacaacagctaaaacatatgtatctctttctatcgctaaacgccattgccttatggtactgtcattacccaacaagtccttgttttgcttcctttgtccattttgtaatagctgtattttatttctctctctaggcaggttatgctgctgtggcagtgtcagccccatggatattttaccttgtaccagacatgatccccccattgctatgcagctccaatgttatcattctgattctaacaggttctctttgagatcagatgtggcatgtttctgttgctgttttctgtttgctactctatttagttattttgttggttcatgttttatcacttactatgacttatggtttgcatggaacataacataggtatttttcaacaatattgggttcaccaggtcagaaaagtgagattgcaggtatttaaatgaaacaactgccttttgttttacttcaattggactctgttaacaccaaaatttgatacaattctttagtggactcttactttaaactttgcatattaactagcacatttctgctttggatgcaggggtattacgattttagtgagaaattgaagcgccttgctcaacttccatttgccaccgttgctagtggtaagtatagcaccaaataaatttgcccgatgctgtaatactagtgcgttcttcattttttttaatgtttataacaagtatgtcctacttaactgcacttgtttcaacatgattaaactattgtctttggtatttatttaaggatctgttaaggaattgagattttgagaggttcatatgtaaaatatttttttggcattgaaatgacccattgtccatattctttttgttcttttggcaggcgttgcttcaatgctcttaatcatagtctggcaacctctagtacacatactatcggtttctttattgctaaggtacacctttgtaattgcagctaacctctgcaaatttctctgttatgtcttgaacggaagttgaggtttatccggcatcttttggcatgaggtttggtctgcggattcccaaacaagtttgggaacatgaattattctcttctcatcctttcagtgcatgtataatttctttcatttactattatgcaggattgctattgtggttgaagctatatgtgctggatgtttcatgagcttatacttatgtgagtcaagtactcaagtcatttgtgtccttgttagatagttcatcttgacttctacaattgcagcagttatgcttcccccaagcagatcctcagccatgcaggacaaaccttgcatgctggagggttcaaagccttgtcatcatgagtttcgatctcgtcattctttttttttttttgctcccactaagaacagtgttgcttttccttagaaatgaaagtttcaagcccgattatttgttttttctaagatataatgcccactcggttctttttacagggcatatccacaagtacaactctctgaatgggcaccctgatattttgcggtccttatattctgcactccaactccaaccatctagttctttggaagaacgaaggtacaacataagggtgtacattaaatgcattgaacttttccttcttaatttacaataaaatactacctccgttttttaatagatgacgccgtgactt

SEQ ID NO: 20930 - DNA, 7599 bp, Oryza sativa
tgttatcttaagccaagcaattttctatattctggccaggcaggtctccaaaatctcacctgtctttggcctactttttatgaactcttgcaaaagctattactatagatgtttatagcacgataatttcttaaaattatattatagctcaactttgtagctgtaaatgataagttgagaaccatctatttgagttgttcatctttagcaccataactaaaggtgtaaagtctttattaaaattttcatcttctactaataccatactaattgaattcacagatgaatcaagtgcattcagagcttcaacttgcacgtagtctgattgatgaaaaggactcagagatccagcgcattcgtgtgagcaataatcaggtattttcacaagtaaccatcaagaggtttagcttagcacgtggatcatgcttattttacttatatcgtcttccaaactgttcctgcttgattacaaacatgttggatgcagtatattgaagaaaatgatagactcagagccattcttggagaatggagcgctcgagcagcaaaggtacactggctaaagttctgttgtgggttgagttgtactagcattatctctcattgttttgcatgtgttcaacagcttgaaagagcactggaggcagagcaaatatcgagcattgaattacggaagaacattgcaaaactccgagggcagacttacaaggatcaaaacacctgatctcccttgttttcaggatatattcacctatggcgatgtttgagcaggtttatcaactcttcagctgctaaaggtgccacctgtgatatccttgaattccaaacctctagtgataagaagagtgccaacacagtccagtttcgctaacaacaaagcaaggtacaagatcatcactcaatctgatatgcatcaaggaaaggaaaaatgcctttgctacacctctctcgtgaatgtacagattgatgtttgtaaatgttgttcgagagtatggtgcagcactggttttttgtgcttctacctgatgcttctacaatgacatcttatcatggcaagagttgtgcattgttttctgagcacttgcgaaatgaaaagtgagcatttgtgcctaagctcccccaaaaaggtatatcagacttctaatttcttctgagttgagagtatcaaatctgtactgcagtctgagatgctttgctaccctttgattcagtttgctttgctatcttagattcagttggctagttctttttcacagtttagtagctttatattacatatgtcttgggcaatgaagctcatgaccaacaaccaatgtgcaaaagcgttcttctccctccttttccttttggacaactggtagagggagaaagttaacaccgacaagtcaatacagaaccaaggaatgttcctgagaataattttgctaaaattctacctcgagttgtcccattctttattaatctacttgcaaattgtaaggtggaattccacatgtcgttaggacgttaggccggtaggcccccatccttgactattgttgacactgctatgcttgatgctgtcttctttaatctctagaaagaaacttgtggggcctttggttgttgaaaatgcaacaacaaacgaccctgaacaaccaggtgcttcaaatgaatagggacatttgagcaaatatcacatacttcgtgcacgagtccaatttgttataattttcaccatacaaaattttgtagttctgcatctgaacaacttctgaagttgcctcaagcaataagcaatttgctgcgtctgaaatacggcaagcactgattattgaaggattactgaagcgcctttttcaaactcacggtaggattgacctcatctggaccgtccgatcgagatccagcggctatattcctcccaaaaaaataaaaataaaaaacgcgccgggttccaaccgtacgagccacgaatcctctctttcccggccaccttcctctcgcgttccactgcatccttcctttccttcctcgaatcgaatcgaagctccgcctgctccgcttcgcttcgccgacgactccggccgccaccgcaaccgcacgcggcggcagccttaccggatcctccacccccacccgaacccgcgaacccgcgtgcccgtgcttcacgcgcattaaagcggcagcaaggccacctcctcgcacctcgctcaccgcacggcacacgcgcccgggggatttggaaattggaaatttcagatcccagatctcgtctcgccgatctcgccctccgctaaggtacggatcccccgcgatcgctgcttgcaagttcagaaatgttgcggccgcggctgctcagcgccggatctgttgtgttttcctgtggtttttaggtgtttgggattttttttcattttgttgtgcaatgtatggagtgtgagattacttgtggaaactgattagtgcaatgattttgcagccatgggttcggttgtggatgctccaacagttgtggctggacaggaggtacgcataatgctattggtgtactaatttagtaataattttccctactgtttattggttgagcttaatgaactgctagatagtttcctatattatttgagtatgtttttagaacacaactgttatctgagaatgtgcaacatgttttccttgaggcatcagagattataaattagatttcctgatcctttggctgtgagtttcgctacagtcaagggctggagcttgaaatcttgcttcctttctgtttataaatttaaaaaccatttatttaggctagaatatgtcgatgtatttctgttgtgtatgattcatttaatcttcatgtatactattataccaatataaattttgactccttgagtcacaacgtaagctcatttatttgtttattcagttcatatccttgcctcatactgtactataatttatgccatccatagcttgtcttatgggtgaaatctgcccctcatgcaggaggtcactgacaacatgttgggtgacaagaaagttacagttgtatttgttctaggtaactgcttaccttctactttatgtttgattataatgtaagtctcatatgagaggaaacgaacttataggaaactttagatatgcaatgaattgacatgataaaatttaagtacttacatagttatatattatatataaataaagagatatattatcttctgtttctaaccaaaaatttacacaggtggtcctgggagtggaaagggcacacagtgtgccaacattgttgaacactttggattcattcatcttagtgctggagaccttttgcgtgcagagatcaaatctggctctgagaacgggtatcttattttcattccataagaaacccaactgtttccttttgtttggaacaagcttttccaaaattcaatttggttatgtttcctcctttgttcaatttctgtctgttactactaaatatttattgttacacttccatgttttatagaactatgatcgagaacatgataaaggagggaaagattgttccatctgaggtaactataaaactcttgcaggaagccatgattaaaagtggaaatgataagttccttattgatggatttccaaggaacgaagagaatcgtgctgcatttgagaacgttgtaagcacatcttctccttgtacttcaaaattttagatcacttcactcttgggtagcaaacagtcatgactccttagtagaacgttcttcaggggccactcgcagcctgtgtacacacacacacaatgacaatgcactaatagcattaatgtgtcaaatgtttcagacaaaaataactcctgcgtttgtgctattcttcgattgttctgaggaagagatggaaagacgtcttttgggacgcaatcaggttttcctcatcacttaagtgtattctccattccattttaaaccttaccaccttatcgccacatgaataacctgttttctgcttccaactttttcttttgcagggaagagttgacgataacattgagactatcaggaaaaggttcaaagtttttgttgaatccagtttgcctgtcattgagtactataatgcaaaggacaaggttaaaaaggtactattgctctttgaatgatgcaaaaacaacaaaaaggatggatagcaataggtattagatgctatacattcgaagtggaagtagtaggagtataataatatgaaagactattctaccatgatattaaagtttcccatgatcattatgagtttctgaccacgattttctttgcacacttacatgaattactgcctacttattttctaatgacttttgacacctattgtaaaacttgttatcttatcagattgatgctgcaaaaccaattcctgaggtgtttgaagatgtcaaagccattttcgctccatatgcgccaaatgtatgtttccacttttctggtttgttatgttccttttgcgtgtatcacataatcattgcctattttcattttgcacctcacattatgatcttatctatcaggccgcttagagcaatagaaaggaccacatgagtgataaattgcaccaactttagaaaaggtactctctctgtcccataatataagaagttttagagttggacacggttatcaagaaagtaggtagaagtgagtggtggagggttatgattggacgagtagtagagataggtgggaaaagtgaatggtggaggcttgtgattggttaggaagagtatgttggtgtagaagttgttatattttgggacaaatcctaagagctaaaagttattatattttgggatggagggagtacatcttctttctctgcacctctatgccggttagcatatctgatcataatatgcaaaatgaaataatgataaacacaaaccatgccaattaattcctagtatgttgattcttttccttttgtttttggtcaaagcaatcttatgtgaattgcttgcatttagtcaaatgataatacttagaaccacaggtgctaaaacgagcccctgctatgccagtttttctgttggcaatgaacaagctcttctgctatgccatttctgaaccacattcaatcttcccctgttctgttattacttacaccatgtaatatatctgttgcaggctttgctctcaggtgtgactacaaatctgtgattacgaaaccgttgatatagaagagagttttggctcatatgagctacctgcatacccgtaggcaatttgatttgttacttgcaataattaattttgatccccatttcctgctagattaacttttacgagagttggcgtatcgtatgtaatgctgtacttgtaccaatgtatcatttacctcatggacgatgaaactttgtcctcccgccagtttctggtggtataatacagaaagtggaacttccgaatttttttttggttagtttctaaaacaatgttcactgaacagctaataattattcaatttgttattgacaagcctttgcagactgtgttaacttgattgcacattgtaatatgatagtatccatatttccttgtttcatctctttgcagtattgaccagatttttgtttgtttggtcagcttaatgagtgtaagcaccagagtcaagattatttctgttcggtgtatgttatgtaactattctctcgttttctctctttttaaaatctgaggtcaacgttgatccggtcgagaaatcaacttctttttttcacctcataaacagttgcagcatgtccataagaaaatgactcctttttttgtcctcatttcaccttcccgctatttgcagtttttttggccaggttcaatgaatatagttatttgctatgagacaaagcagaggatgccatgccatcaggcttctacctcttggggcccttttcagtgatttggaacctgcaagcttgattgatggttaccccatgcagagggaagagagcaagtgaacaaacaatgacaagcactacaaggcaaatgcaaaatatgtgtattctttttttaaaaagaatatcctagcgacaacagtttcatgtccagggacagggaagaacaaagcaaagaagcgtccccggttcatccctttctttttctcttgcctttttcgtctggggcctggaagcgtcacaattataggcttcaacgagatagttaggcatgtggcattgcaagatggttggcaagtaatccatgtgagcggcaacgaaccacgcgctgtcatgctcacattcacgcaactagccaggatagcattaccagctggagtagcaggttgcaggtagcagttggcaggcaccagcgccggcacaccggccatcctgattccgccggcttccgccctttccaccgccatcctctcgccggccggcctaccgccaagaaagtcatggccatggaggagcttttgccttttagcagctgttcttgtaagtttgtagtttctttaaacaattcagattctaagaatctatatagtcctacgtagaatatagaacatgaactataactcataattttataccagctagtatcaccggttatttctaagaatctcctgctctcttaaacaggattgagacgccgagctatccggtttcactatggctgtgtttagatccaaagtttggatccaaacttcaatccttttctattacatcaacctgtcatacatacaaccaacttttcagttacatcatctccaatttcaaccaaaatccaaactttacgctgaactaaacacagcctatgtaagttcacatgatttttggtttttgaaataaaatcacatgatcagaaggttgctatggtccccagtttacatccagtggtcacatactcacattgtacccctactgtatgttgggcgacttcaggataggatccgttccgttgatcgaatcatggatcaccccccccccccccccccccacaacacaagcccgtgcaatgcatgccaccaaatacgaagagacacaattagtacagttctagatttgccagacaagggccctttcagcatcttgttcctaatctccgcgtcagacatacacattctgttattcttatatcttaatcagacagggcgcagatgggattgcatcatttcgattagttaatttgcaacgattacgactcaggcactactgttgactacagttggttaattttgttgaaaaataataataatttggctggctgttaacactgttttatcgtccttcatgttgggcttgactgaaaacgtgaaacatgatggttttaactggtgtatgctaaaaaataaaaaagcagatgggccgtacagagaaaaacagagcgggaatgaagaaaatttcagagttcggcggccggccgtgcgctcgcgtcaacacgttgtactggccgttgattctgcagattccgcgaatcgtgcggatgctcgccggcgcaacccacctccgccggaatctgcagcatcaacggccagtagcgctccacgtccgaccaaaagcagcatattccacggttcccccgggtcgagatgcccagctggtaggcctattttcttgacaaatttgaattttctggagcacgtcat

SEQ ID NO: 20931 - DNA, 985 bp, Oryza sativa
actgtcttcttattcggttactttgttctattggcaggttatactgggctttcctcctgataaactcgttctaaagacattcggtgttgccatagttttccaagtgaactcactatgaaaccggactggtcaattttctccaagtttgaccacaatggagggtacctgcataaattcccaatagattctccaatatctcatgatattggattaggattgatatcacattttggaaccttagtcgagagttcctttcagcatccaaggcatatatgttctacagggaatggagcagttcaggaagcattcagttgcttcaacaagtttgctggtgctttctatttctggctttctagagcatcaaatcccaagattttccacaggttgtcagctattgcaggctcaagttcaagagcctgccagtcgcaaataaagcaagtgacttcttgcatgcagcatttggccggattgcgttttggttctcaagttagagaagagcacgctatacaaattcttttagcaaagcttgctaatgcaacatttgggcgactgtggaacgaggtggaggagcgccatgcctgtaacattcttatgttagctgctgctactgtaccaccatttgaaaacatgtaggttcttctatttatattgtttttgtacttccaatgcctgttccatttggctaattcctgtattttggttttcattctatgtgtactttatcgactgctcatttcttgcatggacaagatcgccgaagatgcttgcagactcaatgacattgggaagagataatggtcgtaccagagaacctgttgatcagcattctttggaggaaaaccattcaggctgtacttgtgttgctgtgccaagaataattttaccagaagacgcaactgaaccaaaaactgggataaagttccctactcttctcgaggataattcaaatccaacttcagaggtattttaaaaaggggatccacta

SEQ ID NO: 20932 - DNA, 731 bp, Oryza sativa
aaaacgtgtttttcaactgtcacattaattctgacatgaacctaagtcgttttcgcctgcgtgacagaaacagagctaacagctaccaccctgaaactgaagagcaattctgggccgaacactttgcagcctcctccctgtctcctgaatccaagcgcgtccctcccttttccctcctccattacacctcctcaatagtcaatacccccatctccttggattgcattgccttctccgtccgtcgcgttgctccggtgctcgatcggtctccccgcccggccgccagacgacgcgccacatatgaagccccgctcctcgcgcgacggccataatgccgccgccgccgccgcgctcctcctcgcggcgctggtcctctccggcgacgtcctgccggcggtcgtggccggtggcgccccctcgttcaactacaaggacgcgctcaccaagtccatcatgttcctcgaggcgcagcgctccggcaagctgccgcccaccaaccgcatcaagtggcgcggcgactccggcatggaagacggcaagctcgccaacgtatacgtcgtctcgcctcgcgccctagctcgaacatctcgctagctgcatcttctaattttgtgaaatggatcactcgatcaggtggacctgactggcgggtactacgacgccggcgacaacgtgaagtacgggctgccgctggcgttcacggtgacgacgctggcgtggacggcgatggc

SEQ ID NO: 20933 - DNA, 670 bp, Oryza sativa
actagtggatcccctttttatggacgtcgcaggaatctcttgaagcaaatgccgcagcaatcgatggtgaaagccttcaccagtgggcagtggcaacaacactgcatgaccccatcgtcactaccaaacccttcagcacctgttatgtgttcaaggtgacggtgagatgccattgttgtgaattgactgctgctgtttacttacaggaatgatgaggaaatcctccagttagttagccacgactagtaccacactaccaccaatggttgccatgtagtgcatagtgctgatcattagatcggcggtgggggagatcgcgtgcgggcgggcgatgccggcgctggcgtcgccacgggcgggcgacgcgatccgtgcccgccgtccgccgccatcgtcccgctccccgtcccgacggagctccgcctccagtacctcgccatgggcatctcgccgccgtcgccgacttgctcccctgctcccgcgtcgtctccgccgccgccgcgtcgcctgtcgccagccgtcgggccttctctcctctcccttcttgccccggcgacctcctcacgacccactggccggcctggtagaggagaaaagcgagagacagagagaaagaggaggaagtgaaaggagggaaggagagagagggtggtacgtggcatactgacag

SEQ ID NO: 20934 - DNA, 1002 bp, Oryza sativa
gagagagagagagggcgagtaatacggaaacgaagccgcttgctttcggtttcctcctcccccatttccttggattttgcgaggtttcctcttcctccacgctctcgaatccgagcagagaagaagcaccagccggggaaggcacgggaaccctaggttggctgcgccgccgcacgcacgcacccgctccctttcgtgctgctgctgctgctgttgttgccgccgcctgcatcgtccccgatccgccggccagccagctagctagcgagggaggccaggtgaggcgctctcggcgttcgttgcgcgtgtggtgaagtcttcgggtggtggggatcgcgaatgcgggtgggtttgggggaatttctgtgagggtggtggggatgggtttgggggaatttgggtgctgcattgggggttggtttggtgctctgcgtgaatctggtggggatagtgagatcgtggtttgttttggtgctaattcgggagttccgggtcgagtttttaggtgattttctgagctgggggtgaggctttgatgatgggaaataaaagtataagcaactagtgtgttcgatcgctacttttgttggcaatattgagatcataccatgtttctctctctctttttgtgtgtgtgagtttcagtttgtgaacgcctgctaaggagaaaaaaggacttcagagttctcacggttgttttcagatgattatttatcgtgtcactatatgaactaatgtaaatagcttagggagtagaaatcagaatttatgtaaaaactgtttttagcaacacatcctagcagacaagttggagattgacttttacatatttgtcttagtagcaaacgtctccaggagtaaaaatcgatgcaaaatcattattgagtaatttattagtactgtcttcttattcggttactttgttctattggcaggttatactgggctttcctcctgataaactcgttctaaagacattcggcgttgccatagttttccaag

SEQ ID NO: 20935 - DNA, 1294 bp, Oryza sativa
ctatgcagtacttgtgtaacgccaggtgttcatttagtaatttggcagaaattatatggatcattaaaagtattggctgttttatgctagaggttaatgggactattccaaacctgcaatcatttgatgtgcttttgaggacttcatttgagtagttttttgtattctgcataagaaacaagaggaatcttaatttttgccccatctgcattcctttcgctctgatctaacaggtttgtgttgtacctgtcatgttgtacagggaaaatattcatatgacagtcaggctgatagttagctacaatggtcttagcattggcacagtgcgggagtatgtattttagttttcttgtgctaatatcagcacattcttatctttagctgtagttcagaagatacaatctctcaatatgcaagctaatcattttctttaacactcttttcagtgcatttgagaagtccctttgcttccgattgcagaaggtacttgttaattcggcagctaaaaatattcttggctaattatataggtctaaaataatttctctgtaccatttcaaaccagatgaatcctaatactgattatcattgcttgaagacgtttggttcttattttagtgaagatatttgtatacctgcggtaagttccaatattacgtctggcctaacttggtacttctcatcataagatactgaagtcaatatgactgcagggtacaaagatcgacttccggcaaacctctgatggccagctcataactgaaagttagtatcgtatgcctgattggttctgcatggttagaatttttacacctgacaaaaatgttgacatggaacgtctttgtgcagttgatggcaaacaaattggtgctgtccagagcaaagatctttgcagtaagtatatatattcgttctttctaacttccagaaaaaaaaaaagacagaattactgttatctgtcattatttatttggcaaattccttatgctgtctttatgaacaggggctttcttcgatatgtatattggtgatccacctgtttcagtcgagaccaaacaagacattgcacagaatgttggtggactcattagaagatgttattgaaaggcataattaaacgacagactggtcggaattatttcattcttcgatacaaggatactagggtgagggggaagcatatacaaagacaggactaggaggagaggatgaactgtatgtatagtgatagatcaacctgtaaactaaacagagccttagcatctttctccggagcaattgcctccatgctttt

SEQ ID NO: 20936 - DNA, 1322 bp, Oryza sativa
attttatagtatgggtaaccaacgaataggtgatactggtatgctacacagcatttcatgtttttgtttcaccagcagaaacagtgtcttattgtctcagctattctggaattgtagtagatagcattatgtccctgtctattcttatgtgtctgctgcgcatactgtatggattcgcttcaactctttggtattctctacatattaacttgtctaagaagccctttcttctttaaccagctgttgctgtgaaccctgagctcacttatgtagtagttgagctgcaatctgtactagaaagtgaatcaacatctggtggaaatcaacgaaagcttgggagtattttgagccctgggagtcagaaaccatttatcatcgtggctgctgatcttgtctcagctctagagtccaagtggggtacaaagcttataatccagaaatcatttcctgggtcagccttggagcactgcaggtattttgtttagcacttctcacttcattatgattgtgcttgacctatttattgttttgtgtttatttacattatatttggtgttttcaggtatattcatcctgtgaatggcaatgaatgttctgttgttcttggaggagattacataacaactgaatctggcactggccttgttcatactgcccctggccatggtcaggaagactacataacaggtttgaaatatgggcttcctattgtgtctcctgtggatgatgaaggaaacttcactgctgaagctggacaattcagtggtttatctgttctgggagctggtaatgccgcggttgtgaattatctggatgaacagtgttctctcattttagaggagccttacagtgagtagattgacaataacctccacaatctggtttcacttgtgaatacgaaaaaccttattaagtttgtcttccaattgtatctcttggttcacagaacacaagtacccctatgactggcggtctaaagaaccaacaatattccgagcaactgaacaatggtttgcctcggtggatggtttccgtaatgctgcaatggatgcaattaggcgagtatcttggattccttctcaggtttgtaactgctatactttattttcctttactcttactgtttcactgaacttcccagtttgaacttttgttctctttagtggcgacaaagttcagtagaacacaaactgctatctgatagtgtttagcatttttgttcagtgctatttctcttctgcactggtacatgaaattctctatgctaatcttgcttttttttttgttgctttggatcctggaaacgtttgcttgatttcaca

SEQ ID NO: 20937 - DNA, 939 bp, Oryza sativa
gaatggtcaaacatgtgagaaaaagtcaacggcgtcatctattaaaaaatggagggagtagtgtttgaagacacgtataaacatgtactatgcacagtttctaccacttcaggcttggcgtttgattttctggcagtttggaaaagcattctttagtccatgtttatcagaaacatctgtattgaacctatatctagaaggatgtgccttcacatgagttacaagtgttgatatgttgccgaatatgtcatatgtgtacttggcatactgccagtagagtttcacaagttatttttcttttcaccaggtattatgatggtcgtttttctgaccagcaaatggctctgcttcagtaccaaagggagaatattcattacctgagtgaggaggtacttggaagatcaatgcagtatatccattttaaaatttgattatgttagattgtgttattatttaaatatttgtacaagacaacagtagattactagcattactatttcatggaggaattagctgatccttgtatttagttctacattaacttaattggccagttctgtagtcagtgctgaagttctcaataataatatgttggaacttccagaaaatttcttgttgaataaccaaaccttttattttcctgaaaggtgctccgcttgcaagaatgcttaagcaaataccagagaactgatgttgggagcactcctcaggtctgcacaacactgattgattgtgttgcattaattaactgaccagcttcgtaggtgcaaaattagagaaaggaactttgtagctattatgtttatgtgaattgatggacttgcatcaacccccttttaattctacaggccgatcttgctcatctattagcatcgcgtgatcaagaacttagagcactctccgctgaggtaattaacctatattgtaatgctataatgc

SEQ ID NO: 20938 - DNA, 922 bp, Oryza sativa
cacagctgttccagttcgccaagacgcaccagggaacctacgacggcgagtgccccttctactgctcctactccggctacaacgtacgtctctgcatatgcatgcatgcaaaatttatcaacgtaaaaaatttgacacgttatatatattgtgattgtgactgcatcgatcaggatgagttgctgtgggcggcgacgtggctgtacctggcgacgaagaggcaggtgtacgcggacttcatcgggcacgaggcgatctcgtcgagcgtggccgagttcagctgggacctcaagttcccgggcgcgcaggtgctcctcgcggagctcaacatgacatccagcggcggcctccagagcttcaagtcccaggccgacaacttcgtgtgcgccgtgctcccggacaccccgttccaccaggtgtccatcaccccgggcggcatgatccacctccgcgacggcgccaactcccagtacgtcaccagcacggccttcctcttcgtcgcctacagcgacatcctccgccggatcaaccagccggtgatgtgcggcgcccaggccgtgcagcccgcccgcctcctccagttcgccaagcagcagatcgactacctcctcggcgccaacccgcgcggccgctcctacgtcgtcggcttcggcgtcaacccgcccacgcagccgcaccaccgcggcgcctccaccccggtgctccccccgggctaccaggtcaactgcgggatgagcttcagcgagtggttcacccccgaccggcccaaccccaacgagctcaccggcgcgatcatgggcggccccgacggcggcgacaacttctccgacaagcgtggcaactcgtcctgcaccgagccttgcacgtacatcaactccctctccattggccccctcgccgccctcgccatccgtggcccaaa

SEQ ID NO: 20939 - DNA, 14035 bp, Oryza sativa
tgaggtgatcgatcgggcacacgatcgatcgatgacacgaacgaacaattaataacgcgagaaagggctcgcgcgagttgttggggtaggtctcggctggtcgttaggttggccagcttatttctcgttgcacgcacgcacgcacgtacgtacgcaggcgcgcgcaaccgtgtgtaagtgcgtgtgtgatggatcgatcaaccgagcggcgcgcacgggcgaatacgaacttttccaagtgatgaagtgatcacgtatacacgtagtacagcagccgagcttttcggtgagcgtgtacgacgtgtttttttcattggaccgaacataaaacatgtcaagtacgtacgtggtacgtttggttaatgcataaatgtatttgtggttcttcaaatcccgtgctcaggtatgaattaattaatctagctagctatatggtgtactatcttgtacgaagaagaacatctctgatgctgtatatctttgtgatgtatactacacgcacaataaattatctagtttggtgctatcattttattgtgtccttctcgttttttcaaaattttaatttattcgtaacattgtgtatgatgtgtgaaaactataataattggttgtagcttttattaaagtaaagacccgaattctcattatctaaaaaaaacattgttgatcaatatcttgatatcccctttattatacatcagctttggagagaaggaaaaaaaatacatgtatttatttgacaattggttttctgaattacaaaaggggtccttgtccagttgtcttgaactataaccttccattttttgagttcatttttatcatttctagcacaaataataaattgtactaaatcaaccccatctgcaaccattagatcagtaaccaacaccaccagataatgcctactttaccaacaccactaacaaaaccattaggggaataggtgtacttgtggtaaatgaggcagtgatgcagcgcaaaggcaggtaccaatttatccttacaaaagttaaaatcacaaaggtgggtgaccttgatgaacattagttagcaatgtaccgcaaagaaaacattaggtagcaatgaagacaatcactctcttaataatctatatgttgtttgcacttaagttgtaatgtaagtaactcttggatttaagcatacgttagattctgctgagatagacatatatttattcgaccgagcttagtcaaactatagatgttggaataaaaatgctcgatttattttagaactaactcattggtggatgattgggattggttgtcgatttgtcgtaacgaatttattggattggatgggattggttcaatttcgcttctatgtccaaaattgcatcgtcttctactttaacggtattagcttggcatgttgttatttggcacaactctctattaaagtcgtgtcctttcggctattgggtaccaatctagagtcatgtctcttttcacttgtttaatatataatctctcaaatggagtgcatatcattgtttttctttacgggttatctaaatgtatgagaaattatttaaagctaaaaaaagttcggggcaaatctttacttatatattactactccatctttctttgcacatttgcaaactcaggcagaaaagggaaataaaaaagggaatcaacctgccctccttttgcagcataaatacccaacccatcactccacaaagaaaaaaaaaagccactctctcgcgatttccctagtctttcggtgtgcgtgcgcgtgtgaaggcgagcaagcgagcgaaagcgaaagaagcagcaagcagcaagaggaggaggcggaggcggcctcctttgcatgtgaggagagagaggaggtgaggtgaggggggccatgtcgatcgcactggagagtgggcccgggctaggaggaggaggagggggcggcggcgggccccggttcggccgcgtcgcccgctgcgcctacgccgcctcgccgccgccggcgtcggtgggggcgcgcagctcgtcgtcggtggggagggacagcgacagccccgcggcggcggccaagtgggagtgggacggcgaggaggtggagggcggcgacggcgaggtgcagagctcgtacaaggggcccttcgacaccatggacgcgctccaggaggccctccccttcaggtatggctggcttcccctccccgcccaattcgtcgttacccccacggatcttgatcggtcccgaggtgttcttgcgtttcgtttgggtgatttgggggtaatgcggggtagaaaccgctgttcttgatcccccggtgcgcgtgttcctctagagagatttcgggggtttcttgattcgtttggaccaatgcagtggaaaatactggttcttgatcggttttagttggggaatgtaggcaagattcttggttcttcgtggacggttagtggtcatggagtaatttgtatggagcggtttggttatctatccttgagtcgatgcttatcttggaatttgggggatttattggtcggactgaagtcaaactgttaaaagaaagaaagaaagaaagaaagagctaatttagggttctaggtgattctttgtgccgccttacatccaacaaatttgtgaacatgggtttcgatcgattcgtgaagctgggatatttgaggtcggaagaatacagcgaatgcactggatgccgggatacttttgcgtatggtttcgtcatgcttgcttattgttggttcatgtttgggttatacccataacccattaggggtcgattatatttttgtaagtagtagtccttaatgttcttgccatgcccttaaaatctttatgctgaatgttctgagcacgaaaggttctgattagacaatttctaatgcgtttgtataggcttcagcaagaatgacttgtgattagtactactttgttggtgtttcacttcattcttactccgaggaatcaaaggatcctagcacttgaatatttcatttgaagtccatgccatcttataatttcagaagggcacattagttgtactaacactgaaagaccaatttccatgattcatagttcctttggtatgtgttgatacttgatattgactatataagcgcagtattatgggatgaaatcacacaaaacgggttttatcagaattacaaaaagttctatggtgtattaatggttgggtttctttgttaatgatcaatacaatagatggtgtaaattgcagatatgtgcatctttgacaaaagcaatgaataatctatcttctaggttggtcgtagtaatgactttgagtttgttcgtttgtgttcttgcaacctgactattgtgtacagggggggtaggcatagctctgagatcagttgatgcatattaccttcaggcagtaatatttttgtcatgaagatatcatgaattgttataatttttgcatagggacattttttttttcttttgagcatgcacaactactgtacaatttcgctactgctatttgaattctttcagtactagtgtaagtctagcacaactacttagtagctgagtgggtttgtagttcatactaccaagtacctattggcccttgtcacttgtagtcgcatagaattgtgcattctagccatatgatggaagcagagattgggtattgtgaacttgaagtcttgaacacaattcaatatggctaacatgattaacacaggaacaggatcagtcagacaccacaatctttttcacatgcttttgttagctatcttgtagcatgtgtaattatttgttgatctgcaacattaaaatattccgcagcctgtctctatcgttgatctggcaaacttgtttgtctgttccttgtgaggagcatgtgtactgctgatgttttccaagtctttgctccagcatcttacaatcttctgttttattgagtaattctgttcttatctattgcaggaaaggggtatgcaagttctacaatggcaagtctggatcttttgcaaagcttcaagattccgtgatcccatctccacctgagaaaagtcttccaaagccagaaaacccatcccctaggaagcggaaaggtcttcttccgttcagtttcaagtggggcaagccacagaacaaagaggtattccctgaagatgatgtgatcatcagccctacaaattgcaggagaatgacattgtcaccagctgcaacaagcagttcggggagcaacagcggcagtgatgatgaacactaccgctctccgaagctgcatacccgtcagccactccgaaggcccagcaatgccgccatgggtgtctttgcttctccacctgcacctcgtccaccgcaggtgttatcagctcatatgagatcacactcgatgcttgatctgcaggatgtgacagagtcgaccgccatggtttctcccagggacaagcgaaggaggaactaggaagggtggatcttgatgtgttgtcggtctggtccaaccgctggtgcccattttagactgcggaatccagtggcgaatgccgtcgtggtggtagggcgcgtgcaatgctttaggggggtggggggtgttttgcgaggtcaaatggactcgtattcatagagcttgctgttctccttatacttgatgtactgggatacatacagagaacctgagaaactgatgtcgttacctgagttggtgggctgcatgcgttgattacaggttgacttgtaaatgctgaactctgcttttgtcgattataattcaatcatgtggcctgctctattacattttgtatacctctctgatctgtggtatctcacccttggaactgtatcagtatgcatattatgtcctgagctgttggtgttcttctgttgctagtacaactgtacaagtagcagcaacctcttccgatgaacttatctgtgcagatccatcacttttttttttagaacatgcagatccatcacatagttttggataaatcattctgctcttatgggtactggtgtgcaaagcgcaaggattttgtttttttggcagaagataatctattgcagtacacacgcagattgtgtgaacgccttggcaaatcctgttggtcggtttcgtactttcatcttctgttttcgtgttcggaagagattgcagtggctgtgcagccgcagcagctccatcaaacgcaacaaaatttctacggctttgtactgtagatacagcccagctgcgccacagccgagcaagctgcaaagcagcacaagcgatttggtggcacatgattgctgctctcgttaatctgacgccttcggtaatcggaacctcccactcacagctgaaatttgttgttttctctatgcgtagatcaaaactgatctttcatatttgtgtaaggacatttaagacctacttcactttgtattatttaatttttataagattttagttaactatttggaccacatggactaaatcttaaagcccacaaatcttgataaggcaaaattgtataaagcaccccaattatcactcgttttaaaatctcctcccttaaaaaattcaattcgttgcaaaggcccacccaaccaaaccccttcacatgaatataaagtcagcccgaccccgctgatgtgtagtcgcaacaggggaacagagcttgaccttagctactctctctgtcccaaacagggacggagccagcattttgaatcactggggtcatggcttttacttgtatttatgtcgtgtttgaaactataattattctcgaagctagatatttttagctcacttttgagctagagctatgagtaagttgggattgttccattttgctaaaaataaatatttaaagtctattctataagaacttctgaggtttttaaggtccaaaattttaaaagttatgactacatataaccgggcataacaaccatgtgttttttcagacatacaagtatgttctgaaagttgtttattattccatctgtctcaaaatacaactacctacgtctttttaagagattaatgttagggtgtgaaattattgtgattggttgggaaaaaaaagtaggtgaaaaaaattatatcgaggaattttgtgattggagatgggatggttcatagaaaatagctatattttaaagcaaatttgaatattagaagtaacatattttgagatagagtgagtaacttaaaaaacacatctagtagttgattagcaaaacttcaggcctaatgcattgatatacatagcacatagctaaaataagtagttggttaatagatcaaatatgtctaattgcagcattagtagcggattgacagtagcataacacagctaacaaattatgcttccaaagaaataaacggtacaattgtttcagccttcctgagctccagcagtttatcaggctggccggggtcattaagcttttgttgctggggtcattagctacaaaataatgaacaattcacttgattgatcgaatgtcatcagggtctaatgaccccaatgatagtactgcagctccgcccctgatcccaaaatataagcatttttagctatgaatctggataactgtacatttagatttatagccaaaagttattatattttaggacggatgtagtaattgcctatactgattcgccgctaccctcagccctcgcgttgttcgagaccgtcttctctctttgatctacacctaggactaggttcaaatggatgcacctgaaaccaaacgtgacccattggtctggtcttttacgggtacaagtcacgggctgactcagctatttacacacgtggagggtttgggtgggtgggtttttgcaacaaattggttttactagaactttaggcgcgcttcgggccgccctaccgtttgttattggtaaaaagtatcacaagtcagaatatgtatgtacttatattggtaaatgttgagtacgaaaggacttcattctagcacaggctgtgacataacttgaattccgatgttacatgatgatttgaaatagaccctgaatactataagataaaaaatacctaataatttcagaaaccacaattatttatcatacccaaaagagcaagaaaaggtataataatgtacttaaaaaacggtttaatcattcatcctcttttaaaagaggttaattcagttccattacggggcatgaatcacaagttgtaatgtgaaggactgtgtttgcaatcacttaagaaaataaatattcttcaatcgcacatggggactctcagaatttgtatgcaccaggtttctggttttcgttgcttgcaaaattaagttgctagcaatcctggaagctgagtagacactttactggtgtgcacgcgcgcacgtttaatgtgacatggagattattacaggcagcacactgtggaaatggcagagttaggtataatggtaaatccctttttccagaattatcagctaaaatccactgctagatgctccctcaatcataccagcttacaaaaaacgtctttcggactaatctctgcttgaatatctggtatttggtacataggcctaagaaaaaaatcagagagaattgtccatgttctgatttgtgattctgacttctgcagttactaaacataatccaaacaaaaaagaaaatattttctatgttctgtaatttgagtcttaattcagattagattgacctgaaatctaaagaggtcatgaatattcagattttgcatttgattctctgagattatatcaaacagctagatgacaccttaaaaaacacaatgaagcagaaccatccaaaccctgtcctgaccacctccttaaaatatgtaatggagcagagcgacccacagtggtttcatgaagtgaacatctaagctttggttgttggaactatatacaaacacaaccaaataaaaagatatgcagtacaaatcagaaatactgtagcattcttgataaaaaaaaagggtagactatcatttgcaagggaataatggtatatgaaaaagcaaagctagcgagggaactggaggcaggaaagggaagatacatgccaagcatacataagtgagtgtagaaaggaactggttgtggcttaactcaccaaaattgaccatgggaaacaaactgcaaatggaccctgggcaaggcaacaacacatggttccaatatcaccagatatggaatcgctaaacagtggtggtgccgcacggccgacggagcttcaagctaaccaacacctacaatattggcaaacttgagcaccttctatggcagcaaccaatcctttttatacagataagacaaaatcaattatcatatttgatattcatatttataattagattgcattctttttctcttttttgaaaaaagattccacttatctagtgaccaacacttcaaagtatcacctagagtagaaggcaaactgaagagaaaaacattgattttaacaatctttcaccttcttgtacatagaaacacaactgtgatgtacattaatcaacgttttcattagccgatgaggacggtaattttaacagagctaggatgatgcaaaataaatggctcagcaaaaaagagtaagttgtgttttctaggcaagaagttttttggatttaaatcaacagcaactatgaaattgtaagtcccttaaatataattgcatgaaagcacataaaccatttcttgcatacttaattaaactcctactttgaaacattgatatggtgctctgcaatagttctttcaatcttgcaactaatgtcaagcaactttgttatggccttcttgttccatgattcaggtggccttgtaatgctagtatatgaccttcccatcgagaaaatacttagttaatgaggaagaatatccaaagtaagaccaatttcagaatatcaattagacatctaaatgaggccatatgataaagtgcgtgcagtaaaagaggatttctttttttatcatattaacaaatgatctgtacaggtgctacagcctctaatcctcccatgaatagtttagcttaattagtttattctactgtgcacccatggtaaatttttagaaaggctaaatatcacgtcaacagtgaacattagaacagtcactgacagttgcaataacatggagtatgtgcatgaggatagctaaggataatggatttaggacaaggttctatgaaccatcacatgatgttcatgtgaacaaatgcacgtaagttcctattatgctgcatcgaaaaaggcaagaagcaacagaagaacttggaaatctggaagaagcaaagaaaataaaggcaaaggcaacagaagaagatcacctgttcaaaaatatgaaatgtcatcccaattgccttgtggaggtagcaacaaatagacactcaacatttagtcatgaaatcaatggcatcttgcttcacagcgtcctatcatttattgagagcaatataaaccagaagtatatattgtactaatataaattgaagagtaccataacaaactttatatgcccacgatcatatctatgactgtacataacaatgctattcaaacctgaagaaaaatcagacattcatgataaggctcatagtatcctctagaatcagatcaagtccaaagatagtcattcagatcaatcgataatttttttgattaatttcaattgtaagtggtcagctcaaagtgtcacagcatttacatcattcaatattaagttctggaggtcttcattccaacacagattgtcacaacacctgaattctgacatttgtgtcacttttaggaatagtggttgaattcttcaagatagaaatcactaaagagttagttcagaaattatgaaaacttatcatgcttaacagagaaagacatatcaatgtatataatcaaagatgattttagtgagattcagtttctttaaaaaaagctaatttagttccatcatatgcaaaactaaatttatatgttgcatctcgtgtagctgaaagcatgaataccaagatagaagcatccgcttatgtgaatgaagataaaggaatttatagaacaaccttcgctaagaataattcccaagaaactaaatgatttctagatttggcaatagaacggtcagttgatcatccaaaatactcctcaaagaactaaatgtggcatccaaaactcttctttcactcaaaagaaaaagataatacatctattgaaatataatgtgagaagtaatcagttaaactaccgtagatgtgggtgtcctaaagagtatgtggccacaaaatctgacatcatgttcacaaatttctaaagattgggtataaaatgatacatcttaaactgcaatgcaactgcttagcatagtataagatgagaaagcatagccacaaggttgctagatagccaaatctacttcacatattaggaagaaacatgccccctatagttttgacatacctgagcaccatatatggtagcaaccaaccctttttacatgaataagacaaaaggagtcatcagatttgatatttataataggatgcacttattactctctaaaaaaaggttccacttatctacatgcataacaatacctttgtagagaataaattatatccgatgaagagctatagaaatacaatgcatatttaagctgaaaggagcatagaggacacatacacattaacaacgtacaacacccactaaacctctttgattacatcaagccactgaattatcagttataatctccctcaatcatacaagcttacaaagaatgtttttcagactaatatctgcttgaatatctggtattcggtgcacaatcccaagccaaaaataaaacacagagaaattttcttgttctgatttgtgattcggacttctgcagtcgatctacacatgcggctgttcttcgttcgcgtcattgtgaagcaatcaagcagtagcatcatattgtccacatcgtcgtcgccgatctggagggcatggccgacccgatctccaccagcaccccaacgtcgttggtaggccgcgccgcccgctggtcgtcggcctcacctggtgcgaggtcgccccgacgctgccggtgccatctccatcaagctccgccggcgtcgtcaaggtcgtcgcggcgtcatcggtgcggcacagggtacgagggaacccgtccctaccggctcctcctctgcggccgccgccgcctggggagctcgtgcccgccgcagccgcctacgcctgcaggccgccggttcaccgtcgatgcatcctccgccatccacgctgccgcccggatctggatgtcatcgtcgttgcggtcaatcccatctcgccgagctccggcctcgccgtcgtcaccatctccacccggccggatgacgccggcacctgcctcgccgtctcctgtgccgctgcggggggactcgcctccaccgccgacgtgtgcgggtcgccgctgcccggattcctcgctgcccctcctgggactccacgatgggcgcccgccggtctccgccgcgttgctcccggcggcgccccgacaccgccgccgcaggggggacggattccgccctcaccgagcacgagctccctccaccgcctcccgccgtccgccgcctcccgccatctgccttgctgcgccggcgccctccgtcggcccgatgcctctggctcctctcataatctcccaaatcaagcgtcggggccagaagatcgatccccacgccatcaatctccatcacagcatcctcggagctagcgcagcaccatccaatcccctgcttgacctcacagagagaggaagagaagggagcaaaggtggggggagcgccaggagcccaggagatggaggaaggcgggggagagcgcgagggatgtcatctgcgatgaggagaagcgggtgagggggagggaagacgatgcagcaccggcggcgccgcaaaggcaggggaagagcaatcgagagaagggtggggtacaatggcggctagggtttcggagaagcgaggggatggaggatggggatgttttcttttgcaagaaaaccctcttactttcttgttttagagcgcgccccctatattcggaatttcttctctttcacatataataataccagtatatagaggaccactacgtaagaatataaaatacagagaagtatgaccaggcagttaggaatgattatcaaagaaagtgagggtttttttgcaaaattgccagctctagcacagggtgacgtggatatcaccggaagcgaacacgccagccaaaaaagccccggagcgctgtggtggctctatttcgcggtcccctttaatctctccgatttaatctctccgatggtggaattttaaaacaagagtgataattgagatggtttataaatttttatctccggatagtgatactatgtgtcaatatataaatagttttcagacacgtgaatacaattacgatgacgatgatatccaatcacaggctctacctactaaaaatctgcttaccaaccagtacgaggcgtatatttcatactccctccgtctcataatataagagatttcgagtttttaattgcaacgtttgaccactcgtcttattcaaattttttttacaaatataaaaaatgaaaagttgtgtttaaagtactgtagataataaagtaagtcataaataaaataaataatatttttaaaaaattttgaataagatgagtggtcaaacgttacaagcaaaaaattaaaatctcttatattatgggacggagggagtatatttgcatggtatcagtgacacatagtactagaacaaaaataattgaatccctcgcacagataggcaaaccctgcagtaagttgtatatattcggctgccctggcctccccactacctccccacagatgacagaatagctcatcaaacctaagtttaattaattgccaacattctcatggtcatcaaaccaatgggcaaaccactcgtagtcatactcttgctatcctcctccctcctcgccgttgcagctgctgcagcatcgccgccgtcatcaacagcagcaggccatgcaggcgagccagacgacgacgttgtgtccacctacatcgtgcacgtcatgcccgcacacgcgccacgccgccttcccacgcaccgcgcgtctcgtcgtctcacccgcggctacgcatcgctcgtccgcgggctcctcccgcggcacatcgccgacccggctccgcgactcctctactcctacgcgcacgccgcgacggggttcgcggcgcgcctcacggcacggcaggccgcgcacctcgaggcgcagccttccatcgcggccgttgtccgcgatacggcctatcagctccacaccacatggtcctccgactttctcaacctctcgccgtcttttgggctacaggcggagtccaacggcgccgtagacgcggtgattggtgtcatagacacgggtatatatccgaaagaccgtgcgtcctttgcacctgacccatctctgcccccaacaccgcctcccaccttccgtggtagttgcgtgtcgtcgtttcgtgattccaatgccagcgcttactgcaacaacaagcttgtgggagcaaagacgttctaccggggatacgaggcacaaaatgggccaatagatgagagggtgcagaccaagtcaccgctagaccaggaatcctaattgacgcgtacgcgccggcccacacggcccaagacatggttagttcttttttccgaattttttcatatatgtataagcttttaacccatatttgaatactttcaactctgacttaaaaactttcaactcagattcgaaaactttcaactcgagattcgaaaactttcaaatcagatttaaaaattttcaaaagttataattaaaaaactttcaactcaaaacattttgaaaaaaaaatacgtgtgctaaagattttaaaaaagtaatcagaaaaaaagaaaaaaaaagctaaaagaaaaaataaaaaaaaacgaaaaaaaaatcgcgaataaaaaaaaaggccgatgggccttgtgggctgggggagggg

SEQ ID NO: 20940 - DNA, 4392 bp, Oryza sativa
tagacaccataggtcatggcactcatacttcttccactacagtcatgctgtcccgaatgccaacctctttggtttggccaatgggattgccaagggcacggccccaggtgtgcgtatagccatgtacaaggtatgttgggaatattacatacccgaatgcattaccactgacatccttgcggccttagatgagacgattgctgatggcgttgatgtcatctccatctcacttggtaggcccggctaaattttatctctatatttatttaacaaacgtgatgattaggagagacgatatatccgaagatattgagaaattttcacctgataataatgcagccactaggctcaagtaatcactgctagtgtactactcacggtcacatacatgggcaataacacacgacaactcgtctctttggccagttcatgtcgttgtttcttcgcgtcaggggagcaaaaagtcattagctgttcacgttcaaaatactcgaacaagcgagtgccatggatttttcgttggttcgttgtcagttcgaaaggattacaacgagtagaggcgcgcacattcgtgccttcatttttcgttggcttttactgtagcaacagagatagattgacaagcacgtaaaattaattctgatgcgcgagtccatttcaattctaacttagggcgactcgttttcacacgagtaattaacttagggccagatatcctcgtccctgcgagtcaatttcatcgtatcgcgcactgtagattgtaccgaggattgcaaccacagcgaccaatggagggctgcgtagcattttccatctgcaattgacacgcatgaaaaatcccactatcagatcatcaatccgacgggtccagtaataccaacctgcctgtcagctagctatgaatgattattattccaagcacgtgtttatttgcgtcatatcgcatcaaataatattagtgaatgattgaatttggcgatgcggatgggggaatatcaaaaagaaaaaaaaatgctaaatatctgctacctccgtaccataaaaaacgaatctaaaatcggatgtgacatatcctagtactataaatctaaacatatgtatgtccagattcgtattattaagatatgtcacattcaatactatgttggttttttatgggacggagggaatagctgtagaattttcccattaagagtttgtaacatgacgacctataaatctacatgctccctggttaatctacaatgagattgtgaacaatgacatactcccatgtcgtatttctcggtgatctgggaagcaaaggcacgtctcccccacctcatcagcgcggctcgcctgcctcgccaccgccgacaacgctgccccctgcggtggtggccggcggctgcatcgtcccctccttcctcccctttcctccctctctcttcctttccccttcttccttccctatctttctcatttcctctttttctccagatttgaggtgactcatgtggacgtcggtcctgagcttggctctcctccccacgtccgacgccaacggcctcccatcccgggctagcggctgcgttgaagatggtgggggggacggtcagatctggccaccctaggtctagatctggcgtctctctgatgggatctaggtttctctctggtgcgagaggccagatcccctgttgcgatgatggccagcggtgctagtgatggcagtgagggggacagttcgatctggtccctctccaggtctggcacgtcccagggtcgggtgaggccgtctgtttagccatgtatttgtaatataatagattgtaacgtgtactaaccacgaagataacgagttgtgtgcaatgtaccatgtttgattggaacactaatgtggccttctgccatcatcgtgcataggagcggatctaataagacataacatgtgggactgaacaaacttgaaaaactttagcccggtccttttctatggatgtatgacaaaaggaagatagggcttatatggaggctcttatagtcccaacgtcaaaagtaagggctcgagcccctctgtccctatgatagatccgtccctgttgtgcacctcaagcgtcggaatgccatcgatggtgaattctagtcatcctttggagtaaaggatttttacgggaattgactgatttgtatgagaataatacaaaattgatgtgttgcaaagaagccctccacctttgaagacggacgtgattgatggctagatcaaatttcacaatgttttttaatagtataacaaaagcagataatataaggtcaagggaatacctaagcctttagcatcaagtcttggaacaaaaaatatttgaacggttctatttgaggcaccaatttagaatgtataatagaagatattgccatccaaattaaaagaaagtctaaatacacccgtgaattgcaggtaatgtcctgctttttgtcaattctgctttagggcattcccaacccaatgactaggatgatgtccatagcattaaataagttaccacctaggataaaaaataatgtggcaagtgaataaatgaggaaagagaaggaaatcatgtcttgcatgagacatggtttctacacaatatccaagacatcatgtgagataaatagcattaaattgaagtatggaatagtggtgtttgcattggaagagtagtgtctagtactagtttcttgatgatgtggagtttatgaaaaccatgtctagtgttatgggttgggattgcccttagccttactccctcctttccaaaagataagctgcccacaattttagaaaaaataacatttgtaactattaactaatagtaagctaataatatgtatatgtagaaacatgcatatcatatctttagattcatattttaaaatagtttcatataatgttaatattaattatcgataatatattgtgaaagaaattaacgtttaaaatataatataaaaaatacgcatgtcttgtagtttggaacgaaggtgaagggagtacaaacaactctgtggactaagcacattacacacaccaccgtcattacttgtcttactagccagaggccttccaaggccggtaagatgtataaatttgcttggccctcgcctcccactgatctccacacacaagaactcactaaaccgcttaattactaccaacatttgcatcactgcatgatcaccccaatggccaaaccaccagcaacaacaacgctcgtcctatgctgccatctcgccgtggctgccgcagcagcagcgacatggataggacatgacgatcagcaagacgacgacgtgtccacctacatcgtgcacgtcatgcccgcgcacgcgccacgcctcgccacgcaccgcatcgcccgcgaccactacgcccccttcctccgcgagctcctcctccccccgcacgtcgcccgcccgccgccgcgcctcctctactcctacgcgcacgccgcgacggggttcgcggcgcggctgacggcgcggcaggccgcgcacctcgaggcgcacccctgcgtcgccgccgtggtccgcgacgaggcctacgagctccacaccaccctctcctcctcgttcctccgcctctcgccgtcttccgggctacaggcggagtcgaacagtgccaccgatgcggtgatcgctgtcatcaacagtaccatgcgtccttcgtatcagacccgtctttgtccccaacaccgcctcctacctttcgtggcgaatgtgtgtcgactccagagtttgatgctagcatctactgtaacaacaagcttgtgggtgcaaagatgttctacgaggggtacgagcgtgcgagtgggaaaccgatcaacgagacggaggattccaagtcgccactagacacgacgggtcatggcacccacagcgctgccattgcagctggctctcctgtgtcggatgccaacctctttggccttgccaatggcgttgccaagggcacggctcccggtgcacgcatcgccgtctacaaagtgtgctggaaaatggggtgcttcggctccgacgtcgtcgccggcatggacgaggcgatcgccgacggcgtcgacgtcatctccctctcgctggctgtcaaccgcaaaagaacttttgctcaagatcccacggccattagcggcttcaatgctgtccgtaagggcatagttgttgttgcatccgctggtagcggcggtccaaaggaatcaaccgtcaccaacacggcgccatggttgttgacagtcggtgcatcgagcatgaaccgccaattccagacgatcgttgtgctcggcgatggccagacattttctggcacatcgctctatctcggcgatacagatggctccatgaaatcgcttgtctttggtggtttcgccggctcag

SEQ ID NO: 20941 - DNA, 4331 bp, Oryza sativa
atcggcccagtcgtagtagttatggtgagtatgctaaggccactgcccatctcaacccaggcaccacggtgcctaacgctgccgcattggagatcttgcgatacatggccaggacaccatatccagttggtaagatcctcttctttggcacggtgctcagctcgtcgccgaggatcgcgtccttctccgcccgtggcccgagcctcgccgcgccggagatcctcaagcccgaccttgtcgcccccggcgtcagcatcctcgccgcgtggtccggcctcgtctcgccaaccgaactcgacgtcgacacgaggcgcgtcaagttcaacatcttgtccggtacatccgccgcgtgcccgcacgtgagcggcgtcgctgcgctgcgcaagatggcacggccaagctggatccctgcgatgatcatgtcggccctgacgacgacggcgtacgtccaggacagctccggcaatgccatcgctgacatggccacgggcaagccggccgggccgttcgagctcgggccggccatgtcgacccgaacagcggccttgacccggggctcgtctacgacgccggcgtcgacgactacctcgacgtcctgtgcgcgctcggctactccgacgaggatatcgtcggtatcttcttgagggacggaacgatcaccaactgttcgacgcgggcgagcaccaccgtggcggacctgaaccgcgcgtccatctcggtggcggtcaaggcgtacggcgacgatatcacggtgcgacgcaccgtgcgcaacgtcggcggcagcgtcgacgccgtgtacaccgtcggcggggtgccaccgccgggcacgcagctccgcatcaggccgtcgaagctggtgttcgacgcggagcaccagacgaggacgtacgacgtcgtcatccgcacggtgtcctccggcagcttcgacgagtacacgcacggttccatcgtctggagcgacggcgcgcacaaggtgaggagccccatcgccgtcacctggccgccgtctcagagcgccgccgtcgcggccatttgatcgagcagctgctctaaccctctcgatcaatacgcatgcatgatctggctacgatgtccatctagtttacagctttgctttgcagtgtgtaatgtttttttccgaataagcagcttgctgcttcctcgctagtacaataatcccggtgtggtgtaatcctacacttttgtatcgtgcatgcatgataaataaaatcgagaatatatatcaataaatcaatggagtattcagccgaattatactgttcaagtaactattccaacactttgtttgcttagttacgttattacaactttgcaaaaatcaagcatgaaagcaatttttttttaaaaaaaagcgtacgttctgaaaatgcgggtaccagctcaatgtcttgcaagcataaaagagttaaaagacaataaactgaacccaagaaataaatgcatggtaccatatggtccagcctagaagcaacacagataatggcagcctacccaacatttatttgctagtaatacactatttctcccaccgtttcaaattattgcattctagttttatcttgaatcgatcatttgtatatctgtccatcaattgttaataaattgatagtttaccgcgagaataactttcatattatttatattttgcatgttgttgaattcgacaaatttatattgtcaatgataaaaatgtttgtgtcgtgacccaaggtcatggacaagattagggatagacgggaaaacacccttttcccgcctatcctgagaaatgagcccgaatacaaaataaacacacacttttactgacaagatttttagtattccaatatgtcctgtctgctacaggtttttttgtcagccttatatagttcatagatttacatatgagattacaattgtgcccttcgttgggcccacatgaaattacaatcgtgcccatgccatatgagcaaactctaagggcattttggtacattataggggtcattatagtttttggtgccagctagatggagtggttgagtggttcccaggaatattctcttggcatctttattgtccaagttgccttcttcatgaccaagagtcttttccatcaccatgggtcttctccacgaccgagggtcttttccaccaccatgggttttctccacgaccgagggtcttttccaccaccatgggtcttttccatggcatgtagtcttttccatctcgatcatcctttccgatttacctggtagctgacctgttattaacttaggaaatacccaaaacggataatgagacttagtgagaagaactcactcgaacggtattttccgactcgaacagtgttttccaactcgaatggcattttaccgttttccctattcgaatgaccctttgccactaggatacttatgataaaaactcaatcttacccaatctcttcctctatagtgttttgggccgaatatggagggacggtggtgaccccttgctacaacagtttgatttatggtaaaactagaatgacaagtaatttgaaatgaagggaattacatcttattcagtacacctatctgatgaaatgaagtctaataacttctagcatgggaatccaggtaatttagcataaataaaattattcaccactccaatccagtgagttacacatgtgcatagcgatgaacaggcaaccgatcccttccatgaagccatgggagcactaagcttcatggaaggatttggtctcatgcgtggagatctctgtccaagaaggacctatacaagctgtccccattgccaccaaaccagaagacacccaaatttccaacactactctacatggatgctgctcggccgttcgacggccatgtcacggcgatggggctagtgacgtcgtgcacgccgtcgctccaggtgaccgacccgaaggtgtactcggtgtcgacgatcaccgggttacccgacgcggcgatggtgatgtcgtaggacaggctctggtggctctcgtcgaacaccagcttgcttgggctcaccgtgacatccacaccggacgggctgtcgatcttggcttcgtagacggcattggcgttgctgccgacgttgcgcaccaccctgtggtaggtgactgaatctttgtaggaggataggacgacggcgaaggcggggtagttgaggtccccggtgcgggggaatttcgtcgaacagttggcgacggagccgtctgttgtgaagagggagatgatggagggggagtagccgagcgtgcagaggaaggagacgtagtcttcggtcccggcgtcgtacacgaggccagggtcgagcgcgcggttggggtcgacgtggccggcgccacggacgaacggcgtcgactcggtcccggtagccaggtccttgatgaccgcgctggagttgtccacgttgtacgccgtggtcatgagcgccgacttgatcgccgccgggctccagtccggttgcgcctggcggagcagcgcggcgaggccgctgacgtgcgggcacgacatggacgtgccggagatgatgttgaactccacgcgcctcgggtcgatgtcgaggtcggtgggcgcagactcgccggtccacgccgcgaggatgttgacgccgggggcaatgacgtccggcttgaggatctccggcgcgcggtagttggggccccggctcgagaacgccgcgacgcgcggcgcggacggcgacttcccgatgaccgtgccccggaacacgatggtcgccgtcggcgacggatcgctctggacgtagtacttgatcttgtcgccgaatttctgccccaccattgtcgccgggacgaggtgggagtcggcaaccagctcctcgccgctctccgccgtgttcaccagaatcatgccggcaccgccggccaccttcactgccccgcctttcgccacacgggcgttgctcccacgctcacacagaacgatcttgccggaaaccttcgctggatcgagctcgccgattatgcaaagccgagacccgcagtcgccggcgtacaccaccgggagcagtgtggagttcaggggttcgccggagtacagggacacgccgccgtagacctgaccgttgcctagaaccacatcagccgggaattcgcggtcgatggtagatgcgccgacggtcagtatccatggcgcgatgttcgtcgcggtgtactcgccggggccggagttgccggcggacgcggacaccacgatgcccttgctaacggcgtggaaggagccgatggcgatggagtcgcggaagaagctcggggcgtagccgccggcgccgacggagagggatatgacgtcgac

SEQ ID NO: 20942 - DNA, 9468 bp, Oryza sativa
  unsure (1)..(9468): unsure at all n locations
tgtacgcggcgatgtgcgccgcgggggacatgcccaccgcctggccacgcgcgtagtcgaagaacccggcgccggtcaccggcgaccctgcggcggtggaggcggtgtgggtcccgtggccctcggtgtccagtggcgacttggactcctccgtctcatcgatggcgtggccgagagcagcctcgtatcccttgtagaagaactttgcgccgatgagcttgttgttgcagtaggcggaggcgttgaaggaggcggtggagacgcatccgccggagaaggacgcgggcggcgggccgagcccgtcggtgggcgcgaaggagccgcggccgatggggtagatcccggtgtcgagcaccccgacgatgggtgacgacgcgccaccggaggcggcggcgggcaggagcccggaagcctgggtaaggtggaggaacgccggggtatgggtggtgtgcagctggcgcgcctggtcggggtggacggcgagcaccccaggctgcgcctcgacgtgcgccgcctgttcgggggtgaggcgcgccgcgacccccgtcgctgcgtgcgcgtaggagtagagcaaccgtggccgcggtgcgcgcagatggcgcgggaggcgaaggaggcggccgaggaacacggcgccgccgccgccgccgacgcgcgtggccctgagcgccgggtgctcgggcgcgaggtggaggatgtacgtcgactgctctctcgcggccgccgccgccggcgacgcggcggcgaagaggatgaggagcacggcggcgagatggcggagggtagccatggcgcaccgggggagcggattggattggtcgatgactcgacgccaatgcggcctggagaactaaataagtggtgggccctttcaccgggtctggatctggattggccaatggcgatgccggcgtgggctcgtgggattctttacccgttcggtcgtcgggttacttttgcggcatcggattggacacgtcgggcctcacaagtctaagtatctcatttttatcgattttttctccggtttatccgtgactgctgctccagtttaggaccagtttcgtgctcgttttcatcaggatgtactctcactccgtccatagaaactccattttcagtctttgatataacgtttgagtttttgttttatttaaacgttttaaaattagtatttttgttattattagataataaaatataaatagtattttgcgcgtgactaatttttctaattttcttataaatttttaaaataaaatagacggtcaaatgttaaactcacaaacctacaagtggggtttttgtgagtagtactccctatgtctcaaaaagaaaatctaggattggatgtgacacaccgtagtactattaatttctaccccctccgttccataatatataaacttagaaccgaatgggacacttcatagtacaacgaatccaaacatgttgtccagattcgttgtgctatgaattttctcatccggtcttaggtttctatattagagcaagtttaatagtatagtccactactacctccaattcatctatagccgatttaatagctatttcatacaataattgcttactatactattaatgtatgaccccacctgtcatacacactctgcttcttggagtccgtgctgcagctagctacatatctatagcccgctgctcttctctctcattttttatctcattaaaatatgtttatagttggctaatagtatgctattgtacctgctcttatgggacggatggagtattaatttagacagatatactttcagatttatagtattgatatgtgccacatttgatattagtttggttttatatgtccgttacatagaaaattacttaaagtgaatgggacaccatacaatgtatctggacatatgtccattttcatgtccactgcaagcaacggcaacaaattcagtggtgacagcggcgacggatttttctccttgtcactatgccaccttgttgtcaccggcaatctaccgcgatctatcatcaatagtccaggcgtagttgggaagaaacaccggatgtcgagttcaggcaatagcgtttctgctcttcccaagcgacatccgtgctgcacgatcttcacacgcagaagcgttgctgcgccacatgcttcgtcgccgtatatcttctccgcaagcgcaccaagttttagaatttttttattaaaatatccacaaaaatagtttttagttttgaaaatttacaaatttaatcgcctgccgccttttgggatttttaaaaatcgcccttccaaaaggcggcaagggatctaaatgtaaatttttcagcacaacttgttagctctatgattttacaatttaaaattatattatataaagtcagatgaaataaaactttatatcaaaattatagatctcaatgagatctacaactttttagttaacaaatttttcatttaagatgttttagatatccaaatattcgttacaaaatataaaacacatttaaaaaaatctcagatctacatttcaaacgacattggatggagataaactttatataaaagttgtagatcttgatgagatctataactttgtaatttatcactttttcatttaaaatcatttagagtatcgaataagcattattagtttttaagcaattaaaaccggtagaaagggtttgaacacaaataaaaattttgcatttaggtcccttgccgccagggcggcaggtgattagatttgtaaattttcgaaaaaaaattatttttgtaaatattttaataaaaaaatgtataaataaaaaaaatcccaagttttatagcatctggcccatcaagctagcccgccgggaggctgatcgatccactcggcccagtaatggaagtatgaaacgccaacaaattgggtcggaacgggatccccgcttacgtagttacgggccgttattagttgggccggccgggaagggattacagcaacgaactttagcaaaagaaatgcgccttgagactaatacgcacgtaaaacggtacgataaattaactcaggaataatttagtattagttaaaaacttaaaagtgaattaatatagtttttaaagtaacttttgtatataatttttttttaaaaaatactccttttaacaatttgagttgagaaaatcaacaaaccaattcagcttgagtgtcttgattacttgtatcacttggcagtcttgggctgatgcttttttcggtggtccaattaacgattttatacgaattgattgtaccacagtatccccgacgtcaaatcaagaaaacactacacgaattcttgatttttgctccataaaacaatacagcatgtgtttcttaattatttatgtgctccaaatataataaaacctgtgattctctggagacgaatggccaatattataagcacaagtgcgaatcgtagtagcatgcaaattgaaaatcttccatgccggctgaggtaagctctgacgcatactttgcctataatttctttatatcaattattttttccgtgctgatagctctaagatgagtcaggacacgagtacaaagcagatggcagcggaatctcatctctcccatatccatcagtaataagctttgacctctgcgtgcttttttttgctcacgtagccgtgcagttacgccattttggaacaattgaatcgactatctaagtattttgctagtagaacttttgcagaaatttaaggagtatgtaaaattaaatgatataaattatgataagtcgaaaagaaaatagataaagaatatctgcattgtacgacggaggaagtaaataggagcccatgtacaattccaaagtactcactcgtacgatatcatttcctaaatttatcaattgtatctattattatcagtatgtggtgatcatgaatggtcggtaaaatataatcaagtatagctgtttgtcactgtcagtatgtcagtccctcaaacggttataggggtggctaggattgaaccaacataaattggcgcccatgcttttttagcgtatagaattttatcatccacaaacccgtcacaatccgtgaacgaacaaacttgaaaaatgaaatgctaaacatattcatcttcccttttccacacggaagaacagcagcacaataagtgaaacagtgatgcatcattgcatctgtgcatttaaagatatactcctgagtagactgaaaattctctcttcttgacgacagtaaaaacttttttagcttaacctccatgacaggttactgattaactaagcaagggtgtctcgtagtagtactgtactgtgtagcttaatatagcacgtcagcttctcagctctaacctctcaccattttcccaagagatatcgccatcacgatctcccgtaatcacttcttatataaaaagcaagcaagatgctacgagctaaacaatttctttagttagtcttcactaatcacgggcttaaacgcatcttgttacattctcatcggcaagcaaagagcaagagagaagagagaggagatggtggatgtgaagcacacggccggccacgccggcgcgaggagagtcaagctgttccgggtgccgcggcggccggccagggcggcggaggaggcgggggcgccgctggtaccggctggcgagaggaggaagaggaagatggcggtggcgaggctcggcggcggcgccggcgggcggaggcggctgttcggtgcgttccggcggctgcgggtgcggtggctggcggcgctgtaccgccgctcgctgcggcggctgcgcgcgtactacgccaaggcggtccaggacctcctcgagggcgcggcggccatgagcacgctgcgctcgcaggccgccgccgactgctcgttcggcactgcgttcgcgccggtggtcgccgtcggctactgatgagcgcgtgcatgtctgcagcaccgttctggcctgtgcatgaagaacatgaagccatggagcagtagcacccctgtgtatagacgtggttaactgtccatgatgaattccagtgctgatcttttttctctcttcattttatggatctcgagttctcgacaatgatcagtgttcatcctgttcgtaattagctagcatgtaagtgacacactttaccgagatactgagaaaaaaataacttatattagtggttaaacgaaagagagcaagattaggtaagaagaaaacaaatatgattcggcgttgagttgcatcagangtcagttcgtgtgtcgaatgaaggtaatgtaggtagtttatgtangggctgggttcttcgcgaattattactcccttgcagcagtgtcttaccagtagagttngcagatccatctgggcatctgtcccaattgtcatcgaataattagtctgtcgagattctgttccctcctcacgtctcaactctcaactgccgtctgctggaactaagataagcgctaatcgtagttggcttgcatatataataacgagtactccctccgtttcataatgtaagtcattatagcattttccatgtttatattgatattaataaatctagacatatatatctatatatattcattcgtatcaatatgaatatgaaaaatgctagaataagttacattgtaaaacggatgaagtaacagtctgtcacttcccttttcgtagccagcagtaatacgcaatagtaactcactgaagctattgcaaatagtaggcttaaggatggacacaaggacaaaatttcagtctaagatgattcccatcagagcagacatcctaccgtacgttcaggcgttaataaagtccaactgcgcctcaagatttgcatgtgttttgttgcttttgtttatgttctgatctggtatagtggtatactctctggactgatgctaagtaaaatcccgatcaaatcctactggagcctggaggacaacgaagcgagacagccctgagcccaatatatcacaatcaattcatggcgtgtttacggccccgtgaggccgtgactggctcagttacagaaaagggcctgggccgtcgttacaccgccagcccagccaacaattttcgagctgggcctccactgctgcgttccgttgttttggttggatcatccggccaaccagcgtcaacaccgggatcggccggccgcgtgtctgacggaaatggcaaattcaaagtttaagcagatttaaatcagtaattaggtagctggaaggagcatgaacgcacgattcatgcacagctgctcggtgcttcaactacacctgacctcacgagtcacacctgcacagtacgtgctacaccaactgctactagctgacgcgagttctatacttctatcagcatgacacatctcgacgatctcgtagaccaactcatacggagatcacgcttaaatactactcgtaagtcgtcgcagctgcaggtggacacgcggctaggcgaccaagcacaagcagcaaattaacaagcgtttcaacaagctggagatcacgagtccggagcagatggacggccacgtcgctgtggcgccgcggcgagacgctgcgttccgcgcgacgacgcggcggactctgacgattctgcacggaagctgcagggtgaggaggaggaagatggcggtggtgcggctcggcgacggcagcaggaggccgcggcggtttatgggggcgctccggaggctgcggctgcggtgggtggtggcggcgatgtacaggcgggcgctgcggcggctgcgcgcgtgctacgccaaggccatcagggacgtcctcgagggctccgcgctcgtcggcgccgcgcgcgcggacgccggggtttgagttttgcactttcacacatctcctttagggcttgtttggttgattgggaattaatccccaagggatcctaggattgagtgaatccctcccaattcccatctcactcaaaccctgtggggatgattccctttgcctctcctaatccctctcctaaaacctgtgttcggttttggctgggaattaacccatggagaagtccaatcaagcaagaaactactgaagcggctgaatactccaataaatagcgcattaaatttgacttatgcaaaaatcatacacagaagttgttgatgtcatgaaaaatactgctaacactgaagataacagtgtatgcgtctatttcttcaagcaagaagcacatcacaaacatgtcttgtcagcagacaaatggtaataatactgttaagaaactttgggcttggcccatgaaggcctggcccaaatacacttattgggcctatcatcaaaccttccatatattggaatgcactatataaagagaggagggggctactcatttgtacagttgattggatgattgaatagtgaaagagagtctcacccctaaactttgtgtctccacttttatacgattatgggaccctcttagactacttcgtgtagtaggagggttgcgtaataaatacaattattttcactttccaaatatctcacatagcaaactcaaaacaggctgcactagctaagtctaaatacacaacaaaacccaaacttctcccaggatctcccaaaatgagagtttaagtacttcatgaagctgctaccatcacattttaattacataaaatccaacatcagtgattgctccaaatgacgaactatagccttctgtgactgaaaaggataaccaatagttaataagatggcactactagctccatagtaaacaagtattcacagtaaacaagtatgcaaaagcgcagtggataacaaccaaattttcccttctgtacaacatctatgaaagcattgtagcaaaaactagacaggaaagttgtaggtacagattcaacaagcaagtccaagaagagatgcttatatactaatatcaagcagttgtccttatatcaattataaaaacttcaaaaggaacagacacctcaattgccaattgatcatcagaatttaacagtaacaaaaaagagagggcatggaaccagggagatgataagcaatggtgattgcagtgaatgctgtaaattcattgcagtacacaagaagccctaagctccatctctacttctcatcatacacagatgcatatgtctctgcaacaagtctgtcacttcatgttatgcttttcaacaagacagttattttaaattggacaaggatcaccagttggtactttatatgtaccagtgcattacatctagtgagaggaatattatgcttggaacaacaataaagaaattagtgcagtacaacccaacctgtcttcacactctaagaattggcaaattagtccaaattaaccaattttcggatcaaggtaaagcaataagatgttataggcatcacattttaattactgaagcggttctattatgccaaatgtcaagtttagtagtgaagcttggtgtgaaaaattctataggctcagtaattttaaatgaaaatagatattgaaatgaaagtgactctgcttgtaagatgacaaaaactgctcaaatagaagcatcacatgatgtccttcagcatcaactgctgcatatcaggagatccactagattttcacttcagctagctgtaactgcctagctcccgctttgcagcctcaattacaagcatattatatggtattgaatcttttttcacctatcctaaagccaaattgtgaacttgcaatggcagtaccatatgcagtactacttaaaatgcttgcacccaaataatcaaaattttggaatcctaaactaggataaatagatcatcatgcttaacagagaaaagatgcacaaatggatggacggtttccaggagaagcttaacagcggggcaaatttcctggaggagatgaacagcgtagtgagtttagtgaagaagcagcggatcaacgaccccagcatgatgaactggtcgctgcagctcaaggacgctatcgacgaggtggagtttacaagaacagcaagaacaacaagaatagtcaaagaatcgccttgtgctctcctccgcctcttcttctccgagggcgccacggcggtggcgcagtgggcgagggcgatgggcggcggcggcggcagagtggatgcgccgacgctatgctgcgaccgggagcggtgttcgacgggatggcggcgacgacaggaaagggagaagagaaggaaaccctaaccctagatttggaagaggaggggagaggaggaaaggcagcgtgctcaccggaaagaaggtggcggccggatgagagagccgtgctgtcgccgtcgccgtcgccttcgggtcgcgccgcccgccgcgcgccgcgtcttcgttgcgccgccgcctcctctcgaggtttttttccacgcctcgggagtagatgatttattcccgggccggggcgcagggaaaacaccgggatgggccgggttaaaatccagactgggcttaaccgaaaacatattttt

SEQ ID NO: 20943 - DNA, 2727 bp, Oryza sativa
  unsure (1)..(2727): unsure at all n locations
atcaatcgacaccaaatttttatcgtatttcttttacgctgtttttccttctcttcgttttgctcctcccgatctattgcaggcagctgtcatcgtcatcgtcgtccctccggccggctggtggtgacgctgcgtcggagcagctgctggctgctgctgcgtgtgcatctccgcagcagcgttgccgcatgagttagacgcagcagcaggtgaatttttgtgttgctttcctgggataaattttggtggcaacattttcttcttctttcctcggttctcttcttcttcctatggcgccggtcgccgtggagtggcgctcgcggctgctcgggcggcgcggctcctccggccatgcgccccaccgcatcggcgccgccgtcgctcggccgagctcctccacatcggcaccgttgcccttccgcaccattgaggccgcgacccgcgctgtgcccgcgccggggccggcgccgccgcacggccacgctcgcaccaagccgccgctcagccgcgccccgctgcaccggcgccgccgtcgctcgtcggagctcctccgcataggcaccactgtccgaccgcaccgccaccgtgtgccgctgcctctccgtcgcctgaggagaggagaggagaggagatgggaggtggggagtgaggaggaagaagaggaggggtgagttggactgacatgtggggcccactattttttttattattttctgtgtgagactgatatgtgggtcccacgggttttattattttttgggatcgaattgccacgtaagcaccacgtcagtgccacgtcggatgaagaccgagtcaattagccacgtaggcgtcacgtcagccaaaaccgccctcaaaaccgccgagggacccgttgtgtctggttttctggatgagggacggaaatcggattcgttgacaagttaagggacctcatatgaacttattcctatctgtggggattgggccccgatcccggccgttcccggcccaaccgaacaagcacttaatttgcatcaaaaccctcctgcaatccttgcatgcattctgcgtgtcgaaagaatgattctgtgcatggcaaacgtgaacaaattaagcaaacaaatttgacagcaatttcgcttcagagttcagatgctttatttatgagataatctattctaaatcattaagtttgttcgagtacaacgatttgacattgacattgtctctttctataatatatcggtgactttatcaattgttttataatacgctattgggttaggcattcttttcaaaaatacccaaaatatccttatgaacatactaggttaacaattgatttatctcccaaaatatccttatgtggcctccttacgcaacatggaaatttgtacaggagtttcaagttttttacatttctttttttaaaaaatttataacttatcttttatatggtatataaaagtatttattattattattttttaatataaatcatctttcacatactaaattagatatttttatgctatcactcttgtataagcaaattttctctcgtatgccacgaaaaaatattttttttttaaaaaaataaatataccaaaaaaattaaaatttgtatacaaactttcatgttgtataaggaggccacatacaaaaatcatattttttttgaagcttctaataagataaatcaattgtttattttgtatgtctctaaggatatttttgaaaataaggtccagccctggcatatcgtagaacaattgttaaagtcgccggtatattatagaaaaagacaatgtcaatagcaaatcgttgaactcgaacaaattcagtggtatagaatagattatacagcaactacgcttgtgctatatcaggaggaaacatacgtctcgggttccccccgagtgcacccatactgccatccaatagttcggtttacaacagacaagtatacaacgtacgaaccatctgaaaagagggaggtcttctctatttgtggagaacggaaaacatgggattagggtctgaaaatttctgggagctggtttggatatttgttggatccatttttcgcttgagaaaccccaaaatttgaaattggaaatagtataggggaactctgggtgatgcttaggcttggtccttttttaaaccattccgagacatactagaacgtgggaaggtttaggattgcaagatcaaaccttttatatataggggtttggccggtttaattggaaaaaaaaacaaccaacaacataacatccaattaaccattgaatcgtttgttcagttttacatctattttccctcagcttttaccctagttcatccattatcgtcagtattacgatgtaagccgtccatcttcatcgcgagagttttgaatcttcttatagatttatcgcaaaaatcttccgttcatcttataagatggttggtcacttgtctaatccagcccgctagtcggctttgatttggaaattcattctgattgggagcttttcaagatcaatgtggataccgcaatgttttaggtgaatcacgtggtgatgaaaaaaaaacgtgaatgcgttgtattttgttcagacgacgcatgtagcacgccaattcattgccagtggacggcgacggctactcgacatcaatctccatcatggagactaatcaagcaggtgaccgagaatcactaacaagnnnnnnnnnnnnnnnnnnnnnnnnnnnnnnnnn

SEQ ID NO: 20944 - DNA, 553 bp, Oryza sativa
ttgcgttgtggtcgtcctcaccaacgccgcaacggcgtcacgttcgcgagagatgggcgcgtgcgtggccggggagccgccggaatcttggatcttggcagactctctcgcgcgatgaggacggccaagaaaccgagcggattctgtagcccaaatgatgacaatgtccttcgttcgttccaactaacaaacacaacactgttgagccatgagagggacttggtactggcttgttttgtttggttggttgggtcttttgaaatgacgccaaagagaaagttagtgtttttgtactttgcaggtttgggcgctgtggatggacacagctttgtttcttggaaaagttgaaaagggactcggtttcaattggaagcatcctacagtactgacgatcgatacatgaacgagcatccatgtaagtacgttttgttatgtgccgcgtgacgaaaatgtaggatggaagatgggaattgattggcaaatgggattttgctaattaggccacccccaattactctcttattattgctccgaataaatagtttttttcctg

SEQ ID NO: 20945 - DNA, 855 bp, Oryza sativa
agaaggaagaagagaaaaaaataaaaaaattccatgtcatcgtccacgtggcgtgccacgtaggcaagaccacagtcaaacgcggctttggactgggatgatacaataaaccaagtttagggacctcgatgtgctctttgcaagttcgtggacctaagtgaaacctcctgacaagtttaaggaccgctggtgcattttactcattaattttcaacaggagaacctattgaagtagaaggggacatgtccactgcacagttagatgaaattaaggccctgttctttttcagattatccattgaattattgtcatttactatttgcccccacttttctaaaagtacatttcttttaaaaaaaccattttttactaaccacttgttctataaatgaataggtatctgctcaatttatccctataaatgaataggtgatccatcagttttcttccaccaaacaaaatgttgttgactcaatcagaccacacgattgcacggacggaattgggatgatcctacagaacgacatgaacaatgcttgtctctatggcttacaaggtgttatagggatttgtttggaagcactagttgcatgatagaagggcctaaaaagaagcaatttattgtctatacacgcagagaaaaaaggactcacgtgccgttctcctaaatagacacgggagccgaccagccccgagaggaggtttgccggccacgtcccactagcgtcgccgccgctagcgatggcaactcccacccttttcttccctcctccttccctcttcctttcccttcctcgtttttctcctgttccaccttgtcttgccattgtcggcatagccacgacgcctccctc

SEQ ID NO: 20946 - DNA, 686 bp, Oryza sativa
agtggatccccccttgttcgtccacagaacaataatttccatgacgaaatggttgagcagtacggtcgggttaaacgttttcttccggcggtgttgcgggacctgcatttccgtgcggcaccggcaggtgaacatgtactggctgcgattcattatctggcagaactgaatggttcgaaaaagcgcatccttgatgatgcgcctgaacatattatcaccggtccctggaaacgcctcgtatacgatgcggagggacggatacagcgtgcaggttattcactatgtttgctggaacgccttcaggatgcactgcgccgccgggacatctggcttgaaaacagtgatcgctggggagatcctcgcgagaagttgttgcaaggtgaagagtggcagactcagcgtattcctgtctgtcgggcactgggacatcctgtcgatggacgtaaaggtgtgcaacaactggctattcagctggatgagacctggaaagccgtggcatcacgatttgaaaagaatgcggaagttcatatctgtaatgaaggtaaatatccatccctgactatcagttgtctggagaaacaggaagagccaccatcattgcttcgtctaaataatcggatcaaacagctactcccaccggtagatttaacggaactgttacttgagatagatgcccagacaggatt

SEQ ID NO: 20947 - DNA, 16187 bp, Oryza sativa
  unsure (1)..(16187): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggtcagaagaacgacccacacacaggaaaaagaaacatagtggattagcatgatcctaaaaaaattctactgtctgaggttgtgtctataaagagaaaggagataacaatcgactaactgatctccaaacacgttaataatcaagacatattttaagtactccagcagcttgcaagggcatcaagtttcttgtcagagaactcccggtgctgtttgcactgagggaaaatcacatataaacctaattttaaatgttgaacctgcaataaattaatccatttgatttgaccatctgcacatctattgtgtgttaaggctacctacaaagacaggattatcacaaactcctcacaagtttgcatcaaattgaaagtcttaccctaatgtagcaaattcgtgcaaacacaaaatcgttaaatatattacatatcaagccactaatcaacttatcaacctgtctagtactctagtagccatccatgatttctccacctcacagacaactgtagcaccaaaaccatcctgccaatctaaccacatcgagcaacaagaggatcatgaagacttctatcctacttttatgttttaaccatccatcatttttgtgtttctcatacccacatatgaacaacagccacatgcctaatgactctgtggacttctttttgaaatggccacataaggtggttcgcagacttggttagctgctgatattatttatgcaaaaactaattataagcttctcagtatctttgcaggactttgttaatgaaatatctagaaaggcactgagcaattatgggtttctcaatattctctacctgtcagacctctcacccatgcttaaaccaactctcaaaatttagcaccagcaacactttcattcagattgatatgcgcatcctaaattcgtaatcattgtggaccaataattacatcaacctcccaaaaaaaatcttcatatgacctcgcacttaattcaaacaaatcaaatccatctccacacaatctccagaaaagcattgcttctaacacaccaacaaggcacagcacgatctaatcgaagttcgcaaaagaataaaacgtaaaagtaaaagtatatctcatgaagaacgacgagattcccagataagatcgggaggctggtaggtaggccgcggagaggagaggagtggagaggtacctggatggagagcgccgcggcggcggcgcggcggaggtggctgcggagctggcgctcctcggagaccttctgcagcagcgcgtcgcgggtgatctccctcgcgctcgatcccctcagggacacctacagcaaccagaaaaaaacaaaaaaaaaatcagccacggtagagcgatgcggagggagaggaatctaccatggcgtggagaagagggggaacctggcggtggctggcgggcggcaccgacatggccggcggggaggcgacggagatgggcgcggccgccgcgcgtggggggtcgtcgtcgtcactcgctgaactggcggccacccggcgtgtggacgggtttaggtgaagatggttcgttttgttggttttgagatttgtaaccacgcttatattaggtcggtgaagacgcgaataatccccaaagtcggcgtaactggatgatggggtttggataggtgtgtgtatgtaatctgggcgcttactcatgtctacgtcagcgtaacagtattccggtagacttgcttagtagtatttcagtgagagtggttacttttcagtttcttgttactgctctatttcgagtttacttttggtattttcaatggtgttttgacttttttttagctaaattttctaagtctaattaaatgtataaaaaatatagcaatattttcaaccaaacaaatatattatcaaaatatatttgtttggttaaatttaatgaaacttatacgttgttgtaaatactactaatttttttctataaacttggttaaaggtaaaaaaagtctttaaaaaatcaaagcaacttaggctgtgtttgagggtgaggggattgagaagattgggaaaatacgcaaaacgaggtgagccattagcgcatgattaattaagtattaactattttaaatttcaaaatagactaatatgaatttttaaagcaactttcatataaaaatttttttgcaaaaaatacaccgttgagtagtttgggaagcgtgtgcgcggaaaacgagtgacaatctccccaatctctccccaatctcctttgaaagaatgcagccttataatacaaaagttttatataatatgagataaagagagtactaaaattgattgttcttttttttaaagtgatcgattgttctgttaagatcatatgtaccattacaatatttgtccgtgtaacgtgtttagcttcagaaagaaaacgtcgttggatacaaacgaaataggaggatgcaccctggacgtttgggtcagggggggtgctctacacacagcagccaaccagccagccatcatcataattcatcaaccgtagcacgagctccctgtgagtggatgctttttctttccccagggatttcgtaacccagcaggcaccgtcgcatcatcacaggggctccttcccttttgcgatggcatcatcccatattcccatcttgacagcgaaatgccaattttagagaggcatacacaaagcaaaacggaaaacgaaagacagagacgacacattaatacaaactgtacaaggatcagttggtacaactttacaggcgtagtagttaggaagggacactaagcaccatcagacaactccccttcagaagcagctccaaagccggaagtacatgacagtctgcttgatgtgctatcttagatgtcatgagaatgaggggtttacacaacaggcaccaatcaggctctttatgttaattacaattacatttacatgtgctggcaagcaagaattgtacacttgaggagaatcagtatactttggtcaggaaaaagaccttctattgtgatgtttagctgtatagcctgtaggcaaagaatccagaatcttttggtttcaatcatgacaggttaaacataaacttattgtgactgcgcctttggcgctcctatctcggcttcatttgccggagtgctgtcgcccatgctggaaaggatatgatccactgtcaatcaaatcatctgcctgaacaaaatttggaacgggaaatgtggcacttacacttcgccatggcttgcggtaatgttttcagggtttggtaccaccaattccttgttgtcgattccactcggagagacagctgcattgctctgcgggtatggaaatattgacagttcagcaatgatttcattttcaaactcttgataataattattaaaaaaatgaacctgctcagttgcaaccacagaagattcaacttttgccttggggcaatttctcagggtaccctgcagataccaattaggcaattaccagacacagggactagtgccagcaaaggcaaattgcaaacatcagaataagaagtcacatagtgatgtttgagatatgttccttgcacagagaatcagtcaacaataacatgaaacaagcggcttaattaacaacaatggtaggctctctttacttttatttttttcgtataccccctaatttccaaaatgaccatacccgcaattctgacatatagctattgaagtcaacggcgtacctagaaagccaacgaaaaataaaagaaaaggtacaatatgacagatataaccatgtgtccatgtcttcataatatggttcaaaaaccatgactctttttaccctagttggtactgcatatacaccattgctgcaagtgcattatcaaccgcataagatagcaaaacagggccactgccttaacatgccctgtactgtaacgccataacaagaggcatgcatgccatgaagaatgtttttgccagttgaaccaagcaatgtaattatgcaatccacctccacgagaatattactgtattctaatgctatcaatttatgaaatgggataggtgtcctcaaaacaaagatgaagagaagcccattagttatcagaaagaaagataaacaataaactagctcattaatacatgcaacaataccttgttagcccacatcagtccgcaggcgttgcacagagtccttggaccagctggaccacggcgcattgccggtgtcattttttcactagtgccacaattctgacacctgcaacaagtattttacagaaagaagataagtcttctactaaacaataattagacagaacgagtatatagactatcaaaagataagaaatactttgattctcgagatagaaaatcttggcctgaaccctgggaagcaagttcacagcctggagatagggactctccctccatatttgctcttccggcaaattgacccttcctacgttgcatcctgagagtaagtagaagcaacatcaattttttcaagccaagtaatgtttatctagtcatacaatttagttgctagttgattccatagcttgatgtgcagaattttatgcgcctgggtctgcaaacaatgtaatccacgggatctatcatcccatcctttacctcctacctatgcctaatctatctccagcctagcttctatccattgatgctgtgcctagcatgtatgcgaactatttgtaccatcactgctggccagggccccaatcattcttgtctgtcagtattcaacaaacacaaaattcacaaaggagatggagctggaaagattgaggtgacaacaatggtgatggctaaaacaatcggacacagaaagtaataggtagcagcataaatcattagattttttttaccacaaaaaagactcataacatccatccattgctcattgatacaatggatatggtacatcttgctcttagttaaagctacacagaagtacagctccagacctccagtcttaagtcagttaatttgttacatttttattctaatggagccatgcaattaattgttggaacatattgagcaactagcatccagggacaacaaaaaattgagcttgcatttttttcttgcaaattatattggtagatgttcatggtatgatcatggaaccaatcaagcagtagacacattgattgctaatcaaattgagaacccctaatgaaaatgttcatgtgctccccatggacactaaagcagttccatcaactagaagaatgaaaaagaatgatgattgatctaaacaaatttagaagactgtagcaaatccacatggttcatctatgccttcttctgtggtagaatttgcaaaagatcggtgaatactcaatcagactagatacaaacctgagtgccacttctttgcgtacggcgtaacgtatttttttatcgaaatttctttccttccgcttttcacggaacctaatgagtgaagcaacccttttggcaggaatgtctgttctctgaagtaaatcatcataaccctgcagataattctaacatgaactataaacgaagaaaacaatacagattgccaagcgactatggaactatttatttccacatactctgttctcacgttgatttggtaaaaccatgttagctaaacctggtggcatttcacttcttcctaacaataacagaacagcttgaacctgggaaaaaaaacttcatcttatgaaaagacaggaccataaaagggaacaaaagaaatacctatacctaaatgaatattcagaaaactcaactctggaataaatttaacttgggattatagcaagcagttatacaagccatcatattgtttacatgaatcaggattccagccaagaacaaaaacaacagaaaactcgggtcacaaactgcacaactgaaaagttccaaggactaacttgtaggaaatagcaagtcatcaccatgtgttactagtaatctacgtgagtgataagaactgacatactccctccgtcccataatatagcaatcaagtaatacgatagataccacctagtactatgaatttggatagacatcttgtccagatttgtaatataggtggtgtctaatcgtagtatcaagttgctatattttgggatggagagagaatcatattaaccgttactaaaactatgagccagaggataatagtggctacttgttgtattgcaactgcgagcttacactaattcagaggctggaccgctctgcgctaagttactaacagtctaagataggtatatccaatattcaagtctacatgaacatgacggtatacttcaaaccaaatcaaccatattatccaaatagaataaattagtacatttctagtgttgcgttttttggtgtaacagtatccaacaatcaacattgtaaactagctgaagtgacagtagcaaaggagattcaagttaaaaaaaaaacagagggacatttcgtgggagtagcagcactaatccagaattcctgaactgtaagaatcctacccacagaatgactcgaaacaaacaagaaaccacaatataccaatcatatatccgattgcggcgcacgaacactaacacgtcaaattcctcatcgtatcccacgaaatttttttgagctaaacatttccaggacgattgcggaaggaaagcgacacgaggtgatgagcggagtaaagagaccgaccttctcaggcgtcacggattcgaacacgtagacctcgccctggaacagcagcgtcagctggttcgggctccccggcaacaacgccgagaccggctccggggccgccggatcctcggccggcggcagctcctcttcatcgccctcctcgtcgtcatcctcctcctcgtcctcttctgtgccgtcatccccgtcgtcgtcgtcgttgtcgccgccgcctgctgctgcgtcggcgggtgcgtcgcgcatcacggcgtcggcgtcctgggcggcggcggcggcggccgccgcgtcgggcatggccggcggtggcgaggtggggccgtggggggagggggactcaactcgactcaactgaaaccctagatgtggaaatggaaggcggtgatgcggcgctgcggctgtgcacttggtactgggtgtggccgagctcggggaacgtgctgtgtggtgatgcggagggacaggcagcaccgcagcagctgaggtcacttcacttgttttgttttttttttttaagtaaagtccatcatcggtccctaaacttgtaccgttgtgttatcccggtccctaaactcgcaaatcgatcgttcaggtcctcaaacttgttcgactgtgttatcccggtccctaaacttgcagatcactcgtttagattctccaacttgttcagttgtgtcaccctggtccttaaatttggatttgaatatcatctaggtcaaatagaacggtctaaagactttatatttaaatataactcataacttttttatgtaaactctaatgaagacaaactctatatcaaatttgtagccctcgatgcgacctacaactttgtagttgaatttttttattttaagtcatctttttgtcccaatatgtaattttaaaattaaaatttcaaaatctataaatattcaacaatattttgggaccctaaacagttttaattcaaaaacttttcaactacaaagttgtaggtcgtgtcgagggctacaattttgatataaagtttgtcttcattagagtttacatgaaaaagttatgaattattttttgatataaagtttttagaccgtcctgtttagggaccggggtgacacaaccgaacaagttggaggacctaaataagtgatctgcaagtttagggaccaggatgacgcagtcgaataagtttgagaacttgaacgatcgatttgcgagtttagggactgggatgacacagcggtaaagtttagggaccggtgatggactttactcttttttttttctcttgcctctgctctcattgaggaaagaaaacgaggtcacctctttttttcagttaaaaccatcgaaatatgtggttttgtagcatgtgttttttccattgtaaactggagtgctttgtaaaggcaattgaatatatgcttataagttataactttacggctttacgctatggtgaaatctatggattcatcttaggttgtgtttggccgagttagttagtggtgcaaaaatcaaaatggattattaacatataattagttaaatattaactactttaaatattttattatttagattttttaaataaatttctatattaaattggtttatccaaaatgtatcttctagcagtttgagaatcatgttatgtttataacaaaagagaaagtaaccgagtcctttgagaatcatgtttataataaaagagaaagtaaccgagtccataagctaataaaactcacccaacgtacatactagacattggtatgtttgtatttggagaggctaagcaggaaataggtgagattcacacaatgctcacacaaaatctctcataatccttaaaagaaaaggtatttttcaaagatggcacacgacaatactgaacaattcacgcatgtgtatatatactagcagattcctacgggatccggatcctctgcagtttgaattgctaatacaaagttgctactcaattgcctttacaaagcacttgagcagtcacaataaaaactaatagtttaaatcagtcatgtattgtagcatcaggattttatcttatagctagtactatcacattcatcctgtggatgttaatcataggtctagaattgtgctagatggtgcaggtttttcctgctgtaatttctatagcacctctgcattttgtattctaatactggggaccccaatccacatcctacgccatcattcattaatgggggtgtctatttcatttttgagaaaatccaaaaaataccattgacatgcgcacaatttcaagaaatgtcatcgacaagaacgagttttatgaaataccatcgtacaagcaactttgtcccaaaaacaccatcactgttaaggttccattaacaaccctccgtcatacaatctggaataggaatttgaactattcaaagagttggagattgtaagagtaattatacttgctagaagctccctaaagcgagacaaggttcgtgaagatgcatatacgttttacagtgctttgcaaattatcaaatttagtatcaaatattcccaaattttcatacccaacttaaagtaacctttccagttcaacctacatagcccataccatcacggagttgcatgaactcattttgcatcaatagaatcgtggtggtgtgttaccacacgaaacaacaagaagcaatttggtaacggtcgcaacaaaataggtttgccagcatctcgttaagccatgagcacaagttgatcagaaacctctagcaccgtatcatttttatgcgcgttcattacatcgctagcaccaataatgtaaccacatcaatgtaaattggcagagctatgtgagtagtgatctactttagcaactgatgatctatgcatcactgtgatcctctacagcaaaactcctagttggttttaacagacttccggatgatctcgtgctatacagcaaaactcctagtaatttttcacgtacgtggttgccctctacgtcaaaacctccgtattccaaactcacaggtcagcaatacccattgcacgccggcagaaagtcagcagctctttagcattttcaatggtgttttcggtcagtgaagcatcttctttgcccaaggaggacttgtccgcaatccatctctccgtgatactgcagatcgccttgagctgtttttaaaaaaatgtagcataggaaaagcaatgatatattaagtttagatgcatttatcatgggaatgaaaactaagatctatgtatctccatgaagggcatgatggtatcaggattgaattttcttataaaggatacagatgtgcgtagcccattcttcaaagaaacaccctcaactgaggaatcagcttctgtttgaatcccatgtctttcaatgtcatctttcatgagggtgaacttagccaagaagatagacacaaactgctcgagttttgaagagttcgtgatggtttctccttcttctacttgttgcagtaaacgtgtcaagatacaccaaaatgcatttcgagcttcattatcatcagagatcaatggaagaatgtcaaataggccctccagtaagggtaaatctgaaacaatgaatataacaccacactgtgacactgtatctaaatagtcatgttttcaactcgcaaacaatggctaagaattatgagatattgctcagcaaaatgtggcataccatgggacagaataggtgtgagatgttctccatcagacaaaacatttgctattatgattaccacagaagcacaatagccctcaacctgaagcatagtttgtgaatatataacatgatcagcatgctcatctggaacataattatatctaatctgcataaattttcaggtgctaaaatccaggtaagaactgaggctattgaggactcacaagtaatagcacttatcaacctaactacgatcccgaaatatattcaataagaaaaaaaaatattcttgaaatatatatttcatgcttttaatccagaatggcataccttaaaatttgtatcaattagtacagcagactaaaactatttagtaagcagggtcaactgcacacgacgttaaatgggacatgcaatcaaataaatgaactgttagtagcatcatgctcacctcaaatttatctggtaacttgactatattacttagtgctttaatcaattggtcatttgatgacattacttttgaacagttgtctatggcggacagttcttcaataagtcgaaggattgaatcaagagaatctgacctgaaatgtgttaaaaaaaagtcaaggtactaaaattccattcctgtgctagactattcactcaaagtttgaaaacccaaaaaaaagtgattagaaggaaatatgactatgccataattcctggttaatgcaaacagactaagcagaaggaacatgaaaactgtaaaatacaaagactaaattatcggtgaacatcaagtgcccgcatttcagatggcatttatggacctatccatgcattagatttatagcaagaggatatgttgtatgctttatgaactgtaaatagagtatagttcactagatttgacagtcatctgttcttatttcttagataattttacatgaactgtacacttttgcaattttgaagttagttcagacttcaattcacagaaatcatacctgtctagattgttcccatccattgatttttcaagctcatttaatagcaaaccaatagcacagtcaactaaacccacttttatcaagggctcgataagaatggtaatgacatcttgatcatcaacaagagctgatagaaactccagtatctgcacccaataatttacaaaggaaatagtcacaaattttgaacatgtacaggattcaaaagataatgccataagtcagttggccagatgatttcagccgtaccacaatttcaccatataactatattaaatatctaaatcaaatatattaagttatactaaatcaaatatctaagtgcacagctttttggatgaattccaaaatagttcataggccataaatggtcaaaactagtttgcaattatatcttcagtgtctgcagactcatggcctcatgggaaacatgagaaacaactgcaggtaagatcaaagttgccaataatgatgaaataaataagaactcctaacagaagggcaatcaagaagttgtttggatgtcctggacacattacaatggattaagaggtctggtcattacattgatagtggccatacatgtaacaatcaacagaaatgatttacataacgcccttctaacactgaatcataataagatcaactgaaaaagaacaaattatgcaaacacatctaactaactatcatttgtaaaagaataaaagtagcaattattacatagaatgtcaaatagataaatcatcctaaaatgttcaacatcaagctaaggtcaatacaagttatcaacctattaggatctagttgactggatagacaagtacttcaccttctgaagtaaggtagcatgcactgtgtttccaattatccacataatacgtgaaagaatctcatcaggtaagagagcttcagcccatgacatagatgcgttgctctgaaaaatggtgctcaataacctgtatacaaatagactgtgtgactatgactgcacaactagtaaacttcagaacagaactcgggttgtcatgatagtctatatacaaaaatagaaaaggaaaaaaaaagtagaaagataacatgaatgtgtatgaagaaaaggagatgcataataaggaatcataataaggagtacttacaagtgctaaaagaagttacattttacttttttttcttaagaacagctgtatattcaagcattttaatccacaatccactaaatagtgatgctgtatatgtgtaatgtatgactatctgtctgcatgtaacatatgttgtaagcataaattatagtaagatgcctgattcatttccacatgataaatgcttaatttcaggtgataaaagaacttgtattgctaaaaacatattgttacaggttcaataatttacaatttgctaaaggagtcaaagggacaatagcgtgcttattgtttttaatcttgtcagagcaaacaagaaagtgctatgtagatagtcttaattagcacaagccgtgcatcataggtaaatatgtagtggaaaccaccccgtaaaagtttccaaaaaatttcaagaaaaatgttacatatagtaaagatgatattagaaaaccacacacaattttaatatcaaacttcgttggtgagatttttttaaaaaacttttggaaacttttatgtggtggtttccaggtttccactacataattacgcgcacattcaccatattccatgaataccaacctgaatgtttcagtaaggcaaccagggtcatcaagaaataactgatccacgacagtagcaattaatccattatgagaagtgattgcattggccagagatttatgacaagctaagtttcctatgatcccaatacagatttcctgtggagaacaaaattcagagaagcaagacttattaaaatatttgctagcaaaaacgtggaggcagtagtagaaggatattccacttcacctttgctcgaagaaattgtctcacatgaaggtttgccaaaagtacttcaagtacaaggttgttaacctacaagaattaaagatccgcacagttagcgcttcccgcaagcagtcaatgcacttaaagacttacaatacaacagtacaaaaattcgatgatggtgcaagcagtagtttcagtgaatcttagaactcaattgatgattcaccttctattgcagtagcacaatcttttacaaatagtacatgcccgcagatcatgaaaagctttcttgtaaataatatattttaatagataagaatcgactcctagtagaagatactaatcttcctgttcaaatgttgattgatgctggcatgctattgggatagaggcatgccgaaaatttcacaatcataatcaataattatgcagaatatctcatcgtagaacttaaattcaatgcacagttatcaactatgacatgatatcaactatcaagtatagagataagtaccataagttctgcctgaggttcaataactgaaaggtcccacagtttgcaaccttcattgtcccacagatctttgtcatgaggctgttttggttccccaacatcagaactagcatccttttcttctgttcgtccctgcttcacactgtttacatggtatcagaggttagcagctgataacaaaatcagcatgaaaatctagcacacggctttcacttttagagaactctaactgaaaataaaatctctggaagtaaattgcaccttaactctttatccacatctggtccctgaggtaccagcttccttatgagagagatggtgaagctgggatcaactgttgacttatcatcaggtaactgcatataattacaagcaggagagaaaacatcaataaagcaatggaacaccgattgaaaatatccagaagtcatttctaataagtcaactgtcagctaaagcagaagctcgcaacacacagaaatctcactaaaaattatctagaaccatgcggaattgtggattaaaccttcacattcgcatggaacacttgattacgagaattttgagcatgcaaagatgatatataagttttcaactgtaaatggtacatacgctccgtgaaagcacttgaatgacattggggacacttagatgacagtaatgcccacgagttaaaggacagtaaggaagcacaccaagtgcttgacgaaatgcccacgagttaaatgacagtaacgaagcaccacccgccaccaggtgcttgacgaaatgcccacgagggcgagagtgtgaaagcaatgcagcgcaaaatgggttggagagacgggtaagagagacaaaggggatgaaccgcaagaactgagggggcaaacgcacgtacctccgattccgacgagggtgcgaaggggagatgcgtcggggcctcctcctcctcgtcgtcgtcgtcatcctcttcctgctcttcacatggtgatgacgcgttgccgccctcctgctccgcctcgccgccttcatgtgggtagtcagtggtggcggcggcggcggcggcggcggtgggcgaggcgatgagccgtggcgctggcgctggcgcttcgtcgtcgttcctcgcctcgccgcattccccgagcgcgccttctcccgaggaggagccaggggccagcggagtgcgggagccggtcgaggcgacgccctcgtcctccttccccgcttcgccgcccgccggcagcgcgccacctcccggcgagccgtcgggcgccaccggagcgtggtcggaggcagctgccgcgggcgagggcacggctccgccctccttccccgcctcgccgcccaccgcggcggcttttcctcccggggaggaggtggaggaggagccgggcgccatcggaggtggtttggtggtgggcgaggcgaaggcgagtgtgccggcgacggcgtcggcgacgcgggtttggggtttctttcctgcctcgtgagctgacgccggtgcggtccgttcaactccactcgcaagcaagaaatgctcgggcttgtaaccgggccgggccttctgatagatcacactgggtctaattaggcccatacaaatgtaacagttaattatgtatgtactacatctacatattacaaaacggtataccgttctaacgtaacagttaatgctaaaatgatagtagcatgatatcgtaagataccagatctagtatcggacatgtgtatcatgtcggtacaatttatgacatcaacatggtacctatagtatcgtgtatggtatatatgagcaatagtggagctagaaattttgtgaagcctggacaagtctaactacaacggtaaaaccattatccaattgtctattgtttatatgctcattttactaccaaatttagcattctaataaaatcacacctcaatatctcgcttagttgtttttttaaataagtagaaaacctagacaacggtatcccgttgaaacgggatacctttctatgagacggtacctgatacttgatgcatgctgtggtaccagctatatggtacccgatacctatgatatacctataatacctagaacctgatacatgtaatactcgtgtaagagaatagttagcatgtctatcccgttgtaacgggatgctattttgtagctgccctcttaaacaagacgattggtctac

SEQ ID NO: 20948 - DNA, 42319 bp, Oryza sativa
caaaatgcacatatagttgtgcagttgtggattaatcatattagttgtatcatgtgattcatggcgggacggattgagatttccatcaactctggaaccatacactatcctaataatcactagtttcgccattagggtggctatccaaaacctaacttattgtcagggcatgtttgtccttagatggtaacatgtgttatttacgagaatgctattggtttacaagcatattgttcaaaatagttttgcgcttcatgcttgatttctcatctgccatgtggtgctatggtaccatccaattggcatgccgaatttgctggcaaagtggagtggagtgctacttaatcttttgcgcagcttttagccttttactctgtttgtgctgtagacctatagccattttggtacttttcctggatcctgattcatttgctctagttgatgccctattttattctgtaggcatgtatgtgatggttcttgggtcatatagtggaaaggaatctcttcctcgggccaatcggccagtgattaaggttactcccctcattctttgtgtgtccctaccttctcggttttcacatgcatatttctttctatacagtatatttattttgttttttctgtccatatagttatttcaaagtttgaacatcgccaacatttgcagtttaaaccttgcttggtcaaatgatttaaaagaaaggaaaagagaactagactcctagatttagcttgtaaaataaatactaatccatcctagtgatctcactttctggagccttcaatctctagattctatagcgttaggagtaagaacgagttgaagagcaagatccgtgtctaatcacacgagcatattgataattagtgccaaattagagttaattaacctaaatttggtgatactgatgagaagaagacccttgattcatccgggatcatattacttcaacttcgtattactattacagaaacaaagtggttacatattgtatcattgtgcttgttatctgtccatatcagattgtaggagccatttatatatcaaaatcttatttgaagtgtaatttttccattatctattactctgtcagttctctataagcaaatgcaattatcatatctctttcgattgttagtttgctcaacttcgcgtatccaacagttctattttgttcccaacaccctgtgttcaatttgtaggcaattgccatcttcatgatgtattcattataattgaagagacaatttaataggtaaaggagtcttaatgcaaatctttggttcatgcctttctggttgctgtttgtgttcaagtgataaccgtagctgaaaagcttgaaaccatgaatacatgatttcttttagaaagctccattcggtttagttagtgatatgaaacataacctgacattctgaacacatttgttgaaagaacaagggattactaatactactatgtactgcatttggagctttattggttgattacattcgagataatttttctgaattttggccaacattagtctgcaaaagtgggtgttagatctggagatttgaagaactttctactcagctgtcaattttacataacattattcttgagccaacctaaatttgagggaaatgaccatagtagaaacaactagtaactttgacattgaccaatcagcatggtggtaacaacagttgcagggttgcagcagagtgacgggttactgacaagttgcaatctgtaatccccttgcaatggtcatctttgctgaaccatgtatttcctgattatgtgacaggcttgcaatagctactgaaatcatgtggaaggcttgttcttgcatgtattaagtatcaaccacgctctcttctattttggtgacatgaaaagacaaggataagatggtggctcatttttgttgttcatacttttaatctagtacacttttgcttgggttagatttaggcattggcaaaacatatctaggcagattactgtagttgtcactttcaattctcaaaaaagaactagaaactaagttctgttgttgggcttcagccttaagacgtacaagcacttaaacattacccactgcattagttttcctgaggactcttatcagcatcttgcttttaacgactttgaacttgattgttgcaggtgcataagctagtcgatctttccgcgcagcccgaccgtgaatcaatgtggtacatggaagtagttgaggccttcaacttcttttacttgcagttctcggctgctagcccactgatgaagcgctagtgtccctgacctcttgttctctccagtgctcagatgcttcgtttggctgtaggcctgtaggctgtagcccttcctaacacttgtccagtgcctatttttaacgggtagtttttgttagggctaatatgtactccttcgagcatctcacattgtggtcgttcatgtcgtggatgggtttatttgggagacgtaaacttttatcccaaagaaacttgtccagagtaatactaacctttcatgttggtaaaagagaatgaattctcagatgcactcagaaatcctttttgtgccattgataacatgaaagaaatctgcaaacttttttatggcgtatacctgaatagtaagtagggttcgctttagcatttgtctcacctggttgctttgtagccaacaaaattggcattgccaaattatttggcttacttgaatatcaaaatactacctccggccagttatattcatggttttagagaaaagtcctggcttattttctttgtaatttcagttcaaagggattttccagaaattaccgctcattgagttgaactactcggcatcgggagcattttcattttctttgtaatttggatatttggttgtcctaaatgtcaattaattatatccagagggagtataacttcttaaagttggtaagcagaccagacaaatcatagctatttttcgccaaaaatttgaggaggtgactagggatcggtcgtccgatccaaatctccaaaaatcgggcgctgacgtcagtgctacccatatgtgtaaaaccactttaaactaatttttttctcttctaaaattttttttctcttaaattatttatccaaatcatgatccgattgcaccattaaattcgttgtaattaaatattcaaaacaagaccacacatggatatatttcgacgaaatttttttagcttattattgactttttttaaaatgttgcacgatgttccaccagttatatcggaattgtttcactaagtagaacggaaatatttcaatcgttagaatcgggtgttgtttcaccttatataaaaacaatgtttcagcaaataacgaaaaaaaagtttcaattcactgcaacattagaaccgtacatagtgaaacattataagtacactaagtgaaacatttttttggtggaaaaaaaagaaacgaattccgagggtttccaaaatatatggatgatttgttgcaatggagtatttcaattcactgcaacattagatctatagatagtgaatcattatgagtgtagtagatgaaacattttcggtggaacaacaaataaaccaaattctcttaacaaagggtttttaaaatatgtgggtaatttgttgtaatagggttgtgtgtgtggacacgtggtggaccagggaagagcgcgcgtgcatggggtgggggggggtgcccgagttctgctcccccgcccgatcacccgatggcaatcattctcgaaaattttagcaaaaaccaatttttgtccttcccaaaaaaatccggcaaggctgaaaatagcatgaaccaaacaaacaagccgagacgggacggggctaaatatagcgaccctccgccgtcgctatacgacgtcgacgctacggagtactcaataactcaaacgacggtatagtagtagccagatcatatctaatccatgccggtggacactgccagtgggacccacatgggtcctctgatctccagtaccttcatattccgggctggagaagacgacgaaacagaggaacagctggcagcccaccccaccatgaatagaactgggccccaccagccagaagtaacggacaaacgtcatcccaccggagcatccgcccccgtccgatccgcgatcggacggcccagatcgcccccgcccgcgcgagcccgctcagccaccagctcatctactggatagcattttcccttgccgcttcttccttctcgcctcgccgtcgtcgccttcaacttcgaggcgagaagcgcgagatcccaaaaaaaaaaaaagaaaaaatagaaaaaaaaaacaagcgaggaacaggagaagcgccgcggcagctagctgccacgtggacctcgccgccggcgtcgccgccgccgccgcgcgtggatgcccccgcggagcccgcgcccatggcgtccgtttcgtcgtccccgtcgtactcgtcgcaggccgccgtcctcctcctcctccaccagccgccgcaccagcacgggcacggcggcgcgtgcctccggtaccgcggctcgcagtcgcaggggagggggaatgccgtagctacgtcgctggggctctccgcggcagggcggggcggagcggggggcctcctcctgctgccgccgctgcccgcgctgcgggcggcggaggggaaggatgggcgggccgtgaccaaggatgaggaggaggaggcggcggcggcggcggtggaggaggagggggaggtggaggtgaggagggaggaggacaagccaggggacgatgggtcaagggaggccgcagcgaggggatcggggtcggggcgattctccgccgactacatctcgctcggcatcagggagcccgtctacgaggtaaccgatcggcgatcgaacgccttgtaatggttaatggtaaattggagacagcaagggactcattcttatgatcatataagtcaaaatttaaattttagaacttaattttgaatttgattttttttcattgtagattattcgccgcatttgtttttttagtcactaaggatacgtatataaaagctttactcacaaatgattttttatttgctaataagcgattcggataaggttgcaaggtcgtgcatcagctaacttctgttcctagtcagaattatggattgcaatagctcatgttctcaaggtcttaagtccactcaacaagccaaatggaaatattgcaatatgatcattgtgagtgtccaaacgtaaataaacaatacattatatgccgttaatccaaacgtgtaactttggatggagggctaccagtaggcttcatgcataataaatctttctctaggttcagattttgctctctctttttttcaagtcatggggagttatgtccctcgttgagatcattttctttgcaaactcaaatggccgtgtgcatcctagatgcagaggctggggatgtaatcatctcccttatctaaaataaatctgcaattgtcatgctaatttgatgcatgtttctgtaagggtaggtttgctttggaatgaaatgcctgttacatattctgggacttctgcaaattgcaagatgcaaattaactttcccggatatcaaattttactcaggtgatagaagtaaaatctaatgggaggatgtctaccaaaaaaataagccggaggcagctattgaaatcaagtggtaggtagaaagaatatgtttctcaaggactgtaaaaaacatgattatgtagtctgtaccaaactctcatatagtgcttgataatttactggtaacagttttagaatttgaaaatgctgccatttcttgtggttttgttcattcttgtgaatgtcaagctcattgacagtatttatgttgatcaccgaccttttcttataggcctccgcctacgagataccagaagcgttgacccatcgctatggctaatgaattcaatgccatccttgctggtaataagatactttcaataattaatcatgtagactttactctgtatatgtttcccatcttttcctacaattttcagttacacaaacaatggaatgagtgatgctaataattgtgtatgtacaagagtctgaagatagtacaattgctctgttacaagtatctcaggttgcctgtcaaaattacctatgttattatagtcaatcacagagtcagagttcaattttttttattcaaagatagaagtaaagaaaaaggttttaattctgcaatattttccagctcacatttcgtttagctgtctttttcagtaacctgcattgtgattgtaatcttgacaaccactgttcattactatgaactgataacatacatagaatatttgtgtatagcttttcatgtaaacttccatatcaatatatttgaactctatgtttgcatggttactagattctagatttatgtagaagttaattttttgccttatcaacctgcttcacagttcaacatattgcttctatgtaccatttcatataggtccgtgaacaagccatattagtaaatcttggttccttgcgagcaattgctatgcatgaacgcgttcttatattcaattacaacaggtcagtttgtacactagtcattttaatataaattgtattttacttggtgaacatcactattgttatgaaacttatcaattattttatctgacttgagtagcccaggaggaaaggccttcttagattcattactgccacggttaaatccaagaaatatcaatggtggaccagcaatgccatttcaacttgaggtatcaggcatatggatattcttatattaatccatatttgtggtctggaacagtcttaatatgatgatattttccttgtcaattgtttcatttatatttgcctccatggaaggtttactttgttttcaactcacataggaataagattgtcatccatgagttttcctagtttctcttaacggtcgaatggaatcttgaacaagaataggattatcatctttgattttaaaagttctttttgattgtacaatatcttttttggtctcattagttattatattaaatcatttaacatatattgctgacaaaaaacatttttatcgccatcatgcatttgccaacatgtcatgctatgcttgcattttcacccgattattgagagtaccatcctcctgccaaatactgggccaagatgatctggttatttattgccttctcttatattcaggttgtcgaagctgccctgctttctagaatacaaaggttggagcgaaggctaatgcgtatcgagcctcgtgtgagtgccagaaaagtccctgctagctctacatcttgtacaagattgtatatcctgatgttgttagttctactttctggtgcatattcaatttatggagcaatctgatatattgtcaataggtgacttaagacacttacgaattcctgttcctgtcctctattttcttgatttcaaccttgaaaacttcattcaaagcacatatatacagaactgaaccaataataatgcatgttatttccatatcctgcaccctaactctttcctttggcatttagaagtccctgactgcagatttgcacgccttcctctatatttttatacatctttaccaaatggactaattgaagcacctgatcttcacacaagtcaactgcacaaatcataagctactgtcaatacctagctttttgctgagcacttactaagtttaacactagggagtaaggatcttcttgaagtcccttgtaaatcacagacaagacatagaccagtaccatgtgtccgtgccacatgatcactgcagaattccttcttttttaaaaaaaatgggaaacagtcggaaagagccctaccaagctgaccctgcattttcatgtggtattttaggtgttgtcgtattcttgtgtttgtgtttcagtcatgtatggatcaagaacatgccagtgttcaaattgactctatttataatggaaaaaataataatttgggtatctgggcttatatctcaggtgggtgctttgcttgaagttctaccaaatcggttgacagctgatgtgttggagcagcttcgtctaagcaaacaagcattggtattaaagctgcgctttagaatcatttcctggacttgtttgtcaagtttaattttgtctctattcatgtgtcaaggttgagctgggttcacgagcaggtgatctcaaacaaatgcttattgatctcctagatgatcctcatgaaatccgtcgaatatgcataatgggaagaaattgcacgctcgacaaattaagtgataacatggagtgctccgttcctttagagaagcagattgctgaaggtatggattgagagcatcattggactttttatattttggagacatattactgccttcatggatttttttttgtttccaagcatggcatgtgcggaattcacaaggagtgttgcaatcacttatttgtcagtagttaactgtttgattctgttttacttgtttcatctgtattttttttgttttaacagaagaagaggaagaaattgaaatgttgttggaaaattatcttcaaaggtattcatctgcaatacaatcttttcagatgtcttgtttctttcttgcagaccttcattgtgtattcttactgtcagatgtgaatcaatccatggtcaagcagagagacttcttgattctgcaagagaaatggaagattcaattgcggtcaacttaaggtctgtctactctcacagaccacatgatctcacaaagtttagcttcatcaatgcatgtgttcttataatttataacaatgctcacttttgtgatttttttgctcttgaatataattggacagtaaaaatatatgtgtaaatgtatgaattttaataaaaactatattttgaatttaataaacgatctaaggtgacaaccgaacataaattactagttcaaccagacaatcaaccattgttttctactcttctctctacatttatattccaaatcatgtgcatggtccataatttgtttaacaccctgaagtcactccaacttggactaaaatggtctttgatttgcaagccctgcatctaaacagacatcgcattttatttgctgcctctaaactgtttctagcagctactatttctttgtgaacccttcatccaagcgactgagtccaactgtacttatcataaagctaggctgcgtgcatctagaagatcatgtagcatggtagcttttcagcaaaaagaaagagaaacacgttctccaatatggaaatagaatttatatccatcagataactgtaaaatgatctttcacatatttgcagtacaaccaaactacaattagcatcactacaaatggacatttcagattcttaaattttatagctatattgtggcgactagcgagaaaataccaattaagagcaaacaatacactccaagtctccaacatagatgaaattaagaaagcaaatgcaagaattacttggaaatggaggacgcaccaattatgtaccggatacgtacatagtactagtctcaaaattttgcaaatgttcttttgtgggttggggccttgggggcatgacttcattatcctccatcctttactctctgtggtgtgcgggtgtccacaggccatggcggtgtgtactttgcaacataaaatgccagcattatgtttcaggtttcaattatcaaagcataaccagataaaagaaagggggactgcttgagtgcttcaaattgcattcccataattttatttttttagaactgatttaagatgaaattatgagagtgggtcttggtataaggtggtgtgttcctgcacctctgtttgtgtagcatacaatcacaataaactatttgagaattgtgggatcttgttctttttggcggatgtgaaatttatgtgaactagctcaacatcacaaacatttcataaattatgggttttcttaattcttaccacattgggcatccttacagctcccggagacttgaagtaagcagagttgagttgcttcttcaggttggaacattctgcgtcgccataggagcattaattgcaggtacaaaaatctgtcagcgcttttgtatctagtgattttcaaatttcagttcctttctatcactctttattcttgaagtaatgctataattgaaccgttgtatttgtttcctgtaggaatatttggcatgaaccttaaatcgtacctcgagacaaacgcggtatagcattgcactcttgagttcaattctgctttctgccacgtactggcactacttgatatagcatgagttgatgacgagtttattttggagcagtgggcattttgggcgacaactggtggaatagtagttggagcagtggctggatttttcatcatgtactcatacctaaagactagaaagatattgtaaaactctgtagcattcggtactcctaggaatgtaaataattcggttttgatctcattttgaaagctattgatggaggcacgtacagattcatatgagattgctttgatgctcccacgaatgctgtcgtgggcgtcggttctgaactttggaccaagcgttcgctgcacgcctgatgaagctagcagcctagcaccaagaccatagtatttcgcatctcttacataaagccgtggcggttttcatgactgcactgggtgagagtgctgaacagtgtaactctagattgatcaatgttactgattatctttgaaaatatttgcctggatccaactttgtcccgcgttgacatgcgcatggatttccccttgtgctttcacttttcatacaggctgcctgtgtcagttccacgtgtaattaagatttggctcatcgtgattgaaccttcctccgtcataaaataagttaatttttagagttgaaactttgtctcaagataagtttatttctactttcttacctaggttctccacaaatcacccctttttaatgtactagttttctattaataaggggttttggtcttttttcctcacacacactaaagtttcccgggatatcagtgattcactaatttcgggactgaataaggatataagaaggtgcctgtgatgttagaaatgcagtgtatttccactatgaagttttgcaagtgacatccctattgagtgttatcggagaagtgggaacaggggttcccctcggggcgttgtggctcatactaagacctacaagatctacatcttcaaagtgtcaagaagagtatgagactcaaaagatctatagtttcaaggtatcaataagagtatacagacctatgagatctacatcttcaaggtgtagaagtgagcatagatagacatagggacaattggaacgaagacttttgcctatctaatccacttgttagtctataggtgtgattgtcacatctggccaactagcttggagggatagcgacaaggctaaacatatcaagtttagtggagtgggcgccactcctacatgcatgcatcggcattgacgaccccccccccctcacgtataaaaggaggatccatgccaccgataaaagggctcgtacactcatctaatctaggttagccaaacattgggtgagaaaggatcttctcctcctcacttaggctgcgttcggtagaacattttcccaactccttctcctcgttttccgcgcgcacgtttttcaaactgctaaacggtgcgttttttataaaaagtttctataggaaagttgcttaaaaaaatcatattaatctatttttgaaaaaaaattagcaaatacttaattaatcacgtgctaatcgctgctccgttttccgtgccggggagtgagggttcccaacccttactcccgaacacagccgaacttttcacatcttacttataattatcttcatcatccatgtccaccatacaagagtagggtattacgtatatgtgcggttcgaacatgtatactcgctttgtgtccattccctttgcataatcaggacccaagctcaaaacttgctcccccagccaaactcacatagagggagtgcctagcttccccgctagaggagttccgtactccgacaagtgtattggtaggtgggtacatgtggtggtgtgtgcatttccatgtaattgaaaataacctaccatttatgtagagagagcaccagtggggtgatggtagagccataggttcatgattctatccatcattctttaaattctggtgttcacaaatattatacacatataagttggttttcaacaggaggattttagtaaggtaaggtgtgtgtgataatcgagagaaaaaaaacacctgccacatacataattaggtgtgaagaaaagaaataactcaacagatttacccgaggatgcaatgagaaaaaggaaacaatgtctctgattcttagaggtatagcgaatgcatcttgtgatctaacttcgtctatgataatgtgacatatgaaatttcaggtgtaaaacaccatctttacgggtaaattttacatgttcgataaataatagacattacttaaagtttgtagagacatcttagtaaaataatatacacatcttttacgtattaggtttaaaacattatcattgtggataaaacctacatgttccataaaatagtagacaacacttaaaatttgtactaacatcttcttaatacaacaatgggcacatcttttacaaattacaaaaagtattaataacaaatcgtataagtccattcttagcaaaaagtttcatttcacggttaccaatattgttatgtcgtcaaaagagttttgaatcgataaatgaaataaaaccttcagtgtacaatttcattttgtggctttttaggttagtcataacatttaataataatgcatgggattgaatgcagttggatgaaatggaatactcgagctcctcaatgccagtttcaaatagttttatagtcttagaaacagtgtacatccagttccatatatatgaaactcttttaatctctcttcataatgatattgccatgtcatcaaatttgtttgaatggcatctcatttattgagaaaaaactctataaaactaccactagaaattttttgttacattaaccaccattgaaattggcctaagagcaatttcaatagaagagtaagccgtcagctctaaaacctatcaaacacatagagtgctgctccaccaaacagatatcatgtacaacaaaagtctacaagcttgccatcacgcaattaccaaagtcttttttttaatgttatgcctataactgttatttttttcttcacactttgctaattttgtagactccataattatatgggacagtaaggaacaatccgttgttactattatcgcctcaacatggaagtgtagtaggcaactattaatcaccgattcacactctctcccccttatttctctgccaagtgccaactcagcatattagtctgcatgcatgtagtatgatcgattaaaacgatctgctgtacctgctaaacttgtgacattcaaaccgatcgcaaaatattttgatctcgcaaatattgatgtacgtacactagtaaaacaactacaaatccaactgtagtctgtagttatcccggtagatgtccccgtcccgtgtgcgaccaattcgccgttcgttgggaggcgcgcgcgccgctcgccttcgctaacgccgcgcgtcacgtagacacgtactactagccgaacggagccgcggaacgaaggggaagtcagtgagggcgaagcacacgtggcgctctccatctctaaccgccgccaatggcgtcgtccccgcggccggcggcgacggcggcggcgcaccgccgggggctgatccagcgcccgccctccgcgcaggcctacctctccgccgcggcggcgctcctcgtcctcgccgccgtcgccttctcccgcgccggccaccgcttcccgcacccgcccgccacccgccgctgccgccccgacgccgagggctcctggtccgccggcgtcttcctcggcgactccccgttctccctcgagcccatcgaacacgtaactgctccctagaacacgcgagagctcctgcttattaggtttcggtgtgcgatgcgtgggggggggggggtgccgatcgaacgacgccagatgacttggctgatctccgtgccttgcagtgggggatctcgaaggccgacggcgcggcgtggccggtggcgaacccggtggtgacgtgcgccgaagtggaggacgccgggttccccagcagcttcgtcgccaagcccttcctcttcctccaggttcttcgaaccagcttttcactgtgttcccatctcaattttgaagtatcccttcgcattggcaatctcggcaggaatgtcacgattcgattacttcagtgggcattaaatcattcaaatctctaactcacctgtctggagtatctgatatctgaggatgtaaatttattggttttcatgtcacttttatgtgtatttactgcgtcctcgctcacgatcatggtggtctgtatccagccctgatggatgtgcaactgaattgttttcagggggatgccatctacatgttttttgagacaaagaatcccattacgtcgcaaggcgacattgctgctgctgtgagcgaggacgccggagtgacatggcagcagctgggagtagtgttagatgaggaatggcatctttcgtacccatatgtgtttacctacaaaaacaaggtgaaatatttcactcacaggttggagaaaactgctattgcaatcattctcacatagtcacatatgcttttacttgactaactgcacaggtctatatgatgcctgaaagcagcaagaatggagatattcgtttgtatcgtgcattagattttccgctcaagtgggaattggaaaaggtccttttggagaagccattggtagattcggttatcataaatttccagggttcctattggctccttggaacagatttaagttcttatggtgcaaaacgaaatagagagatcagtatttggtacagtaattctccacttagtccttggattccacacaagcagaatctgattcataacacaggtaaaatgttaagcactagaaatgggggcaggccattcatttacaatggcaatctttatcgtgttggtaaaggccaagggggtggatctggccatggtatccaagtgttcaaagttgaaatcctgaagtcaaatgaatacaaagaagttgaagtcccatttgtgatcaacaagcaactcaagggccggaatgcatggaatggggcacgctcacatcaccttgatgtccagcagcttccatcaggtaaaccttggattggtgtaatggatggtgacagagtaccttcaggtgactcagttcaccgtctgaccataggttacatgatttatggagttgttcttatactagttcttgtcactggtgggcttattggtacaattaactgttccttaccactcagatggtctctcccgcatactgagaaaaggagtgggctcttcaatgtagagcagaggttctttctataccataagctaagctctctgatctccaatttgaacaaactgggatctcttatttgtggaaggattaactacagaacctgtaaagggcgagtttatgtagttgtagtaatgttaattttagtggttctaacttgtgttggaactcactacatctatgggggcaacggtgcagaagaaccgtatccaatcaagggcaagtactcacagttcacattgttgactatgacctacgatgcccggctttggaatctgaagatgtttgtggagcattattccaattgtgcatcggtgagggatattgtagtggtctggaacaaagggcagcccccagctcaaggtgaattgaagtcagtcgttcctgttaggatcagagttgaggataggaactctctgaacaacagattcaacatagacagtgaaattaagacaaaagctgttatggagcttgatgatgatattatgatgacatgcgatgacttagagcgtgggttcaaggtgtggagggagcaccctgacaggatcattgggtactatccacgcctttctgaaggcagcccactggaataccgcaatgagaggtatgctcggcaacaaggaggttataacatggtactcacaggcgcagcatttatggaccatggtttggccttcaagaaatattggagcaaggaagctgaggtaggaagacagattgtagacagtttcttcaattgtgaggatatccttctaaatttcttgtttgcaaatgcaagcttgacaagcacagtggagtatgtaaagccagcttgggcaattgatatgtccaagttctcaggagttgccatcagccgaaacacacaagcacactatcatgttaggagcaaatgcctggctaaattttcagaaatatatggaaatttaactgctaagaggttctttaacagccgaggtgatggctgggatgtatagtgacacatattagtggatagctttattcctgagactcaaatagactgattagccaagtatataaggtggggaagcagggggaggactagtgcaggaggaattatgtaattaagttattcagcaatgtatcctgttgtggttctactccctccgttccataatataagggattttgagtttttgcttgaactgtttgaccactcgtcttattcaaaaaaatttggaattattatttatttttttgtgacttactttactatccaaagtactttaagcacaacttttcgttttttatatttgcacaaatttttgaataagactatccaaagtactttaagcacaactttttcgttttttatatttgcacaaatttttgaataagacgagtggtcaaacaatacaaacaaaaactcaaaatcccttatattatgggacggagggagtattagtttagcgtgcccctgctgtaggttttccatagatggtttttggtgttcctgcgcttccacttatatttcataattttaattccttttgaattctagttgcctcacatgtgcaatctgtaattattgcaactgtacatgcaattgcaatcgtgccccaggagccaggataaatagttcaatctccctcagattaacagaggtgaacttccttcctcccttttttctttttgtgcaaaattgtatattacatgaagaaagcaattatgaatcacaaaagaaggaattttatttgtacacttatcagatttcattaaatgagatattggtatgtacttcatatttgcatgttctgcactgtgatcacaaattcacaatcaggtatcgatcaatctgctttttctcctcttcctgtttagtaaataagaccaaggaaactaaatctgcatttcctccatttctccccaatgcagttctagcaaattgtggtacaatcttgaattttagtcatgtcattgctacgagaagtaatgcaccgcttgaatcaaaacttgaaattcttcttcaggtaaatcaccacctcttgctgaaacaagtacagtatgagggttaatgctatatttctctttttgataatctcatttactttaaggaagctgggaggggaaatatacttacaatcaagcaaagaattatgcagcctgcagctccaggaaaaagggcataccagagttgcaagtggtgaaactttggaccatcaataaacaagagaggcaagcttgcagctgcaatcatcatggaaatggtgagctttgctatgatgcatttaagtagagtacaaaaacagatgtcaatcagaaatatttttttaaatcctgctgagcacatctaaagcaccacatccctgttgaaagaaagattatatacctggagggtgtgaggcgcctgtaattgtcatgaatgctatggatgcagaaagagcagcacctcttgccaaccatccaggcccaaataaggaaagggctaacacaccaaatgccgcacaaccaatctgggcaacaaacatgttgtatttctgcaagattttgtcacctgctagtattagtattgatttcacgtatgatctaagaatgtttttagatttgttgtaggactccaactggaatgtgttcatccaatctcaaaaaattaacccaaatggaaacacctaatgatttttactacaccgaaaaatcgtacataactacttttgtggttcagtcatgactacagaaaggaaaacagaggtatggttccaagccttcaactgagttctatgagccatagtttttcagtcgacgacaacatggacaccctgaaatttagaagcattatattgctactacatgctgcagattttttagtagatcttttttctaatttgagaaactagtttgcaaatcaacataatctgggtgtccattagattcagtcagtacagtaagtggcagcgattaattcatctgtgcatcttagggtttccgacttgcccaaaaatcttagaaaaggataatagaacatttgtttcccataaaaaaaataaaaggtagcattatgcatagaaaatttttcttgtagtattgaagagtcactgtcgatgttgtaactaaaatatttaactgttaagctattcataccttggcagcaggtgagcctggagcggtgaaaagcacatcgcagactgctccgagaggggcaattgtcaatgatactcccttgtacgccatcatctgatccatccttcccagcacggccattgctaggaatgcacctgcacgttatcattatttgaggaaaaatatgtcaggtgagccttcttttctataaaatttattggcaaaaccatcaaactctcgacggcttttgtggttttgccactactatatgcaagaaatagtctttttttttctctgcacaaccattcaacaaaaatatatcacagagaggaaaccaagccctcgctgaattcacttggcgaaaaagcacggagattcagagacccagccaacgaaggccgacgaagaagacaagtttcaagtttcagactcaccggcggagggccaaagaacatcgctgacgctgatgccgccaggcgacgacgacgacgacgccggcgtgacaccggcggcggcgctcacttccgcgacaacgacgccgctcaggtccctcctcctcctcctcctacttaagccgatcctctgagaagaaaggaagctgctaccctgcttcttgctgccattgacatgcaggaggacgggtagacatggcatattggagtgggacgccgctgctagacattgctgcacccttgctcgtgccaagacgttgctgcagccaatgccgagcatccccggtcgttgctgcaatgccattctctctctctctctctctccccttctctctccccaagaagcacagtatgggtatttaaatgggcaggataaagcggcgaagaggagatagggtcaagagagagagagagagagatggatggcctcttgggtggacgtgaggggaagagaaggcggcttagctcttcagcgccgtggagagtcgcagatgttgatgcctggaataagaacaagtatatagtaaacaaatactactgtactgacaagtgcatatgcttcccatgttttcttccgtttttgatccaggtcatatgctggttggatcacaggggagaggcatggatccgttgctgctccttggcagcttcttgctcatcgctatctggccacagcagatggtaccagttgctttcacatgctgttcatgtggtcagtggtgacaggttacacgggcggcatgaatccaagcgaaatctgattatattttggtgtgaagatcatcattggccgcaatgctggcaagtgctagagatggtctatttaccacaggttctgacaacatccccaaccggtaagaaagaaaagaatctgagcattttatagccttattaacttggctagttaaatttcaatatttgatattgattgttcttgtctcctcacaaattatgggtttgtatattccttgtactgcacgagtatctgctccttccatcttaaattttgcatatgttaatcacaagcaccaaagaagcccccaagaaggccctccgttcgttgacgctgctggtcgtctgggagagatttggaatgaaagaaaccgtagaaccttccagcaaaaggagctcttgtcgaatagcttgctgacgaaaatcaaagaggaggccagagcatggatcttagcaggagcaaaacatctgggaaattggcttataacttagtttgttaggaccaaagctttggtcctgttttttcttttatactgtgcagtttactccttccttgtttagcggctcgccgattcgttaaaaaaattgcatatgtttgcattggatcagttccaaacttacctcttttgcacctaacttgactctgattcccccaccatgagagccgatctaggggctagttcggcctcacttgtcggagactgaactaccgctcgcttacttgctgatcaagggcgtcatttccacttattctaatctttgaaggaagaagattgaaaaactaacaaacaaattgtcttcagccctacttagaatttattttctgttgttccaactgtaagtctccaatagatatttcgttacagcaccttacattagaagatggttacaacttctgaccaccaacaaactggggtctgacatgcgcaatttgcttaatttgttgaaattattttgcatgtgcaatgccgggtgcccatagcctggctgtcgagtgtcgacattgtaatccagcctcctaggaaagaaaaataaggacagaatccagcagaggactacaggaggcggctcttgggactgatcaaagaggcaaccactgagctaaccaataaacaactatcgaaggatgggctagtagcctttttattatgctcatggtggtgcaaatttaggtaccgaaagaagttcatgcctgtcaaaattgttccgtattcaaatagttgactaaaactaagatacgagttgaaacatctagttaaagtcctatctaccattgttattggccattcttttatttttttaaaaaaaaggatctccagagatgtaatatgagatgaatcttcatctaatctaagaataatgtgattacatggtttgtgctaccctgatggtctgacccgatccaacgtgagtacgtgaacaataatgtttttgttcttttaagaatgacaacaggttaacatgcaaactcgaatctcatcagtctttaccatgtttttttcccagaatgtactagggcacaataacatacgagtatccgaatcagattcctaacttctttagtacaccggagatcagccgaattatggtagtgaagaataaaaacaatataatcgtcccatcaatgaggatctgggaacgtacagctgattgacttttttttttaactgcgtaaagttgaacacatgtgatcgaaacaaagaaaataagtttagggtacagtttttatacttctatttatatacttttttttttcgaaaagaatacttctttattgttatcagttagtacaaaacaacaagctgaacatgtcgaaaggttttgaaagcaaccaacaagcctagtgtaacttttttctctccattttcacatgtaaatccattaaattttatgaaaatgaccttgctaaaatatgaagtctaaagtaagatacagagcaaaatgggagtgttcgcggaataagcgaaacgacatatatccaaacgaaaagtaatttgtgaataaaacttttatatgcatgttcttaacgatctaaaagcaaatgctgaaaaataaacttcgatgaaaaaaaccttaaaatcagctccaaatttaaggttaaaaactccaaaatcccttaacccccaaagatgaccttaatcacacccccaccccccctccccgggtgccgacagccagcccacatgcagctagctatgctagcggcatggaaaaagtccacttagactcccttaattgttcaccgaatctagttcgtgactcttaactagaaaatcaggtaggatgactcccccaattactagaaccagtacaaatcgactcctccagcggttttcgagggcggttttgttgacatggcggcattgacccagtcttcgtcccacgtggcgcttgtgtggcattagaattaaaaaatatctatgggacccatctgtcaatcacacacaaaatatattgtgggatccacatgtcatcctttctccttcccttcttcctcctccctctctctcccttcttcctcttttctctccccctttggatgcacctcgggagcgggagtcggatcagcggcgatggcgagcgggggctggagtggcgacagcggcgacacagatgcagatcggcctcccctccagtcatcaccgccgccgctgctcatcttcgtgtaggggagaggggagaggaggcggcggaggacgtggcgacgggatagaggataccgtgggcggcggtaacatgagagcggctgtaagttcaagtgccttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggggagcttattctatattttgtttattataagatttctatcttgatttgaaatcagttttcatctcatctctctatattgtttatatcgggttattatccatcaccaaagagagaaaagattgaaagatcttggattaaataatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaatgatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagataggcaccgtactatcaagaggggtctatgaagcgagcttgtggatgatcttgtgccatattagttcatatgcatgtaggtgcattttgtgggcttgtctaaccaagtgtgatgagttttctcaagtcctaaaccaagagagaagtgggcatgtccaataggagtgagtaacatcttgtgggtatgtccggtgaatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtcggttgagctgaaaagttacctgcggtctgaccgtgggccttaggacggtctgaccgggtctgttagccagtctgaccggcgtggtaaggccggtctgaccggccccactggtctgttgcactggtctggtttttggtagtgatacagagccgccagagccgcaaccggtcagaccgagccgacggcggtctgaccgagccgtggacggtctgaccggccactacactgcggtcagaccggccaggttgactgggctcaatgattgccctgtaacggctagttttctagccgttacggctagttttctagccgttacaaagtagtccggtctgaccggcctcacaacggcggtctgaccggcagagcacaaagttggggatttcggttccaacggctagttttggtggttgggggtatatatacccactccccagcagcaagggtaaggttttggcattccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggtttccgcctcctagacggctcgtggaggtgttgcccagtgacctctccgaggagattgtggaggaggcccagcaccgtttgtgagtggtttagagttcaccaccttcggagtgaaagaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggagagtttccgaacctcggtgaaaaattccttgtctcttgtctcatttatttgttgcatttacatttgtgctattttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcaccccccctctagtcggcctccttgatcctacagcggccggtgaagggcgggggtgggcggtgccggcatcggggatacggcggcgaggaaggcacgaggaagcggctggggggaggtggcggcggtcggcgcaggcggggagagagagggggcggatggggctaaggtcgtcggggtaggcggcgcggacatcctaaagtggagaggccaggtcattcctctcgagcgacggtggagagagggggccaccgccgttgtcgccaccaccaccgccgccgtcgccacaactccgcccggccttcgcgccagtcttctccatcgccgccgccatcaccggatatggacgagaaggggaggggggacggccgcagtccaccgctgccaacacgcatgcggcccccagcgccacccaagccgtcgccccatctggatctgacttagctcacgatggtccactgtcagctacttatctatttccctccatcctcagctaagttcacagtgctgaccacggtcaaggtgccacgtcatcgaataccgcccacaatactaccataggagtcgatttgtaccggttctagtaattgggggaatcgtcctacccggttttctagttaagggtcacgaattagattcggtgaacaattaagggagtcaaagtggactttttcctagcggcgccgtcgacaggctgacatgttccatgggatgggccgccgactcacccaaccgcgcgcatccccgcggcccaaaccaaccaactgcctactcgcgcgctggagctcacacaccgcccccgcggccgcgcgcgtccgtccctcttcccttccccttatccgctccgctccacagcctcgccccgattcccccctcgtgatttcccccttccgctcgctcgcgccgctccctaccggccaccaccgcgcgcgggacaagcaacctagctgctccggctgccaagccatcgccatggctccgtgccccgccgcgaccacgtacgtccgctgcacccagcactcctcctcctctctgacatttatcaccttatcaccttttgcttctctccctctctcgatcgtcagaactcgcattggggcgccgccgttcgccgcgacgacggctcgccgacccgcccggggcgcgacgacgacgacgaaggcgcgggcgtccgggctgcggcaggtggagggccccgtgtcggagagggcgtactcgtcctcctcgcccgctcccacccacaaggtcaccgtccacgaccgccagagaggtgtcgtccacgagttcgtcgtcccacaggttaatcaatacacacacaccttcgatgccgtctcaagcagcagtagcgcaattctccttcttgtgctttgtctgattcgtgccgtggttggggggcgcaggaccagtacattctgcacaccgcggaggcgcaggacatcacgctgcccttcgcgtgccgccatggtaggctcccatcctcgtgcctttcccaggacacattttttcttctgattggctacactttgccctcactactcactcgctcactcaagcttattagggcagtcccaaccctccacctagtatggtgtctatgacattaactacattgccatgtaggacttttagcttatgcggcactatattaattaagagagagattgaagagaggaagaaactgggtctcatgcaagacacagcttcaacacgagaacctatgcactagacactatcaagttttacattgggagagaatagtgtcttcataatagatgaagattaaatatgattggtagagaagagagatgatgtatttattaatggcccactttaaaaaaccatgggttgtagagtgtagttttgattgtgatgtcttattaacatggcaccatagacactgcttatggatattatgagttgggactgccctaagagtcaagttaatctgtgctggactttaaggcttagtcgttgcttagacaaatccatcatactctgctagattttagttgcacaaaaaggaagcatttttttacttgtttgtcaaatgttattcgtattgtattatgtatgcttaatcacggcaaaggaacacattaagcaagaaaaacgtgtgccgtaccatgttgatcaattgacacaagcggttgcttacttttggactcagccagtgtagtctctggctagcgtatcatttctcccttttcttctgatctacaatatagataagcaaatgaattactttagggaatgtgcaaatggattgctcactttgtattaagatggagaaagaaaagttacatcatcagcaattcggcatgcaaaaccagcagattgaccaaaacaaaaaaccaaatacaaccaggcgactatacttctgaattactgaagacacatttttctaatcaggttgctgtactagctgtgcggttcggataaagtcaggacaaataagacaacctgaagcacttggaatatctgctgaactaaaagataaggtgcatccatctttttatgctttgttgtcactattaattaagtatatcatgtttttactgtttctgctacagtttgcttgccacttgatccgcctcattcctcaatttactcagtggtttcaacagtgtctatgttctatccattagtaacacacgatcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagacatagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcaggttacaccgttgtccaattctgcgtggaaccaacctgagaatgctcaattctctgaaactggagtagccgagatgaattcagacaaatcctctgcccaattaggccggaaatcagccaacttgttattcttcaccgaattagtcccacgaatgaattcggcacacctcttcccatcaactaaatcagactgcttaattcatgtcagcaaatacggtccacaaatgaatttcccaaaccaaaatagcaaatacccacagaagtctacgattggatccactagtgaatttggcccaacacatccatcaacgagttcaacccaccctcaacgaattcagcacaccaacaaatttggtcccagttaactccatcagtgaaattggcccacgaaattcccgcaaacaaattcggcccgctaaaagatttggtccatctgctacccattagcgaattcagcccaagcataaattcggccgtcttattctcgacatcgtattcagcccatgagtagatttggcctcatagattctcgtctacaaattgagcccaagagtaaattaggccgactaaattctgtcaactaatttggcccaaaaataaatttggtccatctattttccgtaaactaattcggcccatgagtagatttggtctcatgggttcccgtcaacaaattgagcccgagagaaaatttgaccctctaaattccgtcaaccaactgggaaatttgggctactaatttcatttcaacgaattcgggccatgagtaaatttggcccactaattcccaataacgaaatttggcctactaattcccaataacgaattcagcccaccacggaatttgcaccactttattcttctaaaaaattttggcccgctactaaatttggcctgctaatttgtcatcaatgaattcggcccgtcaataaatttggccgactcaattcttgtcaacgaattaggccctcaatcgtattggaacgacgtaactcccacgaacaatttcggcccatcactaaatttggcccacttaattatcgttagcaaatgatttcggccacctaaatccagtcaacgaaatcgggccacaggtacatttggcccattaattttcccaaacagtttaggcccaataacgaattctttccgctaattaatttggcccaccgccgagtagataaggcgcgtattgcgatttgcgagggaagagacacgcgcctcgccgccgcccgccgcgatgctactggcgcgcgctccgccgccgccggcgatgccctcggcggtcagctcgccgccgcaacgggagagcatactccgcccatactgcgttccctggacccgcggctccgttgcgacggccgccgtggcgaaggctgctcctttccggggcgagcaaaaccacaagcaggtagcgagcgtggcgaaccccctggtgaagcactgcgttaggctcaggctctcctccgcgtaccgccgctcctgccgccgcattctcctcgtcggactcatccccatcctgtaaacttttctctattctaagctgcgaaattcccttattttgttttattctgagatgaatttttttcctaattctgcactcgtacgccttggtgcagggagatgtgtagcttcgaattctccaccatcgaaaccttgcttctcttggacggcatagagctaccggaggaattgtacgggttctctggcaatgtcgtgtatgtcagcgccgctgtgatgaagaaagtttctgggatgcaatcagttgattcaactgaggcaatcgctatcattcacatgcctaagtatttccgcgaccttgacagcgaccagggtggagctgttcttgatgagtggctcggctctgcaaagaggattttggttctggatgggattcaggtaaaaagaagtgtgcaatattccgttattatccatagtaaatggatgtcattttgtgcataagacggcacataatatgttgtttattgtttattttaagtttgaactagtccatttgattcctcttaagcaagggttctaaatttttactgtgtccataatggttctatcctgcaggaccctggtaaccttggaacattgataagatccgcttgtgctttcagatgggtatgtcatttactactaattgttgaagcgtctctgattgcatttctcaaaacttgatgtttcatggtctcatggatcacaccatcctattgtttcatataaagtagttatcacagcttgttttacttctcaataataaggtagaacttaagtgataaaaaagctaatactactggtagtatgtagaattattaggtttgcacttgtttttacatctaaggatgatagtgtaatgctattaatgacattttgaaagcaaaaggttagtacattctgggttagaaggctagaaaccccatacgtgttctacatttccacaaaaaattatgctcctattatacagcatcagatgaagtttagttagcagttagcacatgccaatatgccatcacacaaaaatatctgcatggtgtgtagcctaccagaaatttatactaactcttcaagtgctttcagtagtgttgttcggttagtctttaccaatttctatgcttctaacagcatttaaaaccaactaccaacaggatggggtatttcttcttccagcttgctgtgatcctttcaatgaaaaagctcttcgtgcagctcgtggagcctcattgcagcttccagttgtttctggtaactggtctgatctgcatgctttgatggctaaatctgatatgaagatgctggcaggtcatccagaaagcagcagtaatggatctgaaagaacacatgttctatctaaagaactagcggattcactgatgagtgaatcagtgtgcttagtgttaggaagtgagggcaatggcctttcggcagatacccttcaagcctgtgagcttgtaaacattcctatgcaaggtacatttgaatctcttaatgtttcagttgcaggtggtatcttcttatttatgttacaaactaaacagcaaaaaatggcagaacgttaactgtttaagtcatccttgattttttaataattttattgttcttgtccaatctgttacatttggttcttctttctgacatcattgctgatagcttgatatcaatccaaagtgaaggaacaaactgttaagaggaatgcaagatcttggttgacaaacaaaacaaaatgagaacattttattatataccctccctttaaattgaaatgaattgtttaccctcctgcgccgctgacatgtgggatcatctaagatcgctgacatgtggaccaggagggtaaatcctcaacttcaatctaaatggagggtatatgatcaaactttacctgttttgtcacaaggatcattggatggcactatatgaaacctagtaaatgatgatggaatgaactgccgaaagaattttaaaatgaactcattgttcagataaccaacacaactttgtgtaattcttgtagtatgtatttgtacaactgaagatcgctatgcaatttatgaaagggatccaccataatcactgcagccttgcctttggcccttgaatatagtagcttcaatcaaacacggtggtcctttatcaatacgagccttttggaacaggccagatcagtagtcctggtccacaagcttatgtaagttatctgtgaaattttgttgattgttacaggaatccttctatcagcccaagcatttactatgtagaattgaaatgttagagtacatttaacagtagtcagttgaatcattatgcaaattttgcggtaaaatgtccatttagacactggattagatcttccgtatctattgatataatcttccaaacttaaataatctaataggaagctttaagacttagtccagttgagatatgattcattgattgagtccaactttatgttctttcttgagctggaccgtccaaatgctataaatgactagcagctttcagtattgcttctcgctgctgtgggctgtggaatactcaaactgtaatctaattaatgatacataagatcagcagaaactcctggctttgtcagcaccgtaatgacaccttccacatatttattatgggatcttacatgtgatccaccattgctgactgaaaaaggtatcgtccttaatcgagacatcttgcacactggattttgcagcactacaacttatttcagccccaattagttggtttccagaggaaggtatgtcttttcaggtgaaagcttctttgtttagcctgtgagagcatcctgagtcatatctcatatgcatacttagttctttgattattgtactatacatgtcatctctgggaatgcacgtctgtcattcactgaaacggtggtgctccagtttccctgtttctcttgtagtgatacttacctgtactcctgtctatagctgatatgtggattcctctgacgacatacatgctggtgtaaaactgctcatcttaccgtgaattttgtattttctggaaaagtatcattggctccccaaacaatttttcgattgttgatggctaagttttcttaacccttggtaggtagtttatttcttctgcaatgcagtgccctatacattatggactgttagtgttcacttttcctgtactctgcaactgggacaaatatcatatcttctgtaggcaaagaggcattacattatgtataagttgtatgctgagaaaccaaccactaggtgcaaaatcaaacctgatggttctacatgagccagcacttcaatattttggcacccaagtgctagtggctgatgacaaatttaagatagaatacctgtgtcaacctaaaggagacacaaagaggcatactgatggaaataaagttgaatttgattcaccgacgcattgtttggcactgtggattgtagaatattaatttgttgaaaaaagcaatgaaatgacctttgcatttagtatttaaagaggcagtgctggaaacgtagttttctactgttttattattctattcatttgtcttgtgtttaatagataataacttgttatgttaggctgtgttcgttttcttgtgttgggaacttattccttccgcacagaaactgagtgactcattagcacttgattaattaagtattgatttatttattttttaaaaaataggttaatatgattttttaaaacaactttcatatagaaattttttacaaaacacacattgtttagtagtttgaaaagcgtgtgtgtggaaaatgaggaaggtaagttgggaaagatgggggaagaacacagcttaggagctttgggaaccaattaagaacatgggctgagaccctcaccaaaggagatatctgtatgatgacaaatcacctctgagttttgctcttttgaaaagaagttctgatgatctaggggcatttatattaattatggatttgggagctggtcagacttaaaatgacaggcagtggatattttcctacatgaagtggtggaacaacatttgtcaacttctattttattatctgctattctttggtaagcgattctttcgtcattctgcgttatacattcagtgtttttcctgtgacagtgattggttgatagctatactcatttcaaatgatgattgttttgggattactcacaaaacgaaacatcaccagctcattttagaactgaatgtggacagttttcaatcccagtagtcttctgctggccaattctctgccttgtactgtagcatgctctaaattactctacctgcaactattacaaccttgtgcccactgtattcttgttatataattgctaatttcacgcaatttgtgcatgtgtactttaatactggatctgtgctaactgctaagcatcactgaagtgatcatgtgcttctagcttggttttcacatgtctagttcagaagtgcaatcataaaccagttcgactaagtcctcaaaaaggagaaaaccagttctcgtaccagttcagaagaagaaaccagttctggactaatcatgttattaagatacatacagatagaatatttattgcatgttgggcatgctgttgtgtactcatctcactgtactcaacctcagtgcatacccaatcaaaagctatgatacctagatgtttcctttcatcatctatgtgtttagctcactaatcaacattatcgctttgtcagcatgccaatacaggcaagttgatttagtagtgtggccagcacatttcccaaacaatgttctctgttatgataaaggtcttaagacccatagatatatgcttttgttgaattgttgggtatgaatcatcaagagctggtgccatttggcatcaactcatttttttttgcagtttgttagaaagggattggtgtggttgtgtactgacaaatctatggtattcaataagaaattagcatagggtgatagggaggtcactgattggtgcatcatttgcttaattaagtactgccaggttggtgtgttagcctatctggagagagagagagagagagatcatgcaaatcaaagctttttggtagctcatgtcagtttgatacgtgtgcatgcatctgaatgtagatcggtatccttccatttgtctcttcctttgcagatttggggattatttgtgtcctcttttttttttgtcagaagagttcagggcattgccatgtggctggtatatatattcctgctttatcatttgctgaagtccccagaagccacaatacgttaaactctttatatatcagggaggaaagaagtagattaatttgtcggtgttgttaatacatttccctctagtttttcagctgtaaactcctgtgcctagaaaaaaaataaaaagggggtactatcacgtcattatgttaattcggtatacaactattttacttctgatcccacagatgtaactgtatcttgtatataattgttaattatgtttctccaaatacaattttctgttctatgcacagctatatcgatcaatcctcgctattaaaatttggactcatcatgatctactggtttacaaagttctctgtcttctattaatattgtaatttctaggcctttggaatgagtacagtggtttttttcaagtttgttttgataatataatagattgatgtcatcgacataaactttcgcataatagaacttggaatcgtgttactatttttctagagttattttttcaccgtagttttctgtagctagccatgggaatggtgcctacctcgactggcagggagctgttaggagcagacgagcagtgcaccagcctgagtttgaatccctttcagtgcatgttgttggtaacttttttggttacgccgtcaatcatgatgaaaacacctaatgttttgcggtgctacaaagtcgtcaaccatctcgatctagataaatctaaaccaaggtggtttatgtaattcaaaactgactagttgaagctggcttagatgaaatagggataaacatttgtctcgtgggtggaacggaaggtttttgggacagacctacaaagagattcgcacacccacatcgaggatggacggctttcagtgcaaaccgacaaagatggatgaaaactagaaagaaaaaaagtgattggctaattgtattgaaaagagattatgtgttcagttgaaccggccatagcctttataaagagactggtcttgtctcctacagaatcttctccacgtcttactcaaggtagataccaataaaaactcaaaaacctcaacccaagcaaggaagcctgagacccgacgaaattcgactcgaagtcggacttagacggtttgaccgtccatttgtcgccaatcagatcgatcagccacacaccggcgatcatactagccctatgtaggaaatcccgatcttattcaaatttgatcatattttcttatttcatgtctagatgtcaaatttggatgttaacacatgttttctcactactttatcagcaatggatgctaagatcctctttagtaacctaacacatttttttgtttttttttaaaaaaagttagccatgagtccatgacatcctaggacaagagtaaaaaaaaaatcaaaacagataaatcaaacttaaaagaacacccaaaattcataagatcgtcgatgtgctgcccaagttgccgtccacggcgacgtgacaagactacaagagaagggaaccaaaaggtggcaatggcaaaatccttggttctgctcgactgctcctactcatcagtcaccgaggcgaaaggcatggctgttcttgctccaaacccgtaggccatccactgcccattcgtctgcgctcacaagttgcagttaatgctaaacaccaaaggatgcatatacgcaagtatatattccctccgtactcataaataaagtcgtttaaaacaatatttaagtcgaaccttgaaaatatatattataaataactctcgagttgttgagtttgtaaatataaaaattatatgaatagatttgtcttgaaatttttttataaaattatatgaatataacttttccataaatattttttatagaaacaagaagttaaagttatattttgaaaactgtgtcgctgtagtccaaaacgactttctttacgagtatggaggaagtatgctttacaagtaggagtaggtcagatgaatctgatacagtaactatgagtaggattccatcatagagtttgcatgcactggcgtataagacaataccaacacgatcatatgagccaaaaaaaaggaagtccaataattaatccaactatccaagtagtactcgtttagattctcttaaaaaatcagtcgagtattgttaaaaaagaaaataaaatcagtcgagtaattaattcaagtactcgtttgggttctcttgaaaaatctctagctcccttcaaaggttggtgctgccgcttcgtcgtggcactttcctgctaacgaattcaaaaaagcgacaggggaaaaaacacttcatggctgtatttagttcacgctaaaattgaaagtttgtttgaaattgaaacgatgtgataaaaaagttggaagttcgtgtgtaggaaagttttgatgcgatgaaaaagttaaaagtttgaagaaatattttggaactaaacacggcgcaaattggataggaattgggaaaatcaaatcggtgcgttttttcaggtgaaaatgtcaagcagtcatgctgtgtcttgtgcatttcacggcacgatggtgaactcactcgagctattcaattgtgaaagctccaaatcttgtctcggtcatgtgagacatctccggcgacgacgatgggtaaattactctgtcggtttatttatcttttctttttttttaaaaaaaaagacatgtccagccacgtgactgaactatgggtaaattactctgtcggtttatttgtttatttcaaaaaatataaagatgaaatactaagaacatcgtgcccctactccattcccaatatagatttttggggatttcagtcggaaaaaaatacactaatagtttccctgctctctcacaaaaacgaaattcccttatctttcattctcactctccacaagttgaaaaccattctctcccaaatttcatcttttgagcgagactgcaactcaagagcaagcaggagaatgaccctgctagctaaatgggtggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgcatatatatatatatatatatatatatatatatatatatatatatatatatatatatatatatatatatatatatatatatatatatatatatatatacacacacactactatgctaccggtatttggtgattttcggtatgatgtattctaatttaaaaattttatgtatgatatattctttttttttagaaaaattcaggagtaaatttcactttgggtcattttttattactgatgttttgtttttaaccaccataaaaacaatgttttcactttgaatcggatacttttacctttgtggcactttgaaccatccttaattcttttatccatctatattaaacttataatatgctgaagaaatgatctcatatatagctgaggagttcattgacaagtagaaaactgacataatcgacataatcgagatcgttcagatgctctagaagtaggttgggtggtctaaaataaaacaaaaacaactttatccggtccaaagtaaaaacattggctaaatggtgatccaaagcgaaatattgataacaaaaggtggaccaaaatgaaatttactcatcaacttttgaccattgatttatcataaattatatttttaatagctataaatccaatatttttacacgttaatatatacttctaattgaactaccttgatcaaaacctataaagtcgattatttcgtatgagggcgtttataatttacaaatatgccatgtaatagggcctatttagatggtgaaatgaaaattttcgggtgtcacatcggacgtttgactggatgtcggaaggggttttcggacacgaatgaaaaaactaatttcataactcgcctggaaacgcgagacgaatcttttgaacctaatttagttgtcattagcacatataggttactatagcacttatagctattcatgaattaattagataaaaaaattcgtctcacgatttacatacaaagtgtgcgattaatttttctttgtatctatattttatactccatacatatgtcccaatattcaatgttatgtttttgcgaaaagtttttgggaactaaacagggccatagtgtttggcatgagaaaattatgaactcagagcccaagcaggagcaggaccgaaaacgcgtgactagtgcaaggtttgaaaatagtactccttaagagcgatactttcaaatctttatctggagaggctcaagtcttttttttattcattttttttagtttcatatttaaatgtcacgtggaacttatgaatcctaaacacaatgcctaactggcgtcacatcaccgatcacactccacccccattcaaagtttcaaacaaactccaccattttcgtatgaaattgggtgtgctcgcgcgcaacttgatccacacacgtacgcgttgcccatcgatctccaacagaattccgaattcaacaaactctaatcatcaccaaagcatggcccttgcccaatcccagctttcttccaaaaaaataaagaagaggtttccatggcttccaggcttagatcaccgaaattcaataaagtttatctgtcctttactttgtttcgccattgccatttatgcacggcggttaaccatgggggatccactgtctagaaaaaacaccccgcg

SEQ ID NO: 20949 - DNA, 13860 bp, Oryza sativa
ttgcgttttcgtatcacagatttggcgggtgatggacggaattggcgggaatggttaagtgtgtgcaccgttagctggaacccactaattaaatggatgcggttttgatcagcttaattgggacaggtgacaacggccggccgtttctgatgcagagatagaggtaagaggtatattcagctgatgaatctgttctccaaaaaaaaaaaaagatgatgagtcacctcactggctgatgctgatgctggcgtgtatccaacggatctctctcttgcttaaccgtctttttagctgaggtaggacagtgcctttgattccttggtcgagctaactgatggatcaatgacagctattagcaaaggctgtttggattgtaatttaagcaatgagaggcaagagaccaaaaaacagtactaccattattactactgctcgttcttgaagaacgatttaaattttagttttgctgttaggggttgttaatttgtatctcaggttttgttaaagctggtttaccttaatcatgttttagatcaaatcttgtttgtttggcataagagaattgtggatatatataaaaaaacataagttctctcaaagtaaaaaaaaatgttttattcccttcgctcttctgccttttctcttgtgggccaaacagaggatttggattttacataaatctacggtaacagaataataaccttaaacctaataattcgtataaaacttgtttttacttttcccatccaaacaaccactaaagacgtctgattagctcagtacttaaaatacagaaccttatgggattttatcttttttctttttgaaaaaaaaactactccctctatccttctctaaaagatcttatttttatctatacgtttggagtatcttttactccctccgtttcacaatgtaagactttctagcagcatctatatgaatatgggcaatgctagaaagtcttacattatgaaacggagaaagtaatacgtatctaaacaagtatttgcctagatgtataaccagaaataatgtcttttaggatagagttaatgtgcagttaattactccctccattccaataaatacatgaatatatccaaaatttatttaaacattgatttttttaggcgaagtgagtattaattaggggtaatctctaatacatgagtcattaatctctactgtttttaataaagaatcattaaagatgtccccttaaatctctataagggttcttctgcgcaataatagcatgtcctttaccatttgaaattacccctcaattgctgaccagatatttttaatggctcgtttaattgttaaggatcacagtggtgaaccattagatattaggctctgagtagaagtacgtgacttgaagatttgtgcgaacctttcaacatgttgaaattaatccactaggtaagggatttattggggtgccggacattaacagagggggagacgaccaataaccgatggtgcattaattggtgtggacggtagaaagagcattcacgtacgctgccactcggtaatgcttgaaggagggcaatgcatgggtctattccctcggtcgaaaaaaatgaacaaacatttgtattagaatatgacatatcctaatacaataaatctagacatactttatatttaaatttggtgtatcatatcctaatacttgattgatttattttacaccactagagaaaggggctttagtcccggttgggaacccctatactcctggttatacaactgggagcacaaatccaaaattaaagatgcccatctttagtctcaggtgaaataaccggagtaaaatggagccaggctaggtgcggttgctttttcttttcttttattttttttcattgcttttaacattgaatattgatttcactccatttccaaatcatcccaaattcgtgaaatcccaaatcgatcatcacatcacaaattaaaaggatcctctccaaatcctcaaatcgatcatttccaaatacatcacaaattcttaaaaaaaattacatcacaagttctaaaaaattcatcacaaatacataatatattcatcacatcacacacaaatcaaatacatctcagatatgaataaaaaattctcaaaaaaaaaccttagaggcgctgcccaccgctgccacgctggcctgccgccgtgccacccgcttcgctactacaagatgagaggagaggataagagcaagaaaagaggagaggataagatagagagagaagagggagagatgaggaagatggggagagagactttgcaatagtggatttgaggataagttttagggattatatacgacgggttgagttttagtctcgggactaaagatctaaataatctttactcccggttggttgggactaaagttgtgatctttagtaccgactaaagattctcggccccctgacaggcctctgataggagatgaaccatgactaaagatcatctttaatcccggttgatcaaaaaaattttaaccgggactaaaaataaattttagccccgattcttattagaatcgggactattgtggaaatcagccgacccagcaaagaccacttctctagtagtgttaggaccaagagagtatatttcaaagggggcaatgaaagagtgagatacacagattttatttgtcaatgaaagtttattgtctcaagttgatttattttgatatggaagtagcagttttggagttcggatataaatttgtagaatacatagatacatgccggtttgatgatatatatatatatatatatatatatatatatatatatatatatatatatatatatatatatatatatatatatatatatatatatatagagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacctggttcactattgtgagggtaggtagtaaggtggatactactattgtgagggtaggtagtaaggtggatagtagtatgatccagtagtaacactactaccaaataacaagcaatcaacaaatattaaaacactctcctttctcactcccactctcttattcacccatccattcctagtaataactaaaacaacaactcccttcattgtaaaatataacaacttaaaattggataggacatatctttctgtccagattcgtacaactaagatgtgtttcattcagtcatatgttgctacattttgggatggaaagagtacatgattttgtgttccatccttattacccacttgctattcccttcattcacaaatgatcagcatatatgatttgtgcacctatgccaatgcactcccacatgccacttaaatttacatcgattaacctgcaacaccgttttttcatatcctatgcatgcaacaagggaaatttgcaccaatgatatattgcttgcatgtatacatgcatgcacctcaaattacaattagttgaatagtacattgaactatgcatgcaaaagaccatttaataatacacagagaaacgaaaagccaggtataaaaagtactatcaaatatgcttaccatttctatataacgttgaaaaaaattatatgatgatcatttatgaatggagagtcttcctcctcattatagtccttctagaatccaaggtattttgtcgaaatatatcctgtctttgaacctttgtatccctaggagagtactacattataaggaggcccttagaagtaatcctctcttcaatgtcctgactagtcgatgcgatgtgcttacaggctacagcaaagaagggtacgtgcagctggttggaagtcgaaaccgcccgcagctgtactctctttatcacacgaaaacaaatctatgactagatgtgatatattttaataaaacgaatctagacattctagtacaataaatctggacagaaatatgtcttgaattcgttgcactaggatatgtcacatccaatcctagttttttttttattttttttacggagagagtagctagcgagagaagttcaaaccgcatggcatacacagatcacacgacacgaacatgctagctagatcaatttaccagttaatttgtctaatgctctattcatcttctagcgcttagactaacaaaagaaaattaaataagttgtacgaaatgtacaatccaacattactgggtgtgctcagtttcaaagtcatgaacaaccatttagacatacaaaacaggtggaaaaatgaaggcgatgcaagaaattttggtcaaggcgtatctagaaattccaagcccgaccggcctaacactctcgactcgtttcagaacattcagcaaaacaatactccctccgttgcttctttaacgtttgacatcattaacttttcaataaaaaattaacaatttctcttcttaaaagaagttactccctccatcccaaaagttactagagtacaatataagtattttttttactataaatctggataagccaaaagttattatattttgggacggaggtagtatataattattatttttttattgttatttgctttactattaaatatactttaatcaatttttttcatatttgtataatcttttaaaaaagaatggtcaaacgtacgtcttcaaatattaaaaaataggggcagtaattaattactgtacttttcctagcccgagctacttgtaaaaacaatatacagccggcatgtcacattagtgtacttgccttgagataaattaatatagagaaaaaaatagctcagctcagctctctgaatttctactactacaacgtggtggctcttctgaactctgaacctttaatatattttttccctcagcgaaagagaaaaaaaaatcaaggccggacgacgtactggcagagcaaagatccgaatcttggggcgtcacatgccgccacatgtggtccttagctcgtctcgttgttcttgcgtcgcatgtgcatggatggatggatcatgcatgtaagctagttgcacttgcaccacactgaccgcacgcagcagtggcacgcctcactcacgtcccgcgtattccctctccgttccttaagaaaagaatctaatacgaaaatatgatatatcctaaaactataaatctaaacagaccattatttagattgatagtactaagatgtactcactccgtcccaaaaaaaatccaatcctagattagaacctggacacatgtgtgtccaggttcatgtgtccaggttcaaacttaggattgggtttttttttttttgaacaaagggagtatgtcatttttagagacgaagggagcatatttctcttgcaaccaagcacaaacagcacaaatatttattatagacaaaacataccggacaatcctctctctctctatatatagagagagagagaggggcaaatataacgtcatcctgtctgtacttattttttccgtgtctgcaggacaaagatattcataccgaatgattcaatattaacgtggtaccatcaataatttgtacggtctttctctctctctctcacacacacacacacacatatatatatatatatatatatatatatatatatatatttgtgtgtggtgcaccagagctgtccttgatcctttatgatattgcttatgctattttaatatatgtatttcttttgagaatgatgaatatatagttgaaaatataatacatgcatataatatcatatgcgtagtagtatatgatttgacctaattaggttgtgcatacgtctttcacataatccatcaaacactagatagatcatatctaggacatccattgtcagtcaaagtcaccattttcgccaccacgacgaatctaattccatttcgtgccagaacgtactctcgtcgaatgtgagagcgaaagcagtatatccacactccatgactccatatccactagccctcctcatggatcaccaaattcccctcctcccttcacaatcagccaacgtgcagtgacacccaaaaatccttggagtccacccaggttcaacgaacctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcggtcggcggcgtgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccaggtgccacccccctcctcctcctcgtccgccatggatgtctccctctgttcgtctcggttgcgatttggtttggtttgctcgggggaggggtgaaatggtaaatttgctctttccgagatcggcgccgcttgcgattacctggttggagtggcgttgttctagcgacttcttatggattctttttttttcgtcttccttttgcttttttaaaaccatgcgcagtaaaaattcgaactaattgcattatcgcaggttaaacaggttgaatccgagtacaaaatttgtaaatagtaattcataaattggggggtaaacctgcaatggcaactgcagaagttcacaggaggtgagcttagcctttgcagtgatccgcacggactttttttttattttgaaaaagtacttcttctcaaataaataaaaattgcttaaacttaaaatatactctatccgtccaaaaaaaatcaacctcatactgaatattgaccatatccagatttataagatataatatatcttgagtttcttttggacggaaagaagtacaagtataaaatcgtttttaaaactagtagagctataatatttatggggcgtgaatcccgtgggcccacaccgaaccgcacccgtggccagaagaaattcccgtcttgtgcgttggacaggtgggccccactccctgtcacgccaacgcattagcctggccgcttaaataaaagaaaatgaatttttagctttcgctaaatctaattccggacacggttgatgacagcctggcacagtgcgccaaggcggttcacgtgagctgacgtggcggcaccggctgagctcacttgctgttgcacacacacaagacaatctagtaatctaattttatttaatatatattttttcttctctatatttggcggtaatcaactcctccgtggaattgctgccacggaagctgctcggtttgaacggcacacggttggcgtgatgcatctaaaccggtgaaggcggtcagcggtcgcttttcaaatcaaaccaccagcgacagcgcccaaagagtgtgatttttgtgttaggttggggtgggcttacatatacatgtttgaatccggtcgtttgtccgaacgagcgggaaccatggttacgtgaggactctgtatacgttttgttgtaaaaaaaaggatgagtgcgcgtattcaacttactataattgttttgatttttttttaaattttttttaagagattgcacagtctgatctgtgtctatagaaaggagatagaagtagccttgtccctaacttgatcgaagagacgagttgttcttgtttgtgcgagtagggaagcgcaacttgtgctgctgttcttgggggacattgatccccaacttgtcagcgggattggtttctttagtgattagtataatcgtaggatggagtcccgtaccgatcatagcttaatatccaagccaagcatcgtccgtgatttctgttcaaaagtcaaagctttgcaagaaccgtacagagctctgtcgaagaggtcagcgtgtccatggcagcaacagctgcgcaagaacagttataatttactcctacattcggtgtgccgcgttagatctcgcaagctgtctgaatccgaaaatggatcatgccagctcagctcgcatgtactccctctgtccaaaaaaaaaaaagacaaaccctggtttctgtgtttaacgtttgaccatccgttttatttgaaaaaattatgaaaaaaattaaaaagacaagtcacgcataaaatattaatcatattttatcatctaacaacaatgaaaatacgaattataaaaaaatttcatataaaatagacagttaaagttggacatagaaacctagggtttgcctttttttttttttttggacggagggagtactccactgtctgtctgtcggtgtgctctcctcctccacccacatggctgggctctgcgaagctctaccagttggaattagttgaaatgtttgtgatttgtgaacgagctggatgtgatgcgtcgccggccggccccggcatcggtcgatgatgaccccagtgtggcgaggatggaatcgatcgcctgtcagaaagaaacacgtttagctcttaaaaatgccagctttggtcttaattattcacgcacaggaccgagttggctgttgatctggtcccccttttgaagatctctgcatgtgattgactgcagtctgcaacatttgtttttatttttactggaaagtttcagatatgaagtaataatatagttttgccgtacaatggttcagtttcttgccgtttgaaaaaaaaaaaacaatctttacacaagtggctaacagaggcgtgatcactctgctgcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgaggtacactttttcgccgtttcgttttcaaggtttgctctgatcaaagcttcagaaatggtcaatgacctgacataacttacatggcaaaatgcaggtgtgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctggtaagctacggaattgactgaactctctgtggtttcttctgtctactactgtagctggtctgaaaaactgaagatttgtgttgattacaggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagttggaacgaacgaaggacattgtcatcatttgggctacagaatccgctcggtttcttggccgtcctcatcgcgcgagagagtctgccaagatccaagattccggcggctccccggccacgcacgcgcccatctctcgcgaacgtgacgccgttgcggcgttggtgaggacgaccacaacgcaacgcagcacaacacaaacgcggtagaaatgagttgaagagatgtggccagccatggccatatgtggggtgcggggggttagtgtagtatggacaatggaccaccggcggagcgccgttaagctggtggagacgcgcgagcgagacggatccacgcgcagccttctccgtaggcagagggattccgggaccggcggccggtggctcatgcttggcggagggggaccaattgatgcaattgaaatggagatagctacgtaacggtattccgtttaaacgggatgatacttcagaggtactccctcctctccgtctcataaaaattatatttctagctccaagtctttgtcctataaaaattatatttctagtcatgtggggcccaaccaattgattcatctatataagtttaatttgggctgctaatgcttgtaattttattaagtatgctaattatatgggttaattctctcaaacttccttttaatcatttgtatatatggaatgtgtgcatgcagtgggttcattaaataagttattgtggtcatttttcaatcctactattttatcctaaattagctagaaatgtaatttttatgggacggaggtagtatcatctgatgtgtggatatcagccgatacctaccaggtatctgacaatactttagaggtttcatctcttctgaacggaatatcgtcctgtagcatttttcattgaaatttactccgaactatttagttttttttagggggtggcaattaggatatttatagagtggaaataagattctatttgctttactactttatccctattttttctaagggaaaatctgctctaggacactttaggctttattttgttgccaattccaaccttacttaacttgatgccttacaaaatttagtagtatttttgagaggaaagtttcggaagtaacaaattttagtagaatgtcattggtaaggtaatgtttagttcgttaccctactaaaatttggtagcactacaatttaatacgtcgaaagtggtaacaacgtgaacatgccatctcactttgatgtgaagttgaacgagggttccatagcaatgccttcaaaaaggtgaacggcgctcgagggcattgttgtcgctccaccagcaagccgagtaagactttcacctcagagtccccatacaaccctagcatccacaacgaaagccaccaaatttcacatacacaccgaagctacctgcactatgcacactaccacctgcacaatggtcggactggtaccattgacaacctgctctgccacctagccagacccagggagccaggtcgtcggtgctactagatgactaccaactagacagtcccctcacagagaccaccatataacctggatgtggatctacagaaagagaggaggaggaggagggggggggggggggtaggg

SEQ ID NO: 20950 - DNA, 13934 bp, Oryza sativa
aaatctcctgacaagtttaaggaccgttggtgcattttactcaaaattaattgatccatgacacataagccccctcatctagaggttcacaaactgcttaacattcagagacatccatcatatggagttgtttaatcagcatcaagaaccgcgtgtaacttattatgatggttatgcaccaaactttcattataatgtctatcagttccgaaggaaaaaaatatgttaatacgattttccatgttttgcacgagcagctacacgagaaaatagcacgagagttttggtagtacaaaattgggccaactcgctgccagccacactactagagataagataggtgtctaggttcgatgaaccacaagcggtaccgaccgtgaccggtccgtgttgtggatagacgtagccatcccaattgctgtggagctcccaaaagttgtggaccatccaagtcaaccacatcctgaatcaatggttcggttcacttctcaatcgacgatccaaagctctagtggagccaaggacgatggagcaccgttgtgcgaggttccagcccactactctcaccgccttacccctcttcttcctcccgctctcccttgccactctatacaagatacccctgtgggagcagcactagcccccatgaactagctacattggggcatggttgtcggtgatgctcctcagcggattgggaggagaagcagtgcagttgatgggagagtggaccggcgcggcggatggggaagaggcggcaggtgaaaggagaagcggcgcgacggatagaagagtgaagcggcacggtggataggaggcgaggcgatgcatcctgagagtaggactgagatacacttccttaccttggtcacatgcattgtaggctatgtgacctcaacaattactcaccctaatttaagctatgaaaaaagtaacgtgcaatggggcgttcgaggccttgggccaatttcttagtttcagaaggactagccacacccatagcgtatcttgcattgccgctgctcttatctactactaccagtagttgttgctatagaagaaacgcaccaacacagtgccaagtcgcagcgactattcatcattaacttacttgggatgacactgtgcacaagatgctgtgcaatacaggggttcaacattgacatatgcttgtaaacgtcgggaatggaagcatatcaagaagggttagaagacatgtcaacagctcaacatgacatagatgtttggttgtgtttagttcacgctaaaattaaaagtttggttgaaattggaacgatgtgatgaaaacgttgaaagtttgtgtgtaggaaagttttaatgtgatggaaaagttgaaaatttaaagaaaaagtttagaactaaactcggcctttatagtgacagatggtgtaatagacaactttccacgagggtaccagagcatatgaacattttctaatgtaggaatgtgggatcatataatttggttgttgatgttagaaacacacttaaaacggaacaacctagtacttgcatacgtaggccttgttcggaagacctacttaccacacggctgcagctgcacagcgcagccaaccaacggctgcaactagctaatagtagctacaacctatagatgttgaagctagcaagtgtagggagcagtagtttttgtgcagccgaacgaatgacggctgtaaaatttgggctaccgaacagacccgtaaaacgtaacgactcgttagaatataattaattaaatattagctattattttaacataaatatatcaatttatatattttaacataaatacattaacttttaagacaactttcgtataacggtttttccaaacatttatagtattttgataggctttgcatggaaaatgaattacaggttttttcaaaagtttagtattttgataagcgtgagaaattgagttagatagggtacagaaggcagcctcagttaccctttattactatctttttcatggttttacttcaatttctatcatagaaacgtacatgtcgcacttcttaaaatggttagttaccctaatgatttgccctcgtataaaaaataactcagtctgctctcaggcgagccacaattttgacactagtttgaatttccacaaaaatttaaacaagatataaacgcagcatgaaaccgtcagtaaagttataagtatgcaaaacccccaaccagccagaatatgggccagaaccagtgacagaagtgcagtggaacgcaaggagaaatccgtccaaagtgagctcacgaacttgtcaaatcaaaacaatatcgcatcaaaacaaggcggcaaacggagactgctgtgattccacgaaacatgaaacaacggagcgtttcgagaaataacgggtttaattccataatatttatgacacccagagcaatgtaggcagttctagcattttaggatagtagaatgtacctactcccagaagtagcataccacaaacccaagcgtaccaacgattatcagagtacagccataagcagtggcaccaagttcatgaatttgccaagttattcatgtataatcatgagagtaacgcgaggcccaattaataaaagttccaaaaggccaccagcctaagcagatgcaccaccacggcggcactcgttcagcatatccaggtagaattggcacttgctgatgtcacttccatagttgttgatgcactgcaatacaaaaaaaccaataattaggatttaggacaacctccatgctagtgcgtagactcttgttagttacaggtagtagcatgcatatacaaattaattcttatcaattcaatctatgttaacactatgaagaaatgaggatgctttcttctgttcacatagaattaatcagatgatggtaaccagagaatggtggggatcaacatgcaagccagaatgccagatagagttttaagagtaaaattaaaatagataaatgaagcatcatcaaattcattctcatggctgcatgggaaatgtaagcacgagtagatggaagcagccaggcaacaaaagataactaagccaaaatgggcaggaaaacatacgtcttggaaggccttggaatggatgctgcatgagtcagatggagtggcgttggccattggggtggcagaggcagcagcctcggagacaacagtctcatgctgaatggtacggggacccattacagcatcaacagccctatgtgccatggcactaccagtaccaaaagccatgcctgcatatatgtgcaaagaagtacttattagaaactgcattgttaatataatgctattcatttcaattaaaatgaagcaaaatgatgataccttgagcaatagtggaaccaattcctcccaggatagagccacctccgttctgggcaggagctggaggaggagcctgccttgctgcaatgaacaaattacagatgtcaatcaaagaacacaagacacaacttgacaagacaaaacactttaaaaccagtacagattatacaggtacaatgagaacataaggcacaacttgacaagacaaaacactttagaacagtaaagaataacacaaaatttgtgaaaccccaacatggacaaatcaatacctggctgcggagggttcctcacgggagcagcacgtggtgcagggcgagaccttgctgcaaaataaatgtcaaagcataaaaaagaatgaaatgggttgagatgtgtcacactaatctagagcatatgcatgtagaagggcataatacatacagttaacaacatcatagtcttcgtacataagaaaaaagaaaaaagaaacaccacttcatatcagaatctatctaagaagggatgaacagaaaatcaggccccttccctcaaaaaagattctatttgctatgtgccccagtctgaaccaaatgcaaatatactaagcagctggttattcatgaggcagtggtgccaagctgcatagaacattatagtacagtactaacttatacaagtggtctgcaaactaattttagtcattcagatcttttaatctttgaacactatatatatatatatatatatatatatataaaatcttaatattagtaaatctcacgaattttaaaggaaatggattgataagagagaaatgctggaatatgcaaggccgatcaatgaacaaacccagaaagaagggacttgcacttagagcagccaaagcagtcaataacatctctatatgccccataactaagccaagatagcatgaacaactacagtggctactcaaaaaggcaaacagtatttgcagcccaaagcaattgaaaaaaaaaagcttaatgcacaatgtgcaaggctgttcaacaatccctataaagaagggagttgtacttaaaacagctaaagcagtcaatagcctctctatatgccctctaactaagccaagatagcatgtataactagaatggctactcaaaaaggcaaatagcatgagctccccaaaggaaccgaattgaacaatcttaatgcatgttcaacaccactttctgatgaccaaatatgaaatagagatagttgtatggaactaaagactgcaggaacacgtagaagatgtacatctagaacatcttggtatcatttcttgttatagaagatgaggtacccaagcccaagcaaatttcaaaacttccacagctatgatggctactcattaagacagaatgaaattctacaatagtgatgaaataaacacaaacagttaactttaatgactaaggcaaaatgcaagggtgtagtttggattgtggatggaaaactgtagcaagaaatagtatgaacataagaatttgatggaatgtctagagctgcttggggagcaccgcatattatggtttacaaggcgctccctcaaaaggcccaagtgggcatcaaatgcccatctgtatgcacctcctaactaagccaggacagtatgcacaactgaagtggccactcaaagaggaacatggaatggaagccattggtttatcatagcacatgcacgatgcaattcgcaatgtatataaactaaagatatatatgttggtttatcatagcacatgcacgatgcaattcgcaatggaatataagacatatgtggagtccatctaagaaaggatcaatggaaatttcctttccctaatatattatggattcaaactttgttatatgcccctgtctgaaccgcctgcgcattttgccacaaaacaattcgcaaccggttattcaagaagcaatcttttccccgttcctgatctaaaaaaaaaaaagaaccccttcgataatcccccaaacacgggtagagtcctatgtatacaccgacgacagatctgaccaatctagcagctaaatacgccaatacaagagggagggcacttcctgatcctacatcccaccaaacgctaaacgtgagaccacgaatcgcccaatcgcgcggcgcagatcgatccgaatcgaaaatctacccaatccaaacgaaggccacagatccgaacaagaacaacaacgggcgcgttcaacgcgagaacccaatcccaaacgccgcatggctactggggctaggggggagagagaggatgggggttacctgagctgcggcgagccatggcggtcggcggcggaggagaagacgaaaccctagatggcggcgcggcgaggaggggagcgagcgaatgaagagggcagcaacgggtcgggaggttgaacggcagccacgcctagggttaggcttttatagccgcgagtccggatttttttttcttttttttttacccgttcttgctctctctctctctctctctccaacctcccaccttcttgcaagacacgccaagctgacatgtggggccagaaatctgcggtgacatgtggggccattacttgtggggtccacatgtcggcggcacgcaagctggctgggagcctttgaccgttggaggggatatgctcggaacactctggattcctccagatgaccggaagcagcacgaagccgtgaacggctacgttttcatttttcgtgctcccgtgatgataaggtgaaaaatgattcgtgattcttccgatttgtacaaaatgaattgagcaatttagtcaaaaatattaagctcaaattagcatgcatttataaatgccagatgaaatatctctaattaataatcttctagaaatctcaaactaatatccatattaaggtttggtccaaccagctagatcccacacacacaaccaaacgcatgttgcaattgcacacaccattggcattgaaaacaaaagagtatgctgcaaaacatcaggaaaatatgctattaatccatgccaaatgctcacacaaaaattgattcgacttgcagttgtaatcccctagacgagggtgtttaattgtacaactcgcagtggctccatgtataaaatctcaatcccctggcctataaccaaagtggctgaggagaccattgtacagttttgcgttggcttcatcatgtattggtaactactgctactatggtttcacttgaacatggaaatgtcgaagatgagggcagagccatccgtggacacggagacgatggagttgccatcagcagagacggcgagggactgcacgacgtcaccgtggccggcgaaggccctcacgcactccccggagaggctgtcccagattcgcaccatgccgtcgatgcaccccgacgccacgaacctggacgggcccagccatgccagggatgtcaccccctcctgtttgttgtccatcacacaggcagaacagatatactgtttgagtgcatatctaagaaatggaagtgacggtttttggcgcaggcagaatctaagaaatgggcgacggtttttggcgcttacatcgtggttgcaagtgcatcggatcgattggcgaccaaggtcccagatgatgagcttctgatccatgctccctgtagccacccaattgtaactgcagaaaatactccaggtcaatgtgagaaatgtgcggtgttcacgtgtttaccatactgctactctatggatccagtaccttggtgagatgccgacacactcaatagagccagtgtggccgtccagtgagccaacaacctgcaaaacgacagcgatgatgatggtaccaaaatgccagactgcatacattttcaaacaaaacaagaaaaaattccagcctatgtaccaacttacatgataaagacacactagcttgagtcataagaacacttacctggcctgagtttatgttcacaacacacacagaattatcctttgaaccactaacaattgtttgggaatccgaagtaactgataagcatgttaatccatccgtatgatagccatggcctggagacaaaaaagatcagaatttgatgttcacgactgattgagtatatatgaattcaatcatatggtaatttacctcgaacaacatgtctgctttgtgcagttcttgggtcccatattctcaatgatgcatcatctgatccagtacagataagtttaccttcagaagaaggtatgtgcattagcaaacaatattttcgttcaaaaactatgttgccactgtagaacttctatgtggacagctaaataaagatggtaggagaaaatttccatgctaaagcatcccaaacaacttgtttactcagggttaactaacaaaattaacataagcaaattgttattgatcaaggaaatatattggtaccatctggagtaaaatcaccacatgtcactgtgctactatggccagcaaaggtattcagaatggcattatggtcagcattccacatccacaaattacaatcttctgatcctgcaattatcaaatgccctcgtggatgccatttaagccactacaataccaaagacatacagttacaccacaggactaatcatgaagtattcatatattttgggagaggaaacaagagtttgtcagcggcaataagttcaactaacaaatgaaatggaacagaatcatctcacctcgaagccagatccagaaccctcaagggttccctgaagtgttcgtgtagctgtattccacacatttatgcgtccatcaaaacttccagaagccaaaagattcccatctgaactgaaagcaaccgtgcagacagtatctgtgtgccctgtattgcgaagctattgcataagttcaataaaataattccgagtatcaacactctgtgataataatgattatgtgatgactaattacaacaataatgtgcatgcagaaaaaaaagaaatccatgggccataggaaatctcaaaattctttgatacaaagtatcgagcacagaaagcttctgggttccattgctgatatgcatgataagagagagtaatttaacacaaaatggttaataaaaaaatgagtaaatgatttgtctgcataagatcaatatataacaattgaaatgctaatatgttgatttagagactacaggcagtataccaaaacattccattaacataaatgaatacatcaacttaataaataaaagaaatggaagtgaaagcatatacctgagagttaatattttttaaaggtggaaaggaacagagatgttcccatgaatattttagacacagcaaattaacactgtaatagtaattaataactaaatcataccggccagctccaaaacatcctctgctgatccaatcttccacaggaatcctctatcgtctttccctccagaagccacaagtgatgcatctgtaggactgcatgccacagcgaatatctcgtctgtgtagaacaagaacaggaagtatcagaatatgtataacaaaatctgcatggataagtataactggagactggagtacaaaaaaaaggagcaattgctgcctgagttatggatggtgtggctcagagaacagtgcatcaaagttacaccaatcaagtactatattgaccaatgatcagcaccaaaaaaatcataaattcattcttttcaaccaacttgcctgtatgagcacgaaatgcatattgggaatcatcctcttgcatatcacctgaaattgaaaggatagataattacaaaccaaatttcacaaatcacaagtaagacagttcagaatagttaaatgcttagcatgtaaatgagcaactgaagaacagattgcaactaaaattctagaaaagagaatgttcctctaggatctgacaggacagctgtagaaacataaatacacaaccattgcagttttctttataaatcaaattaaggctggacaaaatatgtccaactgtcatatttctcacaattgttccatcttttttaggacgcaataatattttcatttgcaagttagataaagaaagcagttagccgattgctaaatcatctaaatgcagttgcaccaaacgagattaccataatgcacctgaatgccaaatggagcataagataaacagtaaaacaggcaaaaagcataatactaaaacagaagtgcactcaaaataagttttccggatactaataaaacagaagtgcactcaagagaagtgatccagattgtagctttgcttaagagaaccaccaagacaccaacatcaacaaagcaaatgtcaaactacgccccatgtaactccaacaattatataggcagtataacagcataatagtaacacagaaatgcatccaaaataagtgttccagcttatgtagcccccaatctattgcccatgattgtaattctgcttaagagtcgaactcatgatattctacagaattccaacagtattggagaggaaaatgttatattctacaaagcatattgagccttagcatgcaacatacccatcccatcgtcatcctcatcatcatcccggtcagggagatctgaaaaacacaaccaataatagtaagcaccaagcaaagcagaaaacagatagatggatagtactactactagtagtaatacaaaccttcctcgtcgatgggtatctcgtgtatgatgtcctcctcattgatgaacacctcctctccatcagagccttcgccggcggggacctcgcccgagatgctcatcgtgacttcacctgagttgggggcgactcctcggccgcaagaaacgagaggggagaagggaggaggaggagcggcgcctgtgtcggcggaggtgtgcccgcgccgccgcgatgcttgcctgcgacgagccgggctggggcagactagggttctggacttctcggcttctcccgcctagtgtcactcgtgtagtaggatggcaatggggcgggtcggggccgggttggtctggaacggccccgcccccggcccaggagtggagggcgggtcgaaatcgatccccggccccggcccctccggggccccgctgcacccgcaggtgaggacgcttggaggaggcggcgcggcgacgggcagaggcggagcggagacggcggcgacgagcggaggcggagcggagacggtgcggcgacgggtcgaggcggagcgaagatggcggcggcgcggcgacgagcggaggcggcgatgggccttgggctttgatccgtgggctgtgggtaggttttcccccataggcccaatcccacgagaagatggaacatcaaaaggtaaaaaaaaaagccgtggcaaacccgtaattattcgcaggaagcatcacttcgccgcaagacggcggcgaccaccgctcctcggctggagggagccctcgtcgccggcgaagcccgcgcggccacctcccctgccggagttggccatggtgagctccacctctctctctgcgtgtggctgcgcgcctcgctccatgttccggtcggcttattccttactcgcttcctctctctcgcgcgcgcgtctccgcggcgctcgcagttctccatcgcggccatcaacgagagcgacaccggcgggcagtgggagccgctcgcgcctaccaaggaagctcaggcaagtctcctccccccttgtcgccccgagcattctctcttcctgcgtatctatctaatgcttcgcctccgtagcttgtgattttgggccccgttagggttttcggttcttcgagcgcaatgtgatggattgattggttttaagtgggtaaacgcagcttaatgttgtggcaagcagactctaggagatgtagaattcgatcaccctgttctttgatgtgatgtgatgtaaggtaccatgtgttctttagcttgtgttttcgacaatttgggagcttgaagtggggtttttactatctatggtttcttccgattctgcgacttgcgaattcaaaataactgttttttgttcctttgatttgatgtttgcttatcccctaataaaaggataatgtaagatttcggttttcattatcggttgtaggtgtaggagggcactcaggttagacctttcaggttaaggggcagtattcttgatgttgagctatacatgctcaattgctcatgatgtagacgaatgcgtgatagcatagtactacattttttttccaaaaaataaaattgttaggaggttaaggtcgttttgaaagctagctgttggtaaagattttggtgtcatctttagttatgctaggaaccgatttaattgaaatacggaataaatatcttctaaactgctttacgagaatcggaagattaacacagacaattattataagtaaataactttgggatggaaatttttaggattactagctaattaccaatcctccttgacatattttgaattaacataagttataaactttatgaaaagttgtatatgtttctcagaaggaaaacacgtatatctatatcatgtgcctagattatctattatctagaaaacatctcaccaactcaatccataggagccttttgatttagatgttctaatgctccttctctattcggaaggagagatatgcccccccccccaacccaaaaaagaaaaaaaaaaccctgaactaaacttggtttggtgcaagtctttttcatttttaattaaatggttaagaaggatatctcagggaaattccaagttattattgttaatagccctttattgaacatgctgccatctgattatatatgtggaactttgtttagttagaggcatgatcataaaaaggtgctccaacggaacaaaagggaatcttccaggggcagatttctactttattttactcttttttaatccttgaataacattggttctattatgtaaacattaatttaggatgattcattgaccactctgattgtcttgatgttgctctgctggtcctggattacaatggaatgcatgtattaatttatagtttgataggtaatatacttgttcatctgcccttttattgatgtgttgatgtgttgggatttgggattggggatggtgttctctgtgctggatttttatggacggatacatgattggtaatttaatgcattatgtatacatatctactccctccttccacaaaagttagacctgttacttttttcaccaagaccaagagaaattaactcatttgcatgtaacaaagatcaaggagtatatgcacgcatgcaaccaatgaacattaagatggctcatcgggttctgattaaacatcaaatttacctctccgtttaagtcttggatgcatagagactataaataggaacaacttatttggattttggaaaaactaaaatatgaaataggtcgaactcttgtggatggagagagttctggctggtacacatttttatttaattttagatttgaagataattatttcggtatctttaaaattagaatatgtgatctgtattgtttcgagaattgttgcgatgcacagtcagtcagtcactgtgctagtacttcctccatatcaatataaggacttttagagttgggcacagttattaaggagaaatgtaaaataaaatggatggttgtgattggttcagatgaggaagtaggtggagaaattaaatgggagatggttgtgattggttgagaggtggaaaggtagctatattttgggacaaattttgaatgctaaatgtgctatgttttgggacggagggagtatatcataatataccagttctgatgtagttttacctgcaccaactagatgtgcgtggctatcatatcatgtctgtccaaggaattgattctgccagtcttgtgcaataggtaggtcactgtaattgatctgagaacacgtttagtagttaattaacagtatttaactgaaggattcttttgtaaatctcttcctgtgctaaggtcattttttttagttttacaacttacaagctctcaattttgttgccgcaatattactgtgttattgaaattacttttcaaaatgcttcaggaatcagcactctctcagaagtaccacgaggggctcctcaagttgcaagaaaaaaattatgtaaaagctcgtgaacttctggaggatgtcttaaaggacccactaatatcaaaaattcaggcaatctctataagaacatttcagatatcagtttgtttagacctgtgctctctataacaccaagttgtttattttaaacaggctgataacattgtcagtgatcagcatttgctgcagctaaggttcttttctccatacctcatttgtaatgttcatgatgtaattccatttttatttgttggttaaaatcattgacatagcgcgaagaattataccaagtggaataaacactcataaaataatgaaatttcttagaactacaacagctcttaatttaagaaagatgcatttgtgtcatggggtaaccacacccccatcatctaattcaccatgttgcaatgattcataaaattccaaaagagaaacaaactcatgtgtagtacacataaagttatacaagcctgcaaaaattcattccagatatcgaggaac

SEQ ID NO: 20951 - DNA, 4624 bp, Oryza sativa
aaaatcccttatatttagggacggagggagtattataactaaaaagtaagatattgataatatatcacaagaacgtaaatatacattactattacattgcatacagtatgcaatgaggataaaaaaagaacttgggatacaaatgactcagattgaattgcaagcatcaactaaatcaattctatgctgaattgcaacaagcagaacctttcaaccacatcccatcccaatttaccccaatctgattaatcatggttttggtttgatcatgttttgtggatagatctcttcttttaagtagctaatatcatatggatgatataatataatcataggcaactgtttgtgtgtcacgatttcttgaaggttgtgctatactacacatgtgcataattgggtgtgttgactcttcaatcagatataactgactaaatttcaatggctgataggtttgaaatctgcaacattaatttttaacgtgaggcttcttaatttcacaggtttcttacattgaaaaaccttgcgtctgtttttcttcaacaagggtcagcattttatgataatgctcttcgttgttacctacaagctgtagagcttgatgcaaatgattcagttgtatggaaccatctgggaacactttcctgctctatgggtttgttgagcacatcaagatgggcatttgagcaagggcttctatgtagcccaaataattgtatgatgtcttttttcattattcccttctagtttattcccactgccttttagttcatctattgttcctaaaatccatgatttttttctggttttcagggaactgcatggagaaactcttggaggtgcttatagctatctgtgatgaagttgcatgcctttctgtagcaaagttaatacttaggagttggccatcacatcatcgggctttacatgtaaagaagaccattgaggatgcagaaccagtaccctttgcacctcgaggtatcgacatacttgaacccaagcatgcaaaactcaaattttgtaacaaaagaaaatctggagatgatgaaacgcatcatgaaacagtgacaaagaagagtaggcagaatgctaaattgcagttgactgaagccaaatggatggcccttttagatggtatcctaagcttcttaagttcaaacaacacaaaatctaatgaagatcacggtgccaatacagagagtcaatgtgatactaagaggagtatcaatgggtttgcttataacatgatggatgtctccttatctacggaaacattgaaaactatggaatctgcaggtgggaatgaacatgatttgtaccatgatggtgaaagtgtgctgtctcatgactgcagaactgcagttaaagagaaggacaccaattcagatagagaacatcctcatgaaaggagaagcacacgtcttgagaggctgcgaagtcgtaaatctggtaaagatgaacatgaatccaatggaaaagatatatcacatgctataactcaatttctagattcatttatcttgaagcgcacaagtattccagaaaagatcgattgttctggaaatggtgatgcttctacccctgaagctctaacatatacacctgatcgtgaggcaagtgatgtgaagcaatttctttccaaaatatcaaaaaattgtggacctcttcatattggctatatgttacttgaggaaatagctcagaccaacataccttttcaagattactttgttaagttcattgaactagacaaaattactagaggctgggctcaagatagatctgcacaatgcagcttatttcttgctgaattatactatgatcaagctctttgttctggaagcccattagcatcctcagagttgtccaattcatcttaccatctttgtaaggtcatccaatcagtagctttggaattgccattcagaacctctgatggagcagcaaagtccaccaatttggatttgaatatggaaagccatatggaagaggtgtgttcaagcgataaaactgagaagaatgcctcaaatatgtccagaaactctgtaaattctgtcaactcggtttccagtaacattctttgtgatgaaacatctgaatgtgattcttcttcaaacactaattgtgttttctggattcgcttcttctggctgagtggttgtctgtccctttcatcagactgcaaagaaaaagcttacaaggagttcaacattgccctgtcacttatgagaagtagcaacgaagccaaaatcaatagagagtttgtccttctacctcacaataagcttgtaaaattgcttacagctgataggattcttcgtgaaattaacttggtcaagcttgaatctttactttggcataatgatgaaaacatcaataaaataactcatacagagttcatggaattgcttcctccacttttgctttccaccaaagatgtctatgttggcagtgcatatggtccaccaagagaaagtgagaaagttatttcactagagttaggtgccttggatgttttaatatcagcatgtgaaaatgctaaaccaatgaacatccaggtataccttgactctcatcgaaggaaaatgcaagttctaactgtggcagctggcatggttggatcggttaccaccaatgaggggaaaaaatcaagtgatatagagtttatggaaacaatgaataggaatcgactggaaagtgttgtagaagcagtcaaagatgtttctcgaaatgctagtaaagcgaaagcctttgttgatcagtgtgataaccctgtaagttgactgttctattttctgtggattttcttgactgtcattttaattcaagtctttcatacttggaacgctatctaccaagcttcacttttatattataggtcaatgcacaacactgcaccagactaaaagaatattagaaacaaggtataaaggaagaagtatgtgtggagctaaatgataatttcataaaattccgtaggtctatataagttggtgaagctgcatagaacagtggaggaggaggaagggaggaaacttaaatattcttattttatttattttgtggagaataggcaggagaactgtgtatcattgcggttagaagtgagctaggctcaagtatagggacacaccgctaagctaccagagagaaaaatgcacacaaaaaagaagctaggtatacaatttaagaattggtatattggtgactgccaaacttttttttactttgaccatttactcattagaaatatttgtattgcatgctcattgagtgctgtgaaaaataacctctatctatgattttaggcttttagtaacatatggtaataaataagtatcttgcagacagtataaaggaaattttcatgtttattttttgaacaaaggaatagataatactatgaataccataaatgatcacagggaattacaatatgtagaattgtatagcatgtcagaggtaaatcttttgagcttctctggaacatcaactcgcccccgagctatctaatatacaatttaacccttaaggatggttgttagggtaaaggttatgctgtgcattctaggatggtttgtactgtccttcctgactgtttactgctttatgtggaagttgtttatcaatggtgtgttccagtttagcttaacactaatgctatccagcatgagtgaaattagtatatgagcaattgtaagacgcccattattctgagatttttcaatttcatatttgtttctatattgcctgtatcagtttctttaatctatcaggctgaatatctatatttctaacaatctcggggatattattattgattaattcctcaaagagggctactgaaacgactgttttattgtcatatttgcaggatgggcaagacggtttcagttcactagtttctattgttggtgattttcaatcattgctcctcacaatcatgtgtgctgctgttaagatgatcctatccagaaaacactcgtgtactggaacctcctatcaggctgaccagttggagagttcctgccttgttgatgcagccatcgcattttgcaaacttcagcatcttgatcctatgatatctatcaaaattcaggcacgttctgcgcaccactttaccaaaaaactctctagtattgattttcatgattaactttagttgcttttgttcacatatgattctttgcaggttgacttgattgtggcagtgcatgatttgcttgctgaatatgggctctgctgtgctgggcgtgatggtgaaggggaggaagggacattcctcaagttcactatcaagcatctcatggcactagatgtgaaactaaaatcccaacttagtaggtgtttcctagcaaatttattatggtatcatgtttctgtcccaattaattactagaatttgtttattatctctatcttattgttagatccaaatgggatggaagaagatgcagcagaaaatgacagagcagaagatgttacgactgatgaggcatctgtttgtgacaataaacataattctgaggatgaggaagaatctggtaggccatattcattgcgtgtaactattccattttcctatatatcttgtggtagacatgatgtacaatgacagacaatactg

SEQ ID NO: 20952 - DNA, 11417 bp, Oryza sativa
  unsure (1)..(11417): unsure at all n locations
ttatcagacaaaagaacaatgtgctgatgtgtttcaatatgtcctgccatatgcaaaagctctatctgtgagtaaattcatattgagttccttcattttgttgtttcagtttggtaagaagcatcaattgcagcgcatagtgccttggtcattctttattcattttcttcagaaaactggcttggttaaattacgaagagtgctgcgagctatacgtaaacactttccacagccaccttatgacttattggtcaataatcctcttgacaatttcttggatggacctgattcatgcgaaaagattctctctgaaatttacgaaactaatggatctaaggaagctgtcctgaatgtactgttcccaggtgaaaatggctacgaagcattcaagaaactgtccaatgctaggttggctttgtgcattgtacctatagtccctcctctccttttatttttcttttgcactggaacaagtttagttgtggatataccctaagtacatttttgactgattgctgcagctcagagccatactcagaagtttatgggaacctgtatcactacatagcgcaagttgaagatataagtgcctctgacaagtatacaggttttgtgttaaaaaaagaagggggtgaatttgttcaacagagtgctaaccttttcaagtacgatctactgtataacccattgcggttcgaaagctggcagaagcttgctaatctgtatgatgaggtatgtttatttggttacagcagttgattgaacctgttccattgtatcatgcatttctgttgcataacaagtttttgtcttgttcaaaaacaggaggttgacttgttgctgaacgatggtagtaaacatattagcattttggactggcgaacaaatacaactttaatccaaagagttgagatgggtcgtagacatagtcgacgctgcctattgatgagtttagcattggctaaaaccgcttctgataaggtgtgtcctcttgttctgtactcatctatgagatgccttaggtgctatttttcttctttctatcttgatgagaacttcactaatattggcaatgacgtctaactcattttctttcaggcccaaatgcatgaaatgttggccctagtttattatgatagcctgcaaaatgtggtacccttttatgatcaaagggctactttgccagtgaaggattcaacatgggagacattttgtcgaaattctatgaagcactttcagaaggcgtttgaactgaagtaatcttacataccttgttagtaatctcatattctgtgtgttgtttgccacaagtaggatgataatgcttatttccttcacagggctgagtggctctatgcattttaccttgggaagttgtgtgagaaactggggcattcccctgctgaagcattttcatactacaacaaagctgttgtgttgaatccaacggcagtcgacccggtttacaggatgcatgcatcacgcatgaagttactttatacccaaggaaagcagaatctggatgctatacaggtttgtctaagattcatgaatcagtttttgcttcttttttttttctttgtaaaagtgttacgcacggctgggttccttatttaatagtttgtgtacagtcttaactaggctattgacatgggcactggccaagggccaaggaaagggtgcagccttaaagaggggcctgctcctcccttggcctcactggttctagcttactactagcagtttctggttttcccctcgattgtgacaggctagtttataatagatattttgatattaactctattgatttatgttttttaggttgttgctgattatacatacaaacagtcaaccaaggaagatgtcttgagcatgctacagtccataaataatgtcaagaattcaccctctgatcataatgataaatgtgtccttgatagcacagcggagaataagtttgttgaccctgatctacttgataaagtgtggcacatcctatatgatgattgcctgtgtgcccttggtacttgtgtggaaggtgagctgaagcatttccataaggcgagatacaagcttgcacaaggattgtatagaaggggtgaagcaggggacctagagcgagctaaagaagagctttcattttgtttcaaatctactcgttcttcctttacggtgaacatgtgggaaattgatggttctgttagaaaaggaaggtaaagtttttttgtccttgtgtaatgtcgtaattacccatttacaaatgcatgttgatttatccaaccattacagcttacaatattattatcttcccaaaaaaactctggtttaccttccattttccaggaggaaaaatccaaatattggtggatccaaaaagaatctggaggtcagcttgtcagaaagttcacggaaattcattacatgcatcaggaagtacatgatactttacttgaaccttttggagaaaaacagggatttgtggaccctagagagggcgtacacttatctgcgaactgataagagggtaccccctaataatcacaacaatgatgttgagctatatttgttttgtggatatattataataataagtctatttttcttgtagtttgctctatgcttgggcgatatcgttcctgttggtcttgggaagtaccttcaagttctaacttcagcaatccgcaatcctgagattcgtagagtttctggcgatgcttccgttgagaacctacttgagaaaatgtttggtgtgttcatggaccatgcaaacttatgggctgatataagcactattccagaggtcaatagtcccgagctatcagaaagcaatctttacaggtaattactagattagagtgcaaaatacatagttactcaagccagatggttttcatactttatttccttgtggcagttatatccaccaatacatccatttgcttgagagtgatgtccgactggatgttcttgaaggactaaatgagaagataagaaagcgttttaaaacacccaaactgtcaaacagcaatttcgccaagatatgcaagcacgcttctctggcatggtgccgttgtattctcatcaaacttgcatccatcactccactgcctgaatccatggaaacaactgatcagcctgctccactatccagcggtctagtgctttacatcgacttgcaacctgatgagcttctcatctcgtctcctgatgggcctgctcaattcaaaggcctcgatatgaactggtttgagacttttaacagaattaagaacattccgatcaggcaaacatccgaagataacatggagactgctgttactgtcatgaagagcacctacaacttctatcgggagagctcttgcggaacattcccatcgggtattaatctgtacacagtcaccccatcgcagccacctgttgaaggcctacagcaagccccagacgcaattgagaaccttgacctcagtattccaaggaagctccttctatgggtttataccttggtccacggccgttactccaatatatcagccgttgtaaagtactgcgatgagatgaaggtatgaacatgatgcccagtatttaaccatataaccttcccccttcacctcaactaacgcctacccgttcttgttgcagtcaagaagtaaaagaggagccccgacatcgacagcgacagcttcacagcaaaccacagtttctccccaaggtatcgcatcaaacttccgccatctgggtatcccttctttccgtacccgaaaaaatgcctaatgcatgttgtgtgcttgatgttataacagttggctccaaagagaagagcacccacattgaccctagcgaagctcaagaagcagcagcccctactccagctccagcagcggcgattgctccttcccagcaagaggcaggtgttgcagttgcaagcagccctcatgaggcccagaaaaccgccgccgcggcggcggcttctcaactcacccgtagcagctcatcgagggcgatggagagcactggtcaggatggcggtagaggaaacgacggcacggcttagctttgccccatgtctactggctgctagtaggctaatttctgcagtgtgtgtgtgtgtgtgtgtgtccatgtgaatatgtgtgacctgtgtggctgtgtgactgaccccctcctaatgttgatgtctcacaacgctgatgattaccgtcgcaggaaaatatgctgtacagttattgaaaacctgtaacagacagtagtggcatgcttattgtcactcaatttacctaccaagatataggtggaaacataggtcaagtgcgaataggttcacaacctggaatgttgttcttacccatggtgtactcggtactccttacccattagtgctatgtaaagctgcgctcataaaactgagtagttttttttccccgtaggtgacttgataacactgagcattaacgatgataaattagcatacccatggctcaattgcacccaaagaaattcagaaaaaaaagcaactacaaaaagaagaaaaaaaaacggtacagtacaaccccattaaacgggctggcccatcattaggcagcaaagcttattgggccggtccttggataaactccaatcgcacctaagcacaccgaggtcgccgcagaggcagcagccgtcagccaccacccaccgcgaccgaggaagaagaagagaggagatcaggaggaggggaagaggaagtagggatgggtttcgtgatggagttcgcggagaacctgatcctgcggatgatggaggacccggggaagcgggacgcggcgcagcgggagcacgtgtaccggatgaaggagcggtgcgagcgcaccaaggcggcgtggagcctcccgctccgcccctacggcttctggaccttcgaccgcttcaactcccagctctcctgggatccccagatcagccacgcccccggccgccgcgacccctacgacgacgtcctccaccgccactccaacccacccccctcctcctcctgatcccccgattcgatccggaataggtaacttgcccctcgatttgcttcttggatttctaggtttagttgttcgttgctcgattcccctcttggggaggtccaattaagcgattagggctcgtttagagggtttaaaatgtcttagctgttcgttgctcgattcccctttttggggaactccaaagttaagcttgcttgtcgaacattcaatgttcattgcattcggatagtttgtatatgttccattaggttaggcttggtcacctgtgagttgctaagcttgaggtgttcactgaactaatttccaatctgactgcactatttccaatctgacatcaccaacagccactcaaaattcaatcccctaaatcattttttttagatctctaaaaaggatttaaggtatgagtatagctgtatctccaagagattccaaaaatttaatccccaaaacaaaaaaagtgggccacatcgacaactaccaacagaatggtcattcctctcctccactcacgctcgcacacattgcatcttcctcccggctcctttcaggacattcagtgatcaatctctttgacatcattactgacagttgaagcattgaacaatgtttctattggcctcagctaccatctgagtatttgtcccaaaatgatatttcacttgattattaccacgatctcctgtattttacatggaaaaaatattggttctgcaatcatcaacagtgggggtgtcagcccagaaaaaaaatcagcttttttagtgtgaatggtgttaattaacaacatgaagttttcagcagcaaacaacaagatatttcagcagctgcaacagtacttttcagtactagcaagcagcagtttttagcggcaaagaacaacagttttcatcagccagcaaacaacaaatttccattaccagcaccaagcagttctcagcaacagcaagctcaaaatttgagcagcagcaacgatcagttttcagctatcagcaatagcaagctaacgaacagccatgttccatcattgaattgcaacaaaaaagcactgaccaacagcacttaatcatccaaggtcgaaaatatattgtggagaatggaggaaacaattatcttattaaggagaagaataaatatttgaatgcctagagcaagtttgagcaatactccaaatagtttgggatcattgacctgcaccgctgaacgagtcgatggtaaattgttttgacggacgaactcctcttcatctgggcatcaccgcccagagaccaatgaaatcgactccgaccgaggtgcacgatgattcgatgaaggccagcgactgggcacctccggctgtcgccggctggtcgcatggggcctttgtctcctgcacattaccagagggcgccgggtggccgggagcctgagacagtgcagcgccagtctgacacgagggacaggctgtgttgcgggacgcggtagggtcgagggacgattggagatgaatcggggcgacggccgaatcgattcggtggtggttctggtgggagtgccgacgaaggtctgcccaattggggtggagatgggtccggcgccgccactgagaaaaaatgtcgatgctgtgaaagcttgggggagccatggctgctttccagacatctgcggggaagatgaggctgctggcatgatggattgactcacaggcggacgaacgcacaaagaaaaacctggtaggaaaatttttacccagcacgcgcgaagtgcatgctatcgaaggattgggcgccgagtctcttccctacaagtcgagaacgaaatatacgggtttggaaacgccaagcttttaggggtgatttaggtatactgttggagcgattttttcctgcaaaactcctcaaaactggtattgggaagagtattgggaaactgttggccatgctctaatacatggttgattgaatagattcgggagatgtcgccggaatgtatcgagtcaaggacagggaaataatgcttgtttggaacctgtaggttcgttcaactattatcctgggagtaggttgttgactcatacagtgcagatggatgtcacagctctaggttttctttaaaacatgaagttgagtgaggaagaaggtgtgttaaatacttaatggtttcttaactttgttttggtgtcacattaaggaaacaatatttttgaatttgaatctagcaacttgttagctcttccaaattcatagatgatgcatgacgtgttggtaactatgcctgtattcccaagcggtgagactaagactttaaaattttctaactacatatatatttaacagactcggattttaaaattgagcctaaagtagttattatgttttcagttgacatatccaaaaaaaaaatcaaatgctggaacatatactcatataattgctgcatatgctagaactgccaactttagtaatattttgtttatgtttattcctacaatgcttttacataactttacccaccaaattgttggtatcttcaatagtatcttgttgatgtttggatggaagccttttttttccaacactatcaaaatttctctcctaactagtataaattttaccctgacaaagtttctcgcactatcaaagttttgttaggctagtgtgcttatagtttcgcattatcctagttttttatgattagttggttgctgctattaacttatagactcctgtatgtctttgatagtttgatttacctaattttagagacagagtatgtccattgggattcctagttatgaaaatgttcgatgggcctctatggtctggatgataagaaacaattatagtttgggcgctggagtcagtgtcttactcttttcatgtgtttacctctcatgaattgttcagctcccctaatttgaaataatgggatattatataggtatattttacagcgtatccatgttaatgttgaatggggagtaagtaccttgactgccttcattgctcttttcttttattttgaactgttggattatgatatataaatagatgctagtaaagtccatattaatgcttgacgggaatctggggaagtgcacactgagtctctcagacccaccctcagttcgagtatggttgctacattatcagaagcttgcaaacaaaagaaaaccaagttgttaacttcaggcttatagattgcgagcaaattattgcaatattttgattttccaatcaacctacgaaaattatagagttctttgggtgttcattttccacttgatctaacacatttgttgaacatggcaatagcctcataaatgcaagtagtttgttcatggaaaaatgctatcagctcagctattgaagtttgtctttagacccctgttgtggtgtttagtatctctgtttatgttgcctgatgataggatcttgtaaattttatggttttgcaggtcacccagtcatgtgttgttacctacaaaacctgtagtccatttgtgttcttcgtttatcttttacttggagcgtcagatgatttgatggtttcttaattttcttttctgcagatgccgttcgtgaggaagtgtggtcgcaataagaaacccgtttccatccaaatgacgtctttgaaaattttatccttgaactaccgtgctttggtcatatgctttctgtttggttaaaagctcagatccagaaggtcttagagaggccgttctgtatttccgttcttgattttactgttctgtatggctgtaccacagaaggttttaataatcgcactgaggaattgcttgcgtcattaaaatttgaaaaccattccaattgttgtggtatacaaagcttgctagggcattttcggtgcaatattatgatgtgttctttagcgtgggttgggacgtggtacgtgaaacgagtgatggattagcgcactactctctccttcactcacaaattgatcatcatataacctcatgaatacggattttattggagtgcaattcatgcatcacaggaggagaatacgtgcatgctaagggtgtacttgtgcattatacgtgcatgctaagggtgtacttgtgcattatcttaatcaatgtaagtatgtatattgtacaaacattatatagaacattatataatgatcaatttggaataaagggagtattaattaagtattagcttaaaaattaaaaaatagataaatatgatttttttaaaagcaatttttttatatgaaagctttgttaaaatacatgccgtttggaaagcatgtgtggggaaatgagggagtaaaaattgaaaaggagaaaagaatacaccctagagccaccgtgtagggcatctatttgtcagcgcgtagtagattgaatgctctaagggcaagcacaatgttggctgtcgagttcacaccctccacattgttttagtgcaccggaggggaataaggcaggccgaccaaaaaataagtcacctataataatccccatgactattgcgtggctccttcccatgacttcttcattttttaaagtggtatatgagcttattcgatgggtgcgatctagtataaaaatcttggaaaactcgtgttccgatacacaaacttgtataggtgcttgctaggtgttggaactaattgtctggataaaaaaaagttgtagataaatttatgttgtttagcaccaagatgtgtttactaccccctccatttataaatgactagtgaacttgcacgtgcaaggcacattatcataatatatattattgccaactcgcaatgtgaatcgttggatgagaggatctgacggttaggaacgtgtgggtgtactaaatagaaaactggtgtttttttatattaatatagattgatatagatgtatgtaaagtttttaactctcaatccgcttttttatctcttcgataattaacgggaaatcccgcctaagatgaaagtagccatcagtgacggccaccttcttgaagttgatctccgccatcaagaagctgagccacttgctctttagctccgggcaatggtacctctcggcgtaggcgcgtagcctagagtcatcgccaccgtctccaccgacacactctcccacagcttctgtgcacacatcagcttcaacctctccaatgcgtacctgttcgccgccacgagcaagctctcgaaaaatccggtcgtcgtcgacgttgagccggcaccgcctcggtcggcgacggcaaggcgtccatgtacacgaagtgtagtagagctttgaacgtggccgggtcgatgttgtgcagggtgacgcacggcatggtggactccgccatggacccgaggagctccatcttgaacaccggcgagcgcgcggcgagcacggcgcggtgtgcatgaaacgtctcgctgccgacggagaacaacacgtccgagccgtcggcacggtccgcgatgtcgtcgagctggccgttgaggttcgaccgcgggatgggtatagtgccgtcgtcatcaccggcatataatatatatttaagaaaagtaaaaatagggggaaacagtgtgcgcaaggatatattcatacactgacttgagaaacatggcaaggctgtgtccacacgctgaatttagatacattccatgttcacgttcacaaaataatctggattttataaatacctagaaatccaaatcaattgttaagcatgaacttgtataatatgaatttagtatgaatttgtagagaataaattgtaaccttaaatggtaacaggagtatattgtttacacaacctgcaagggccaaggtcagacactaaactcagacaaaccttacatccattggtgaatttgtaaaatttcagtacttgagctataagaactcataactttaattagctcgcagcaaatcaaaacattgagcaacatgtagctatggtcatgtagttgtcagagggaatatagaactgagagatcaagcaatatgtaagtacaaacatgtgaatatcaaatattattctgacagggaaatatgcttaagtaatggtgtcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20953 - DNA, 2554 bp, Oryza sativa
ttcctgcagcccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcataaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgttttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacagtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatctaattagagtttttaccaatataataatatcattcatatatatgctaagaatatatatatattggaatttttattaattataagtcatatatttgcttattacgatttatccacttaatttattatagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtgaagatcttttctttactcccggttgttctcatcaaccgggagtaaagatcttttctttactcccg

SEQ ID NO: 20954 - DNA, 5458 bp, Oryza sativa
  unsure (1)..(5458): unsure at all n locations
aagagatctttactcccggttgttgagaacaaccgggagtaaagatccaggggtatatatattcccggtgcgcccttgtcttattcaccaacacttaacgttttcggccgatcgatctctctcggcctctctccttcccgccactgcctagggcaaatccccgcgccgacgccgccgtatctcgccgtcgtctcgagctcgtcgtcctcgccgccggctccgcctactccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccggcgccttcgccgccgagcgcgcaatgccgtcgtcgtcacgccacgccgacgncgccacgccacgccacgccaccagcggcacgccacgccgccgccgccacggccccacaacgccacgccgccgccgtagtcgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgacaacgatcgaacgaacgtgaacgagctagggaacgtgaacgagcgaacgaacgaggacgaacgttaacgtgaaatgcaatatatatatatatatacatgtatatatatatacatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaatcagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcatgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaactggcaatagccaattggccggaacgatcgaagttctggtactatgctcacggtggaacgctcaacccagctgatggctcactggtcttcggctatcagatacaagaggctgcgcgacgactaacagatgcagtggaggcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtgccaaggaaggttgataaacgcatggccgcacatcggtcccatgatccccagccgaccattcctcctgcaatggtgagcccgtcaggaaaccgtagcagctgcgcctcaacggggcaggtaggatcacagagcatggacgccatgcaaacaaaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaggggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgattcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgggtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatg

SEQ ID NO: 20955 - DNA, 522 bp, Oryza sativa
tatatatatatatatatatatatatatatatatatatatatatatatatatatttattatatatatatatatatatatatatatatatatatatatatatatataaaccatgcagcaacaggggcatgcaaaaaaagtcagctctatctttagtcccggttggtaacaccaaccgggactaaagatggctcagccacgtggattttttaaaatagggcaggtttcatagtgtccctggggacaggtgaatgcagtccattctatagactcttctgtcatttttacttgccaaaacccagcttttaagtcaaatttcgagaaatatttgctaccttgtatcctattaatccattcttgcttatttgggatattataggcatcttctatagtattatcatttagccttttataatttatgaccatcctagatttacctctaacttcttccgcatgatttcttactataaatgctgcagacctatgtggacttctactctctcttattgctcctagtttcagcag

SEQ ID NO: 20956 - DNA, 1701 bp, Oryza sativa
tccctaaccctaatttcctaaaaatgattagaaaaaaaaggtgaaaatgatatttataaatggataatctagtgggtcccgctattttttttaattcttttgttcacttattcgccatgtaggctgtctaataggatgctacttacctctacttaagtcttatactagtcactgcaaaactttaaatatattcgttgttagtagtcgaaatacaatattcgtagttattagtagttgaaaacttgaaatagaatacttaattcttatactactcaccgcaaaactttaaatatattcattgttagtagtcgaaatggaatattcgttgttagtagttgaaatagaatatttaattcttatactactcaccgcaaaactttaaatatattgattttcctataaaaaatggtttcttgcatcccctatacaacaaagaataacagatgcacggttgatatacctacaattgctttcagtgaattaatttaaatatctagttatctgtacaaacttaccgtctgtttttttttgtcaacagtggtgtgtttattaatgagaaatatttctatcttggcttgcgtggaaaagtggaggaccagtttaatcctaagaacaaatttgtggtacatactatttctgatatatatactatagcttgtttgctgcatgtggccttatatcctatttctgttgcaggtcaccattttaaccatgtttactctaataactctatattcaacaatcatccctatttctctttacgtgtccattgaggtattttgtccaacttctcatttaatgcaacctacatttggacttttggagctcatgctagctttggatgcagatgatcaaattcattcagtgcacacagttcattaacaatgatctgcatatgtaccatgctgagagcaacaccccagctttggcccgaacttctaatctgaacgaggaacttgggcaggtaacttgtaacattattatctgttggtttgaagagaacccaggtttttggtcactggaatgctactgtcttatactacacaaattgatctggctaatggaatggcacaacctcattgtagtaaatcactccgaaaattgggattgcttggggaatgtggttatttgacaatattgagtgagctgatcccacttaataaacatgtagaattgcttcatctattcaacatagatgcatccagtctagcatggttatgggagaccacttgaataaaactgctcataaatgcatatagtactggactaattctcatgggggcattctgatatatttcaacaattaaagataaatcaaacatttctgagttctgaaatatttcctcttaccctgaatttctgtcattaacacaatggctcaggttgaatatatattttctgacaaaactggaacacttacaagaaacttgatggaattctttaaatgttcgattgctggagagatatatggaactggcatcacagagatcgaaaaaggtggagctgagcgagctggaatcaagattgacggtgatgaggtattcaacatttttcttgtcctttaatagattatttgtgttactattcttattttcgctttattcacctcatcagggtaaaagatcaggtgctgcagtacacgagaaaggattcaactttgatgatgccagaatcatgtgtggtgcatggagaaatgaacct

SEQ ID NO: 20957 - DNA, 4487 bp, Oryza sativa
  unsure (1)..(4487): unsure at all n locations
aaattctgtgagatgaaattatagttctgtccttgacactactcaactaacagtacaagaaagcgtcaatcagtggtctgccgtttcccaaatggaaggcttgttctctattgcaaggtaataccgcggagaggggttggttcaacttcattctgtacatggttaacttgtttcactaacctgcatttttttttctaatagggcgctgacaatgtcgtttatgaaagattagctgatggcaataatgacattaaaaagatcagcagagaacatctagaacaatttggctctgctggcttgcgcacactttgcctcgcttatcgagatctcagcagggagcaatatgaaagctggaatgagaagtttattcaagctaaatcttctttacgtgatcgtgataagaagcttgatgaggcatgcatcttttggttattttatttgtatactgtggaaatgcccttttttattttctgagctcgtataatttgccacaatctggcctgttatcgttgcagtatgttttttcttatcaacactgtagaattactaataaactattgaggcctatccttttccttttaaattgcaaagtagcatgagccacaacctataatgtcaagtgtccgtctgcaatttagcaagttcttttcccttctttaatctaatttgttaacacttgctgctttgaacaagataatactactacttccaatatcttagctttgtttctttttatctaagagaactagaattttgaagttgtttattcttctattcctgggcaatattgtgatgcacttttttttttcatccctgtaggtggctgagttgattgaaaaagaccttgtattggtagggtgtactgctattgaggacaaactgcaagaaggggttcctgcctgcattcaaactctttctgcagctggcataaaaatttgggttttaacaggagataagatggaaacagcaattaatatagcatatggtgatatttttattcttaattatattgctcatgtcgtttcttcgattttttttcttgagattcttttcatattttcctgtctcatcttatatctaaatatatagaggatttgagttgattctctgctctgcagcctgcagcctggtgaacaatgatatgaaacaattcatcatcagctcggagacagatgtaattagagaggctgaagacagggtaagatgaacatatatcattgcactgtgaaattgcaagggcatgaaacattgtttttgagttggtttattttatctttattatgcttaagcgaccataagtggagactttaatggttgggtccagcctgaataactacatgatttttgatatgtcactggttatgagattgatatgtggtctcatgggtctaggacccacacgtgtgaggcatcagtttcatagaacatccaaagttatctatcggtacttaaggctttgtcttccaaagtacttaagaagtaggttatacaagttcacttgatgcctgggtttggtatatacgacattaggactttctttgggggagatatagcattgacccccttcctatatttcagaataaagagaatgatgtgatattctttaatagagttctgtggatcgcgttgctttagtgctttaatgtctccattgtattaacgtatgtcttgtgtacatctgtttttttttataattttgtttttacttggataaaaaaataattagctacattgcagcatctgattttgtattctaacttttgattctttttgctgaacctaactgtgccatttataataccggtcattttcagggagacccagtggaaattgcacgtgttataaaagaatcagtaaaacagagccttaaaagttaccatgaggaagcccgcggttctctaattagcacaccgggacaaaaattggcgctcattattgatgggagatgcttgatgtatgctctagacccaactctgcgtgtagatcttcttggtttgagtttaatttgccactcagttgtatgttgccgggtttctccattgcagaaagcacaggtaaatatcgtttcttgctgttattgttgttaattatgaatgccttccttcttcccagggaacagaacatgtcattttttatgttccgggttatctgtagttcttacctagatgctttccagagtgcttaagcaataaactgaagatatcggtataaggaaataatcattttttttctgacaaagtgtacttgaaaagatttgttatgttgttaatcatagtgcataagatgcttttattagtgccaactcaaatctcattcttatgtcctatttttagttgcacacattttatttcgttattaaccatcagcagtcttatctggtttgttatatttatttcttgcataacttatttggttagtacaatgctgaactgtaaacagctgacacttgctcatgttgtgtaggttgctagcttagttaagaaaggtgcccataagataactctcagtattggtgatggtgctaatgatgtgagtatgattcaagctgctcatgtggggattggcatcagtggacaagaaggaatgcaagctgttatggctagcgattttgccattgctcagtttcgatatcttaccgacttgctccttgtacatggaagatggtcatatttgagattgtgcaaggtatagtttagttctttgcagtgtagatttgtgtatagttcaagaaactgatgactgatgctttctgttgcaggttatcacatattttttctacaagaatctgacatttacgctaactcagttctggttcactttccaaactggtttttccggtcagcgattttatgatgactggttccagtccctttataatgtcattttcacggccctacctgtaattatggttggattgtttgataaggtatgtaacttgtattcatttctacttatggagtatactattctctgtgcattacacttaactgatccctttcaggatgtgagtgcgtctctgtcaaaaaaatatccgaagctttaccaggaaggaatcaggaatacattcttcaagtggagggtgatagcagtgtgggctttctttgccttctatcagtcgatagtgttctattacttcactgcagctgcaagtcggtatggtcatggttcatccggcaagattcttggtctttgggatgttagtacaatggctttcacctgtgttgtggtgactgtgaatctccgacttctaatgtcatgcaactctataacaagatggcactatatcagtgtagctggcagtataacagcctggtttatgttcatcttcatctactctgcaataatgacatcattcgacagacaggtgggatagttcatagattactgaaaaatccagtgctctggtatgactattttattcctataactgcattaacttcgtgctgttttctttctgcaggaaaatgtatattttgtgatttatgttttgatgagcacgtttttcttctacctcacactattgcttgttccaatcatcgctctctttggcgacttcttatatttatcgtaagataccctatctttgttatcacgttgccccttttgtttctcaatacttttctagctgtgagcctgtgactgacttattactagctcttccttgattcctccaattaaattgtgttggtttgagccttttgattttaaagcattccatggtataaacaaaacaactgaatataaaccatcctgatgtgcattatttgtctcagaattcaaaggtggttcttcccctatgactaccaagtaatccaggagatgcacagggatgaaccccacgagtacagcaggatacaacttccagagacaagccatctaagcccagaagaagcaaggagctatgcgatctccatgcttccccgagagagctcgaagcacaccgggttcgccttcgactccccgggatacgagtcgttctttgcatcgcagcaaggtgtcggtgtgccgcacaagccgtgggacgtagcgcggagagctagcatgaagcagcggcagaaaacgggaggatcataaccctagtagcgcccctaccttcctggccccccccattttgtgtaaagtttttgtacatcacatgcttttgctggcagaccacaggagagtgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20958 - DNA, 1087 bp, Oryza sativa
tcctgcagcccatttctccactagtgattgtttggattttctaattgactcgttcctcttcttgattacaagaactagtcaactgattgtaagttttgatcttatttggaaagttcttgtggctttctgtgtggatttctctgtgtgcgccttcgaagcctcaatgaatcgagaacagtactaggggaaagaaaaaagtttgattttcctttcttgttcttgttgctgccgtttcttgttgttgctggtcgtggctttgttgaacgcgtcgctgccatcgcagctgtcgggcgccacccttgcagaccaccgagaagccgctagtgaagcggactagggcgtgcggcgacggcggcagccaagaagcgcagatttggccactgacaccactgtcgcgttggccgtcgccagccaccgacgccctcctcctctcccgcctcgccccgccagcctcctccccacccgccgcacagagaagtgagagagggaggaggaagggagagaagtggggaaaagagataatgacgttgcaggtctcacgttgacttagccactacgtcggataaaaccgaggtcaaaaccactaaaggacctaaagcgtacgaccttgtaagttgagggacgtcaaatatctggttttacggttggagaacaattttgtaactcgatgacaagttgagggaccttcggcgtactttttccttatcttggtcccaaagctccgtgtgattccggcccaattagttgtggagtcattttttcttttcattttggggatatctctactacttaaaagttccgtagtggtggcggtgactccaaacacgcgaaatatagaacgtgggatagcctaatcgaacggctcagatcgcctttctcttcctacgcatccagcgcacgcgtctccctcgaatctcgatcgctctctcctctcccctaccctcaaccccccgatccacgccgccgcaaccccctcaaccgcccgcatccccgatccgttctctccctctttcctccttcctcaccgtcgctgccgtcctccccggcactcccatccctttctcctccatgccgcacccctccccat

SEQ ID NO: 20959 - DNA, 31060 bp, Oryza sativa
  unsure (1)..(31060): unsure at all n locations
acgggcgcgggcgctgccgatcccgagtcgagacgacgtcgtccgctgctgctgctccaccactgacggttgccctgcgtatatcctccctattatcgcggtccccatctgctcctgaatcctgatccacaaaaacagcggagcgccgtcggcctctctgcctccctgcgaccaccagtggcatctgccccgccgtcggctcttcctcacccgcgactcgccgacgatggtgctccacaaaccattcaggccgtcactggtctccggagcgcccgaggccgacgtgtctcgcactccctataatcttgctttgctgcatcagtaacaacatcataacatatcgtggttcatacaatggatcaggctggtaattcgattccaattcttgctcctgaacttttttattggtgattccctctaatgttcagcagattgggtttggtggtggcagtgccgcaccactgatttgtgttagacattggtccttatccaaccctctaatctcttgattatgctcacttacgatgacttcagctcaggtggttgcaagaaacactcctagactgctatttagttttacgttacagggatttggctacagatagttgcaagctgcaatgttctgatatttgttatgttttagagcaagatctgccttatatataatgttataattaggcttcgaatttcttgcttatgttctttaaaaattccaagtaaccttttcagttctttctgtcaggttaattgacagatcgagttgcacttacacatatcttgttttaggaaatgctccaatggcccttgaatccagcaaagtaagtattttttttatgcttgatctgtgactgatctcaaacagataaattgaaatgagtaacttgtacacagataaaaaagtgacatgggacttgattagagttacggtatttttatcttacgaggcggcaacattatttgagttttatgagtcaaatattcttccattttttcctgtcatttggttgtgtcaagtcattatttgagttttattgggtaaattgtgtcctgactggccctgagttggatgcagtgcttaattggtgcaaaaactgggcttaagttgcagtcaatttccagtcatgtgtttgaaaccattgttttctgattactttaattaaataatccatgatcacaatataaaccatatgtgcaaatatccagtcatgtgtcgtgtgcatgatcagatgactgctattggctataatgcagtgattctgaaattgctatttgccgaggtttcctatttttgctgaactgctgcagcagaatagtgccaccaaatgaaagtgaacacgtaagcatattgtttgggagaagatcacagttcggaatttcagattataaccaagataaagaatcactcaactttatgatcgacttgctattcatgtttattactccctcctttcctaaatgtttgacgccgttgacttttttaaacatgtttgaccgttcgtcttattcaaaaacttttatgaaatgtgtaaaactatatgtatacataaaagtatatttaacaataaatcaaatgataggaaaagattaataattaactaaaattttttaataacacgaacggtcaaacatttttaanaaagtcaacgggtcaaatattttggatggagggagtataaaatagttcctactgaacattgtcggctacttgttgattctttttaggtggtgtttgttcctctgcacaaataggtctgcacatgcacatgcgatttctcttacagttattttggtgctttaaaatgctttacgtattggtaatattagagcctagaggtcaaaaactattttgtatagagaaaattatcccacatagccatctgttgtttattcaagaaatattatatgtatcttcaggggaaccatatgtgatacacaaattcaattttatgtccattgttagagaatccatttgcttgaatcaaaattagagaatcatatatctgatggaaaattgtctttttaccaatatgtttgccttgcagattggtagttcctctcgtcctccaggcaccagctatagacaatatctatacctcaaggaagcctcttcatgttcccctcaatatttctttctgggtgcatgcactctatgcttgctatgcaaaacccaatgtatgtgaatgtgatccttatgctgcaaaggtgctactataaacacttcgttcttttatctatttatttaaacattctttgttggtgtcggtgcattgcctctgaattttagatcttttttagtgcaaaatgcatatgaatgtgtggcattgatattcccttggagatgaaacaaggtattcagtgtttgcaaattaacatttacgagtaggatttacctagctagcatggcctctttcatagccacttttgcatgtatgaatctttgtaaattgtggtcctataggcaaatagaaaggtaaaattacgtgatcaactcgagctctttttcatatttgtgccactcatatttgtcctaagttttaactgtattttaatttaatcttaaattcaggccaactactcttgcggatgttatttaataaatttggatgtgattgtactgcaagttaatctagaaattcatttccctgttttcataacaacaaaacttttaaagatgatatccctttattgtcattcaagtcagcattaagcttgctggttgaaaatttgaagtttttttaattcattctgaagtatgaagtagtatagaactttctgattttctattggtgtttagctcttaattgttgttttatctgagaattcactgctgactgctagcttaaccatctcaataaagctgatgaagacaaggtgctcgatattcagacgatattggtcaagtataacatatttcatattgaccagtgagaagcatccggaagaagtaaacgaatgagcattgagttccagaaaatggtgtatagtatagatggaattatgaaaagcaatcaacctcatgttttatgtatagtttttattattttgtgaaaggatggtagtgtcaatacgtagagtttttattaatttgtgaaaggatggtagtgtcaatatttagttccagaaaatggtgtattgtatagttggagttagcaagagtaatcgtctagctcatggttttgggaaaggattttggtgttaactattttttcgatcagattatcaaattcaaaactacaagtattttcacccgaatgttgttcgtgaacccgtgaactttattagcttcaaatgtttttattttctgatacaactcacatgctattttattcaccaactttcgttgtttgtagatttgtattactaccatatgaaaactataaacatgtgatataattattattcgtgctatattaaaatttttattataaaggaattacacttaataattatttaacattatcttactgtgtgcttttaaattggtttataacttttacccgttgcaacgcacgggcatctaactagtcaatataaaagttgatgtagacaatatttatataagttccataagaaatctatcaaatccagtgttttaattcgttatagtaattacttaattaattgcatggtaatgtaccaagcttttttttccctttattttttctatggtataggtgaggatataataggcattttaattctactatgcatgcgactatgaaatgccatgtgtacgtacgtgatattctttttacagagaactactgaactttaacaacttattacattcgtcctaaaatatgagcattttagctatgtatctatagataattatttatttagattttgtagctaaaaatatttatattttaaaactgaggaagcacttaattaaccctataacgaaagtgttcgcccgataatgaatgtaaatacgtaatagtacacgtataaatacatactccgtatatagtacatactactcctacttagatacacgcatgccggagtgttactcgtctactcgatacgtctcacatcatatccgtcaagcctgggccacacgatctgcccccgcgccccatctggacggacagaatgtgagcacgtacacctccgcgtagcacctcgccgccgccgtgtcgtacgggtagctgacgtacgccgggcacgcgtcccggaacacccgcgagtacgcgctgccgcggcacgtctccgccgtgccgtgcgcgccgcggcagcagaacgcgtccgtcccgaacgccacgcacgcgctcttgcacgccaccaccgccgccgccgccgtcacctgcagctccggcgggcacaccgcgttgacgttcttggcgcagccggggatgacgcacttgcgatcggcggcggcggcgccgggggtggggggcttcgtccacacggccaccggcaggttgtagccgtcgacgaggctgacgtcgtaggagctccccttgctctggtcctcgtggaggtccacctcgacgagggtggccggaggggcgccggcggtgccgttgcacgcgaggcggccgccgcagtcgccggtgaggcaggacgcggcggcgttgccgtggtggttggtggcggtggaggtgaagttgcagccggtgcggccccagaagcggccgttccaggtgggcggcgcgctgacgcgcctggactggcccggcgggaggaggaagccgccgccggcgagcaccgggtggccggcgttgggcgccgccgccggccacaccgggaacgggcacttgttcaccacgcggaaggtgacgccgcgcacgagcgccaccggtcctgatcatcatccacagcagcacaacaaaattcatggaaattaccaatgctgaaaagtaaattttgccaaaagaaaaagaacgtaggtgggtgtgatttacggtatccatttcatattaaaagaacgtaggttttattctctctctttaacagagtttataaaaatagctagcaatttcagtttcaaataaatcagacatattttattgtagattttaatggaactaatttaatatacaaaagccatggatgtgatctacttcctccgttttacaataagttcaattttcctattctccacatatcaattaaaacctaaaagactaaaatatcttcactttatcaaatcctgatacaattattttttgctttatctactcttaatgtatccatctcctaattttacaaactccaatataataatgactaaaaataaatttatttatgataaatcggagggttgaaaagtaaacttattctagaacgaaggagtacctaagagagtaatgagcaggagtagtggtaggggatgaacgccggagagcaaggataagcacgccatctgtgtctaaatctatatagcaaaccagagaaactaactaagctgtcatggagatggtgcagtcgcagagagtaaacaagggtttttataccctgcaagagtctgcaaatacaatgatgccatggctaaggagatagctaagatcaatgagcaatgtgccatgtgtgtgtgtgtgtgtgtgacttgcattgcaatggaagcaaaggaagacatgatttggggtagcaggccagcagccacacctggtgcaggcctgagggcaaaaaggttgagtggtgaggtaggtaaaaaaaaaggatttaaaatggatgtgccacaccacaacttgaaaactgaatttaaaatactgctagttcattgaatttcatcagcccattttggtcatttgggcatgcatcttcccttgaaaacattataggagtactttctattttagactttgagcacagatacacaattatgtctaagcagaatttatcggcccagttgactggcagggttgctgggccttctagcctcgcccaatcacttgacagcttgagctaggatggcttatcctggccggccgacggtcgatacagagagcttctacttcaaaattcttattccagtaaggcagtgtttggcaaatgtctaaggcaaatgatttcctacccatcttaaatcctaaccattcattctctctcacccatttaatcctaacattttatttatttcccaatctcaatcccacccctcatttcacattatccaaacacaccaaagttgaaattgcacctcttgtaactgcgttcggcagcaggtgaaagagaagatttctctctcgtttgtcacgtgcacacttcctgaactattaaatggtatgttttttaaaactttttaataggaaagttgctttaaaaatcatattaatctatttttgcaatttaaaatagttaatactcaattaaccatgcactaatggctcatctcgttttgcgtatattctcaatcttatcttttcctctcctctcaaacatataaaacggaaaatgcactttgaggatcagctatataccaaccctggaattgagctatctttgatagtaataggtcttaaccgtacctttctcttttttacgtgtacgcttcccaaattactaaacggtatgtattctataaaaaatttgctttaaaaaccacattaatttactttttaagtaatacttaattaattatgtgctaatatgtcaccctattttctacatgtataatataaagaagtataaagaagcatgtcagcctgtcaggtgctgtgctatgttgctgaccacattcctctcgaacagagcaagcacagcgaacagaggaggtgaatcccacaactctgaacaatcccgtcgtcttccaacagcgtctcgtccatctgttccaaccgccttttcttttttcaaatggtttttaattggaaaatggatttgccacatgattcacgatcagtaaacgctttcagccttttcatcttacaattgagtactccatcaatttaaaaaccatttgaaatgtcgtaggagataatataccgtcgtacagtatataccgtcgtgctccatcaattccatctccacgtgttattgtctagtatcaatacagcataatgtcgtaggcgataattaatcagagtatcatgcacataagtaaaatacaaatacatgttcctttcgttttatattataattcgttttgacttttttcttagtaaaacttttatgtttgatcaagtttatgaaaaatgtaatggtattcctaacacgaaataaatatattattaaaatatattcaatgttagattaaataaagtttcaaatgttgccaaaattttctaataaacccaatcaaaatttaaaaaattgacaaaaaaaatcaaaatgacttataatatgaaacagaggcagtacaccaaatgcccgttgtgatcctaccccgaagtagcctacaggctacagtctcagagacagggttcaccaaactgttctcaagccaaaacagggttaaaccttttctttttctcgcaaaaatcgtcaactgtttgactcggcaaaaatccagttatatttttctgaagttataaaatttagtttggttaaaggtaaaattgtataaacgatcctaattataaaccttgttttaagattatacttattatattttattttcagcaaaaatcctacccgccgaacgctacctggataaaattggtcttcccccttcccgtgcggatgagtcattgattgggctaatctatatctatactaatataaaaaggatgagttacctccctccaatcctacatgttgatagatgtaatccctaccgtccatctgtagatcgctgatccataccgtcctccgcgatttaaccatctccatctccaccgcagaaatttctccctctacgcgcaaagaccgtgcgaagactacgcctcaccctctatatgcgcgactccaccgctaccgccgccagagccaagttcttctccatccgcctccggagtcgtgctcctcgctcctcctcctcgcgtgtactgctgctgtgctggagccgtggtcttccccatacgacgtcatctccagtcgccgtcggagccgaggtcgtccccttccgtctccgccactatcgcacagcaccgctgccccccccccccacccccctggagacgagttcttctccagctaccgctggagccgtgctccacgctcctcctcgcgtgtattgctgccgccgccggagccctggtcttccccagtccgtcgccggagccgaggccccccccccctcttcccctgccctcgaagctgaggtcttcccatccggcgacgccactgcagtccaccgctgcgctcaacggagccgaggtcatcctcatttcacatattaatttgtagtagtacatagctaatgtggcaagcagttgtggcaggctgcagcgttgtggcgcagcgccgtagtgacgagcagacgcggcaaccgggcgacgaggagcgagcagcaggaggtgagggcgaggagctagcagatcaggccatccctccatgaagggcatcagacgacgaggggcaagcagcagcagctagcagagcaagcggtgagtcctagcccggtgccggtgttcatactcttcgtctctgtttcagtaatgcatctagatgatgtgatttataagaattgagcttcgcgattcatagttttgatttattcgtagattttcgatggagaagaaaacaatgttgttaaattattatgcaagcaattcaagtagtaccaatcaaactgatgagaacagaatggaatttttgctgattgtgcacaaaataagaataacaataggtaagttttgtcacgaaatgagagatgaaataaggatggtatatttgttggtaaggttataagatcatttcaaaagaattggttagataaatttaattggttagaatatagtgtcaaaaaagactctgcatgttgtttctattgttttctttttaagatataaatacaaacccataaattaacttggttcttttaggtcgaacctaccctctatttctatcctgtatttgccactgacgcccttggaacaccactgccctgatttcatccactcttggctccatttggaatctggccatcgtcctgcaccctgcttcccattttcaaatcaacttcagcacccacattctcctggaaggtatgactttttttttcctattagcactagaagtgaaagcattgaggtaaagactaatttgaatgtccaatgaaaatttcttctacccgtgaaatgtatgtcaatctgtggaccggtgattgagtggtttcatgttaggctcaacagaattatatgaaggccattgagagtaatttattaaatcctttttgaggaaatatgaacatgggcaacaagacctatataggacactaaatttcttacttctgaccttacatgttaactgatttgcatgaacttgctaggaagggggggggggggggtttcaactgacacacaggtcatatcatttgtttataatgcataactaaaaaaaattcctcttgtcagcagaagtgtatagttctttgaagttgaaaaattcaatcccatttttgaatggttttcacatgcatactctgctaagctacttttctgtaagaaactaagtataactttgtaaacatgcgtaacggagtataaagttcatactttgttgaaaatgccctttgtgccactgtgtcaattgaaaaacatgaaaatgtgcaggtttttgtcctgctcaggaagggggtgtcgccaaagtgaattcaagacagctagcattcaatactttacacaagatccaggagccaccagcaatgcaagtggttgtcttactggtactgtacattttcttcaatagaatatagttgaaatgtagtattggggttctggtattaatgttctgtgatcagtatttgcaatgtattggagttgaaagatgcaccttctgttgtagcaggagtaaaaaaatgctggaatgtaagtgaatgttacatgtacatatgtgcaaacaatcatgaccattactaacttatttgttctttctgcaggtatgttgtgatgatcccagagtccaaggttggatgcttcatatcataaaggagttgtccatgtatttaggtaccatttgttaatatcatgacggccatggtaaagttcataatatgtcaatgtatatagttcattccctatcgttattttacttttcctttgagctgaaatattgcccatggggttagctcatttgtgtggcattggtggtatattctgattgaaatttataattggttgatgtactaaagagccaaaaagctaccctagacctttaactgttaaccttgtatagatttggaaatatattggcaaggactcatgtgacttcactatatcatgctatttatgttgctgattaaaattaaattgaggtgtatcactgtggcaattaagctaagagtaatcagattcctaatgttttgagtttacaacctttttcctttcatcgtgaaggctgcaatttatttcagtaagatacaatgtttctgctttgaggatcaaacccttcttccaatgcaaagaagaaaaagggaaattcagccaatgtgcaggtatagcaggaacaaatgtgtaaatattagatgccttgcccatacaatctctttgagatgtagctgttggtactttcttatgttccatggtgccagtggtatgttctgcaacttgagcaaacacgattttcctttttttttcttctcttctttcacagttgctaatagtcattttctgcacaaagttttaattgcaggctactcaagaacctaagaagttctgtcatgaagctgttgtttttctggagtcccttttggtaacatctattagaggacacttgggacctcacctataaaaaacaagtaaattttgaccattgcttcatattaagtgaatatcctctttatatataccaatgatcaattttggagctcaggaaaatggaaccatggcttcatttccttaaaaagtgcatcggttgaatccacagtgtatattctgcaagttataagcaaggattttgatgctccttatttcttccctgaaaatttcaagtaaagatgtgttttttggaattttgaatatttgcattgtgctgatgacttctaattactaacgatgtaattcataaattttatctatcagcatatgcttgcttagccggtttgttattctttttatttggatatacgtagtttgcttgaaaaatttgatggggctaaaagattatttggtttctcaggaagatgcttgatgctaatgtcttctcgagctttcagattgtaaggtacttttcatgtttttttaaaccagtactgctatccatgttttaaatccttttcatcatcattgtggatatattatttatttgtagcttcacaagaaaaagagtgtggctgtggactccaggattacattgaatcttgaaaaggtatgcactattccaatttcagatgatgcatttccctgatttgagatgtttccttttttccaatctaacaaaggaaacctttccttgagggaattccatgaaatatattggtttccagatttcaagattgttaggtcatttcgtggctgccacttcaactgtaggtgtgtgcatagtttagcaatatgacctctttagattaatattgtggtgaaggaaaatatataggcgttttgacaactgttagtgtttctgaaatgttcacacttgctatctactttttacttcaattaaggcaactatgaacaatatttttttttggaattatgtgatgaccatttcctgcaagtgaaatggatgtaaatttgtgttttgtagaccacatgaacttatgtggacacacggtaggacctgtaggacctatatacatctcattggtgatcatgtaaatgctatttttaattgctggccatgaggggtatatttgaagtattgttggagaaaacataaagtccttttttactccctccgctccattttaagtgtaaccatgagtttccgtgcccaacttggatcgtatgtcttatttgaaatttttttataattagtatttttattattatgagatgataaaacatgaaattatgtgtgacttatgtttttattttttttcaaaaaattctcaaataatacgaacgattaaagttgggcacgaaaaatcatggttgcacttaaaatgagacagagggagtattagatattgtatgctgtgggtactggggtttaattcaatagcactaagaaaaatatcttgctttgagcttttcaagtttttatcaagctatggcaaattatggttggtattgttagctgctttgcattttttttagtgtttaaaggagtatgttaagttactataataacttttagtatgtttgtatattttgtgtgacatatattacatgaaaagtgcaaaaaaatttaagtgttttatattatcactatagctaatgtgggaaacgtgcattgcgattactagtttcttctaatgtcgatccacgagggccatatcaggcaggtcaagcttgtccagcgtggttatgtgatgagtccaactagaacttgtcatcacctaagaatgatgttgcttacaactcatagcaagcaagtccttcacctaatatcgagtcaaaaaaaatagcctaagagctctctcgagtcgggctcaccttataggcacactggacgggcctaacctaggtgatatgacccgctgcgaatctacgtcaaaagaaatgggacaaattaacttcttttttgaacgactcgcacgagacggtgcgaagttctattgatagagcaggaaaaaattacaagattacaaccctggaggatcataaccagcaaaaagaaaaaaaataccaccgcccacacaccgacagcgccaacacacacacacacccgggagaaggctagcaccgaaccggccgccgctaagcgtgaccgaccgccgctagaccaacaaaggaacatagacgagatcgccccctagaggatgccaaaatgatgtcttcaggaagagaagcgacggaagaaccgccgccgccatccgtcagggctcaaagaagtcaagactgggcttttgccagacaaccgcccttgaggggtgagacagcacgacaacgccctcaggagggggaatgaaccatcattgtcggttcagctacagccgagctgggttttcacctgccgctcaccacctgcgaatccacggctgacgcaccgatgctccaccatcactcaagctctgccgacatgtgggacccctgcaccggcgtccctcgccggtcagccttggtgcgtcgaagaccgcaccacacccaccggcagctcctcctcacaccgaggtcacctcccccaccgtcggctacgcctctcgcgccaagccggcctcctccaccggatgcacctctcgcgccaatccggcctccctccatcggccgcgcctctcgcgccaagccgtcctccgtcgccgtcggcagcgcctctcgcgccgtgccggcctcctccaccggacgcgcctctcgcgccaatccggtctcctgtcatcggctgcgactctctgtgccaagctgacccccgaccctcctccgatcgctgctgcgccgtccaggtgcgctcgtcttccacgcccctggctagccgtcgaagaccgccatgcctcccaccgtcacgcctccacttgctgccgccgtcgatcatctatacgacgccgccagacgttgtcgcatccgccaatgtccccggccgccagacgctgcctccacagccgcggcagctacgagccagccgccgtctccaactgtccgtagccagccgttgtcgccgcaagccgccgcctcgtcgccaaccgccacagcagttcaacggaggggatccggtctcccgccgcagcaggccgacaccgcgtgcagccgccacgacaggtgcggctgcttgagccgctgccgcatggtccctgccgcggctgcctcgaccgtcgctgtcttcgccaaccaccgcagcagctgcctcagccgtcaccgtcgccaccagccagcgcagtcgtcgccgtcgccaaccgccgtagcagctgcctcagctgtcgccgtcgtcaccagccaccgcagacgccgccggcaccgcagccgccgccgccaccgcagccacctccagcgccagccgaccgatcagatctggccacggccaccgcctgccactgcagacatggccatgccgctgcctcctccgccacgccgccactccagccaccgacactgccacctccgcgccgcccactcgccgtccccggcagtccgccgcccggagcaacaaatccagccatggggggggggggtcggatccatgcatcccagcgccggatctggacgccgccgtcggtttctcctcggcgccggcgccttgccctgagctccgtcttgccggcgccctaaccagcttgactgcgagcgagggaagagagccccgccgccgccgtccttgcagccgcctggctttgccggcggtggctcgggcagcggcgaggtgggggaggggaggagggggtcgggagcggcgcggcctgtttcgctgcccgcgtcgcccccgaaggcggagcgaccgagcgttaaagtgggccgacaaattaacttctcatatgcgcaaaggaaacaatttcgactggataacgttgggtgggtgagttcttgcaataaaataggttataaggtgaaatctcaaaactaagatgataattagaatggtcatgcaattttgccataattgatgactggtttgtgttctcgaaccggtctaaaaagttcagttctcgttcagttctagttggatgagccgctggcagttgtcatcatcgtcgtcgtcctcttcctcctcctcctcgaagtagccattaacaacaacagtctacctatccatagcgttgggtggactactgccatgacccttttttttttccctttcgacattcagattagctagcagcagccactacacagctacactgtagtactgtaccactgttcctccttctactgcatgtggggccactgcacttcgcagctgaagaagaagaagaagcagcagcagaagatgaagccacatccgccaacaacccaaaagctccaggagttaatggcagatcgaccagtgcttttttcttcctcgtgttttcttttcccgtttcttataattaatcgtgcgatcgtaagattttttttccgattttttcttaaaaattgtaccaagtttttttccttttaaatgaaaacgaatacttgttattctcttttgaggtgtaccaaaagaaatattaatggcagatcgatcagatcggctggtggtagtggcggagtcaccgtctggctagtccggacagccgctcgggctcatcgacgaaagctccgttaaattttaatgttaatgattaaattgatggtttgaaatttctatagcaaatagcactactagttatatcgaaatttatctggacataaaaatctttttggctccacaactaaccggtggtgacacacatccataccataagtatcagatactacctctgtcctatataaattgtaattctaggttgtttagtaatatattaaggtttaagaagaaatactatgatgtcccttattaaatggcttatagctgagagtggaagggtggttgagggtaaaatgggaaaaaaaattgaattacaagtgattaatggaacaattagtactctattgtgataattattttaggatttgaaatacaattattatgggacagacgtaatagaagaggagagagaggaataataagaggatcagaatggaagggaatggagtggtgcagaagtggggatggaagacaaaggctaagcttgtgtggccgcatccagcgattccccagcgattccgacaaccaccagcaacagcatggctgattgcccgtacggtcgatcgcctcgcggatgctcggcctaaacagttgtgatcaccaacatcactgttgatttctgaccccaatcagtccatctctcctaatgatttttttactgtttcctaatgatgtcgaaatgtacatcaacttttaagacattcgacgtggttgattttcgacataacatttgatgctccgttttattaaaaaaaaataagtgtcattataacttgttttatagcagacgtactttaagcgtggtttatacttttttatatttgcactaaaattttaaataagacgaatgattgaacactaaaatcgatatcgtttatttttaaatggatggagtaatttaatttaaatgtatttgactgctggcatttcaaaatgtcacttactttttttacttatttataacaataatattgactatttcaaatttattttttgaaaacagaatggctacttttgttaccttaaacatagtttcaatgtactataactttcttgcatctttttttataggtttcatactagtaattagaaataaaaaggtgtcctcgtgactgtgccgttatctaaaacaccatttatttgtgattagagggagtcggaagaaagagaagtcgatctaattatactccataaataccaaaatgatcagcttggcttatttggaaacgaaaacagtcccaaactatttcacttgagcaattaatctcctaaataattttttggctcattttatacctcaaactattggaatggttcaacttaacacacgcacgcaaaccctatccctatgagcatcttcgaagattgggccagcaaatccatcctggagattgacgaagtcaccacaggcgcctcactgtcgacggttacgtcgcctaccactgaaagcacaaagccgttaaatcctggaaaattcactcccattgggagtcgaacccaggacctatggtgctactgaggctcttataaccactaggttacaggctctttcgttactcttaatggtatttctctcttctctctatataagtcatattttgtattaaaatttggtagaattgaagatgcgttatagtttacctctcaatattctttagaaaaaaattatcattgtttacgtaggttgaaaacactgtgactaatttaaacatgaaagttttaaatttcaagcaaatactcatgaaaacattttagaactttgataatgatatcatttatagcttaaaaagtttcagcttaaaatacaagagtgaaccatttctaatagtttagggataaaatgaagaaaaaaatagtttaagtattaagtgctttaggggagtaaaatgattttcttttctttggaaaaaatgccaccttgcataggaaaaatgatttagcaaggaaaggaatattggttgaggctaatatgtacttcggaaaaaaaaagtaacggaggagagaaacatcgatagtaagatattatcatcgatagtaagatattatcgactcttagcaaaacaacaaaaaaggaattttgttccttaaggacagggaaattaatgaatgataaggaaaggttttttctcttggtgaaatgaaggctaaagtatttatcagagtgaattacactttaggctaccttttattgctatagtttcaccttaatcacctataatccaatcattttttactttggactagctaaatttatatttgtttgctttggatcacccaaaaccacttctttagcacatcaacaacatcgaggacgttggctatggcacgctggcaaaatcatccacctatgaacatgccatacctttgtcggagtataggatggacatggctagtgaagagagtcgaagtagtccaaaagtacaacaaacgtaaagttagctactttaaagtgaaaagatcagagtaggggtgttcaaagtgaaactacaaattcaattcactctatttattatctcaattgttccaagaaaataataaacagcatgtattgcttataaaactgtatgaagtataactgctgtactcgttctactcatgctctataacttggtacaagacattccaaaataaatccacctatgagtataccattaactttgctagagtataggataaacgtgactagtgaagagagtcgagtgaagagagtcgagataatccaaagtacaataaaccttaaaaagattagagtaaaggtgtccaaagtaaaactaaaaaataaaatatgacccaaaatataattcactctatttattatctgaactgttccaagaaaataatctctaaacaacatatattgcttataaaactgtatgaaacacaaccgttgtactcgctctaactcccaccctataacttagtactggaatggaggacacacttgtaatggggttattattggacaagacattccaaaataaatccacctcccgtataaatgcccgaacatttttcttgggggaaaacagatcatatacatgcccaaactttattgatccagcctgtttttacgagtctcctccatttcttagagcaaggataataatagagctcactttctactattagctaattttaaagccaacacatataataaattagctataaggttggctacaattttttctcctctctctatctctcacttatacattaattgtatttgtcttgaagcttgcatgagagccaacacccttaattttttttgttacatctctcctccacataagcttatagtaggcttatagatcattattatacttgctcttagggcacccgctatggttatctataggctctctacaagagatccatgtcagcatattttcctacttggaagatattaaataaagagagagagcaaaactatctaataacctggagatagtctatagagaaaaacgatgcaatgcattagagagctatagatacccatgtaggcgtactattgaggtggtttactattaatctagtctattgctgagttgtacatgttttatagagaacaccttctcttactgccgtggtagtacttgtcagatgaacagagagacatttaatttcgatcaccgtcaattatgacttatctccaccacaattaacgccaaatttctcaattaatcagtgtgcgacgacgtagtagcttctaaactgttgctgtgacacgcgtcgcactgttgccatgacggcgttaattaggcgcccataatcccaatgattgagaaacgaatgaatgatatgattcggcaatataattaatcgctgatgggcacggtcggacatatggccccgtttgagggattatctagtagcttctccgagaaccccaaaattctcacaaacattatatttcatattattacccagattatgataatataattttcttccgtttcatattataagtcgttttgatttttttcaaacatctttacgtttatcaaagtttgtagaaaaatttagcaacatctataacactgaattaattttactataaatttaatcaaaattaaaaaagtttgattaagaaagaagtcaaaacagaaggagcatataactataatatctcaaaaaaatgaaatctaaattacaaaccagtctgaaacctgtcttttttagatttttaaaaactagctatgaactaattgtttctcataataaaaaacaagtaaatattagaaaatgatttaatattaaataattagaaaggatgaggttttaaatccagattatctaacactagctgaaagaccctgaacgtttctcactgtttctcctaatcatatgattcatatgtagtatcgcgtctatatttcgaacagttcagaaaaaaaaaatagaacagtgccggggctctggtattttcggctcctaccagtcgcggccaataattcgtcgtgcaacggctatcaccatcacacacacacacacatacaggggtatctaatatatcgtgttcggagtgatttgtcgtcggttcttttccgtttaattaagcatggtgtcgatcgaaatcatcaaagagttggtgccattaattttggacccccaaactatatcggcaagtaccttcttctgctaggtactgatgattgtttgtatatatctccacattggaattgaacgaaaataatttttttttggaccagtaccatcgatctgatatattattgcatataaaatttacaaacagtcatgttctatggttcaagtcatataaaactctagaactgggagattttagaaaaaaacttattattacctatcattaggaatgattgagcaaattaatttcagaaaatcccgctgtggttgaagttgaagaatctgtttttttttacatattccaatatgtttttccccatatttatgtatgttttgaagttcgagagcgtacatgttctataatatctatacatttaagaataaagtgcataattagattgcttacaactaaggaaaactatgaatatatacatgcaccaatcgatagagccttttcaaaacttttttaaccaaacacatgcatataattttactcccaaaaatcaggagagcaggcctccggaacccctccttgatcttgcaccgagaggaggagacaaatcagattttgggggagcacatcgcgtaactacaactacgtcgactgctttcccttcatcgtggctggtggcgagaatagggatgtcaacaataagagtgggaatgggaatggcaacggcaacggttctctttccactaccatcgcaaccactattgtaggaccctatgttattctcctcttctatttctttctgttgattctgcttttatgcaaaaataagttatatatatatatatatatatatatatatatatatatatatatatatatatatatatatatatatatatatatatatgtttgtttccatggtttacacctatagcatgtcttttttttatccttattgttgagaataatccgtttatggctaacgctatcatggtttatgtttacatcgttatgatttgttttattattttctagatcaaatactatggtaaattgcttatattgtcaacagacgatgcccgggagaggccaaggtgattctggagcatgggcaagagagctactgcttacatgcatacacgtgtacgatctagatgccgcctaggcccatgcccgtccctgggcatgtgcgagctgcgagatcgcacaggccccccaaaaaatagggtctttaatttaaaccaatatgttccgatatacttaggacatccacaatgtgaccataagagtgagccttaagactttttttcagctatatacattgtggatagggacataaggcattaaatgctaaaaaacagctctaagcttatagttgaacttaagagattaaaaaatgatatctaatggagcctatcagcatatggttgcgaattggtggtatgtttcttctttaatgggatccagtgggacccggcttgttttttatccaaggccataaccattgtagagatagatatagctaaagctatctgcacataggctcacccctatcgctcattcagcaacccaacattgaggttgcccttagggtctttcggatggaacgagttattttcttcacagctccgacaagtattcgatggtaaacataactacatccaagaactatattttgtgacgacgctatcaacgtgcattctagacaataaggattcttttttttttatttagtaagaaaaaccgaattgttacgatgattcttcttttacttagccagaacactaatatctatgtgggtgagtttgttgacatcactccagttattattggtcacaaacttgtttgataaataaaggactactaaactaatggtaccttttcctgatatagttataaagaaggtaaaacagatcaaacaaaaatcggtgatattagaaatccgttccaacatatttcacacagaagccctatagctgagtttgggaggacatagaaaacaaaacaaataattagcacggaattaattaagtactagataaaaaaatcttaataaataaattaatatgattttttaaaacaacttttatatagaaatttttgtaaaaaaatatatacagccttattagtttgaaaagtatatacgcaaaagaaaaatgaagaaggtaggttgggaaagaagcgagaattgttaggaacagttcgtgccgaggccactggaacatgggttgtcagcaaaatggtgcccgtacgtcctgatagatggatggaaccggcgatgaaaagctcgagctaccaaagcgcgtaagtactgaaatttaactcccggcgctgccgcagctgcttgacgattaagccgggcgctttccctcattgattacgtactccggctgtgtttaagtttccttcaaactttcaaaaattccatcacatggaatatttgtacacatgcattgagtattaaatatggacaaaaaaacaaccaattacacggtttacatgtaaattccgagacgaatcttttaaatctaattacatcatgatttgacaatatggtgctacagtaaacatttgctaatgacggattaattaggtttaataaattcgtctcgcagtttacaggtaaaatctgtaatttgtttttgttattagactacttttaatacttaaaatacgtgttcatatacaataaaaaaaatttagagaaggaactaaacacggcctccgtcgcctaactgtagcgccatttatcgatcactcaatcagcaatgcatatgaaatgtgcaatgcaagcatatgcacgaaactcgtattaatttttccccatactgacacaaaaaggaaatgtacgaacacgtaagtccagggcccacaaaccagcagcaggtggatccatcctggtgctccttaatttggttgggcccacatttttaacttttttttagatggaatgaactagaagaaatgttttcatgcaaaagttaagcaagttcaatggattcatgtgtgtaagctgtaggtggtcatcagaattaatttgtttataatgatgtgtggaatgatgcattaatcgactgctcaaacacgtacgtcgtcaggatgtggtgttccgccctgtgcacttacagacatgtcaccggctgctcgttgacttgtaagctggaattcttattatttttaaaccttttaaattttaaaacaaatcctcccaagacttaacttttattttaaactttttggccacgtcacctgggttagcgcaacaaaacaacacagcctcgccacccacagtgaacgtgtcgatgttatcttgtcatgtcacaggaggttagcatggaagtgttgtttggccacgtatcagtacggttaaaaggttcacatttagaaataagtttatgttagtttatttttaaaataaaaaaaatcaaaaaaatagattttataaattttagagtttgatttaggtttttttttcaggcctaattcttttcttcaacaaaagctggatgaaaattttgatattcgtggtatgtttttaaagtgctaaatggtgtgtttcgtgtgaaaactttctatatgaaagttgctctaaaatattggataaatctattttttcatgtttgtaataactaaaacttaattaattgtatcttaataccacctcgtttttacgtaaaacacttaatcttcatcttcatctacataagattcaaacacccctagaatataagtatgaaaaaaatacccttaaattgtttttgttgcttcatttattttcctgggtttataagacgagatattgttaattaacgctgcggttggaatgtattacaagagaatcgtttttcaccataataccagaaaaacgtcaccatgttaggggcgaggaaatagttgtggaattccttaaggattctacgtttcattcactattgctatatattttcaagaatttcaactattagcttaaaatcttatcgtaattaattaaattggcatatagtgagaaactcttaggggtcttccagctagctccacaagctagtgggctagccggcctgggttcaaagcttcaccccttctatttatttgatattaggtcattccctaatatttgtgtttttaaaattggcatatactagcaaatatatgtttttcaacaggaactttgtaggattgggttctcgtgaggttttttttggcacttctttaaagtactaagaacatggttatgaatatttatatataactcaatcaattatcctttattcaaactgacttaatttttcaaacttcataatgcctttgaattcccgagagcactcttatccacctttgtgcaaatcactcattttaaagcatagaagcaagtcccagattggtaaaggattccatcattttccacaatatctggaaagatttcaaccactagctcaaaaaatcatgttaaatgttctcttaagggcatgtacaaaggtaaagtttaatatgagctctctgtattaattaatatcactagagactatcctcctacaataatagagacaataatatttctaaaccattaatacactaaataatttttttgttatacttctttccttttctacacccttatgccacaaactttccattaataaatgctaatagtcgactctgagccgttgtcatgcgtagcaacgatgtttctcattccttctctctctttcttccacgttaccaaatttacttgcatgacaacgaagagagcccgttaactattgtacatgccctaacaagtcaacagcacaaaagtcccttcccccttttgtgtctcaagacacatcccttcaaatttaccaacattaattttatttttctcaaatgtacctaaccatctctctttgggaagtattctaccacctatggtatgctagtcctctttttacctaatactacaccttcattaattacattgccaacacacttaaaattatactacctttggttaatttaaaattgaactaaccaatgccatctaaataaaaatagagggagtaccatttatgtaccatacattttaagacaaacagacttcgtgtaccaatcagttcatacagaagccatgttcgaatcaataacgaaatatgaatgttcacctacacatcattagagatcactgtcctctcctcctccctgtcaaactcttttcctttgaaaaccaaggagaccaccatttcctttttgtgcagtactttgtacgagtactgatgggattaaccggataatatagacatatcacaataattaattctagtgtaaatgtgtaatgctgaatgcttgaaatttaataaacttttcttggaaggtttttggtaccgccacagctgaaataatttctcaagtatgttcaacattgtggttggaaagcagtactatagcgctatcttggagaaaaaaaaattcagcaacagttttggacgcatatatacatagcatgtcagagttaattaattaagtttctggtagtggtgaggaaatatatagttatgataattcctagggattctaccgttttctcagcaactttcgagatggactttgtaggattcgatttattcttgtaagcatttcctgtatgcatgttacattttgataagtactgaagaaatggttatgaatattccagtacaactcaatcaatttctctcatttattcaaaggattatttaaccttttcaaacaacatcgtgcccttcaaaggacccttgattatcaaaattccttgaccaattcatccatatatcacttatatttttcactattcatagacaatcacccattgtgaagttaagaacctcccaaatagcttcaggatgccatcattttagctcttttaattttggaaagatttcaaccattagcttaaaaatcatgtgaagtattctcttaaggaaaaagtacgaattacccccgaactatcgcggtcgaccgaattaccccttgaacctaaaaaccagactttgcttaccccgaacttttaataccggacgaattaccctcctcgacccaatccaaagctgttttgtcctacgtggcgtacatgtagcaatctagtcaacattttctttaaataaaatggtgggacccacatgccattactcctcctcccctctactctctctctcgctctctctctctctctcaggcgtgcgtggactagcagtgggcggtggcggcggcgcgtggggaacggacgtgcggtcagcggcggaagagcgtgtggatggcgcgatgggcggcgggcagcgccgaggagggtgttggaggaggcaggcagggccgaggatgagctccgcgtcaacggcgatgaggcgacgaaagcggtggcactgctgctgctcccttccctggagatgatggtgaggtacccctctcgagctccgtgccaacgacggcgggtgacgagtccgatcctccttggggagggcgcggcgggtgccgcgtgcggcgcacgcagtagggagggcgagacgagcggcgggcggcaccgaggacattggaccggcaccggaggcagccgtcgtgctcatcccccatcttcgcctcatgcatccacggaggctcgccgacgtcgccgagcagcaggagccgcattggacgaatctagtcgttgtggaagaactcggcgtctcgtcgccactgatcagcatggcgatttgggcaccctatgattcgtcttttggcaacgccttgccaaggaatctattttctgttatggtctctgcagactctgcttctgccgctggccaccgtctattttctgttgtgctctctattttctgagccgctcccacgatactggaggggatgccgacgaggctgaggaggactatgaggaggagctccgtgcgtcgatccgcctctaccgccggccaccatctcctccttctctagccatagacgcaaagcaagagagagagggtgagagaagggaagcagggggaatgggattagggagggattggtgtgaggaaagagatgacatgtgggcctagatatttttttatgttttattttgctgactagatgccatgttggtggccaagtatgcagattgaagtcaaaaccgtccaaaacagtgttcgggggattatttccggtataaatagttcaaggtaaacgatgtctggtcttttagtttaggagggtaattcggttgattgctatagttagtggggaattcgtacttttaattaccttctcttagcaagttcaaacactatcacaggaatacctatcactgtcgactcattgttgtgggttccattagaaccgacagtgataaatggattcggggtaaaaagaaatcgatttgtaacagtcgagcaacactgtcgattacttattgtcggatcaactataggtctttcatctggcagtgttggaggtttatgtgatagtgaaagcacacgaatttctttctcttcccccttttgttatgctttaggacacatcccttgaaaactttcctcaatttctcaaatggagcatataagcatatctttttgggagcattcctcaatacctacaacatactactctaatgctctcacctaatactccgtcttcatctgctacatcgccaacagacttttaattataccatttctgaatattttttccacttactctacgtgttatatatgacaaacagtcttcgtgtacccatcagttcacccaagagagcctcatatccatgacgaaacatgaatgattcacctacacttcataagagaccgctgttcaccactgtcctctccctatgcctctctcaagtcctttttctttgagaaccaaagagaccattactaaaatgtgggttaattggatccatgccattgcaactttaccaaatttataaaatgacactactatttgtcatatcggctatatgccactggaagtttctaaaattggaaccatgccactccagccaccttttccgtcctcctctctcacgccgtctctgttcccgtcctcatccccctatggtgcatgcatgcagtttttgttactgcattcatcaattttgttaccgaagtaaatgtactacgaaagagtttttacttctattggtctcgatgcactcatgttatgtgtgatcaactggaacaaagccacagaggaagtatgacaataatgtttaacaaaaattataacattgtaggagtacttacaaagaaaaagcaacacatctggttttaatgttttcaaatcaaatatgttgagaactattcagggtcagtttttgaaagtttgatccaaaaaaccatcggacttgctaaaaatatgatgccacagtttttactaaattttagtcactgttttccacagaggaaataggaaagatactggcatatttaaatacagagagtagttagtttttatacatccattagttattaaaaacacatatccatccatgacaaggtgtctcttgtaacttcactgatcccaaaatatattgtcatggtctctcttagagatgctcgtaaagacaaggtgtatatttatatgaacaagtatacccgtatgtatataaacgcttacgtttgtatcatattttcttaaaaaaaaaataacgaaacatgaatgattcacctacacttaattaggagaccactgtcctcctcccctctctcaactccttgcctttgaaaaccaaggtgaccaccattttcttttttttttctttttgcagtactttgtaccagtaattaatcaactaactaatcatgggattaaccaaaactaattcttgtgtaaatgtagtgtgcaatgcccagctgccccttacctctcaccaaccaaccatatgtttcgcccactcacacacactgacactgccacctcactctccactccactatatataccctcgctcgcgcgcgcgcactccactcgcgcactcgcgctcgctcgcacgaacgcacgcacgcacgcacgcacgacgcgcggcgcggcgcggcgaggcgaggctagctcaattggcggcgatggaggcggtggcggaggcggtggcggcggcggtggcggccggggtggagccgttcccggcggtggacaagtgcgacgcgtcggggcgggaggcgcacgcggtggcggccgacctggaggggacgctgctccggtcgcggagcgcgttcccgtactacgcgctcgtggcgttcgagtgtggcggcgtgccgcggctggcgctgctgctgctgctggccccgctggcggcggcgctccgggcggcggtgtcggaggcggcggcggtgcgggtgctggtgttcgcggcgacggccggggcgcgggtgcgggagatcgagtccgcggcgcgcgccgtgctgccgaggttctacgccgccgacgtgcacccgggcgcgtggcgcgtgttcgcggcgtgcgcgcgccgccgcgtcgtgctcacggccacgccccgcgtcatggcggagccgttcctcgtcgactgcctcggcgccgacgccgtcgcgggcaccgagctcgccacgtggcgcggccgcgccacgggcctcgtcgacgaccgccgcggcggcgtcctcgtcggccgccgcaaggcgcaggcgctcctcgacatgttcgccggcggcgacgtcccggacgtcggcctcggcgaccgccgctccgactacccgttcatgagcctctgcaaggtactttacaaatataatttaaccattcttttttggaagtaattacaattaatcctctccattaatttttactaccattctatcagcatccgtactgcaccggccgcatgtacgtacttaagtaattaaatctataataactggataattacagtgacttatcagtatcacactgatcacaccgggtaaccgtgcttttggaacagttttaaacaagagaactttttaaccaaattttacaaaacttattaaacgaatttcatgcattaccaagttgataactacttaaatctttatttgcatgcatactgtcattatcaatggcgacatgttgacaaactctcaacaggagcatgcatagccctcttataaaattcgcaaaaacaaaaaaaactactctgcatgatcttccatgctctatgatcatctccatcatgtaacacaattagttacatcaattctttaaaaaaaataaaatttaacaggtgaaatttttaggaaaaacaacacgattagtagaagtacatgctactgtgtgacatgccaaattaagatgcaaaatcagttgctggccggggtccgtacgagtgataagagggcaccactgcatgatgaatctggatggactggtgtggtaccgaatcgcattgcatctcgcatgtgttgtggcagcagctagatagttagaattggtactagcctttttttttcacatttcattttttttctcttttgtgcatgtgcaacaattaattggagatataggagtactgttggcactgtagtggctccagtatagagaggagatgaggaggaaattggttaaaaacaaagttgtgggtgtatagggttttaaaatccggggataattcacggagcgtgaaaaactggctttgagaaaagaagttgcgagtaggtttttagaaatctggggataattcacgaaacgtggaaaatggtgcaagagtcactcaattgttttggaattttctttgtgtttcttgatggttttcaaacatggccatctggaaatcactccatattattcagttctatgaaaatagtagtcagctagttcttgcgtgagagttttttagcccaaaatagctatctagcctcgtgacgaaaaataaaaataactttacaccacatatacacattaattagttagaaattgttgctcaacctacttgaattgagaagaaaaagatccggccgcagacaagaaatggaaggctttttcttttcgtgttgtccttgctgtacttatcaaatcatcacacataactaaacggctaattaattagcgatcgatcgatgggttcggttggctcacatcttcagctcagcaagtaaatttaagtgcgtgctggttaaggacccgacacgccgtctacccatatttattaattcaatctcatctacatctccagctcga

SEQ ID NO: 20960 - DNA, 7855 bp, Oryza sativa
aatcgcagcacacacacgcagttgcaatgctgtagctgcttttaggtgcaaccaggtaggtaaaccggttcatatatggccataggcagctgtcatgacaaaaaaaaattggcatttcttcgctctagacacaattcctgtgttccaaataagccctaacaatcgagaatttagccatttctaacaagtctccgagagttggaaactacagtgcatagaatgtgaattctgaacacgtgtttttataacaatattaatcattttcttttttcaaacacaactctgtgtatatatatatttaataagaacacaaaaaaaaagaggaaaatggaaccataatgaatccagattggatgtgtggggcttatggcacggcatgatgagatgctggctgtgatgtgagagcctctttaattctgttttttggtagtactgtgctgtaataataatccttgcgagttaatgcgggcattggttggctgatgccttgtcctgcgacgtcgtgcatggcgtggcgtggcgtggcgtggcgtgacatggcaggaagggtacatcgtgccgcgctcgccggcggtggaggcggtgcccatggacaagctgccgcggccggtgatcttccacgacggccgcctcgcgcggcggccgactccgctggcggcgctgctcgccgtgctctggttccccgtggggttcgcgctggcgtgcgtccgcatcgcggcgggcgcgctgctgccgatgccgtgggtgtactacgcgttctgggcgctgggcgtgcgcgtcgtggtgcgcggcgcgccgccgccgcgcgcggagcgcgccgcggggcgccgcggggtgctcttcgcctgctcccaccgtacgctgctcgacccgatcttcctctcggcggcgctcggccgccccgtggccgccgtcacctactcgctgtcgcggctgtcggagttcctgtcgccgatcaggacggtgcggctgacgcgggaccgcgccgccgacgccgccatgatcggcgagctcctcgacgagggcgacctggcgatctgccccgaggggacgacgtgccgggagccgttcctgctgcggttctcggcgctgttcgcggagctcaccgacgaggtggtgccggtggcgatggagagccggatgggcatgttccacggcacaacggcgagggggtggaaggggatggaccccttctacttcgtcatgaaccccagcccggcgtacagtcgtcacgttcctcggcaagctgccgccggagcacaccttcggcgccggcggcaggtccagccacgaggtggccaactacatccagaggctcattgccgccacgctctcccacgagtgcaccagcctcaccaggaaggacaagtacagggcgctcgccggcaaagacggcgtcgtcgacaacgccaccggcaagctgccatcgccggcgacggcgacggcgaacaacagcaaggacaaagcttgctaggagaagggaaaaaaaagggggaagtggatgttctagtagtgtaaaactataatgttattaatttttacctgtgtcgatttgcatggggcggtaaatttcctctttcttttggttatttgtactgtgtatgcacttgcaatgtaccaacggggagttgaatgcaatttgcataagtaaaagcaatgggccaggacaagcaaactattcttgtgagtcagaaactcagaagcatgcatctttctgcaggcaacagctaagaacataaaagcaaatttatttggtttggtagattgggtatcacacattacacataggccagggcataggtgttccattcgattcggcaactgaacaacaacccaacaagtaaaacgacaccagacattattgatatatacatactacgagtctacttatcaaatctggtccagatcaattgagttgtctctcgtttttgtaaattgcaagcaaccagtttcaccagaagaataactttcctttccaagaagaaaagcaatcgattgccacagaaagtgaagcaaagaagagtgtacaatccgtggtcgtagattccattgcttcagctaaaatgagtaactagcctcgagcttgaacaatgaacagaaacaagagtctggctataatttttctaggtgcatataggcgaaatggatcttagtacatcttaactccttccaggttacacatgctatgctcagtcctatatacacccggtaccgcggcaacaattatcgagggcgtgctgctatgtatcacaagggtggatcagtaacttactgtgcacacacattgcagcttttccggcagaagccaggtgcttcattggtacccaccatgtagttcggattcttggcacactcccctactgcagcccactgggggcagaggacgttctcatcctcgcacccgtcagtggaagctccctgcttgacagagatgtcgaaggacctcacatggatccatttagttgcggaccacttctgaccttcaatgaccgggcagctcccgtgcaggctgtcagagtctgttgttgcatcggggtggagactgaagaacagaagggcatcaccctttaccggttttactgaagaggagaaccaacagttaaacagctgattaaataatgatcataatggaaggtataactcatatatgcacggctaagacaacatgctgagtgctaagcccacagaatttatcagctgacaaggaacatacatagttctgcattatttaatatctggttttagaagcaaagtaacttaaaattctattacaggcaattcactatacctgcatatccatttttagcacagtcagaccatgtatcatccttgggttgtaataacttcccctaaaaaaaatagtcgagttactgcaagggaaatccaagtggctaacactgtagaaagttaaagaggacaggtaaactacctctgcttctggaaagatggtctctccccccttcccaacgtctgaaaggtacatgagcacagtggcgatccgatgtcctccaagagcttgattatttttgtcatggaagtaatcatagtgtggctcatacttctcgccattctgataatgtaatatttgaatggattcgccattatctaaacatgggcaagataatgataataccattaatgattacaaaaaatgaggtagagaaattttaacctagaatggttaggcatttcggatacctggtggaaggaacgtccaagctgcaatcctctcctctatcctagctacaacttcgtcctgccaaatgaatagttcagttcaacttagttgttacatgtggtactctgtaccagacacaatcagctaaaggcacggtagattattaatctgactcatctgaaagcaaaggtagctttaacagtctctatggtacagaatggaaactgaactacaggtggttgtgtgcagatatgtttgcaatagtgaacacatggggcaatatcccaactggtctgccctcaggttcaaatagtaagttcagatcatcacaattacgagcttgagaactggcctgttactcagtattgacgtccatatggcaaatatgactacgtggttcagtgctataagacaacagcatagacagtaagacagatgcaaagaaaaaatgagcaaggtggaaaacaatataaagcatgagaggcagttacaacccataagacaatgcacacagctcggatttgaagtccatttaaaacagtatacatgcaatggtacgagtcaagaggagagaaattggtgaagcgaatccagcagaggaaacatgacatgtaaaactaacatcaaaggtcaatcacccagatattggtattaatcattaatgccataaagtaactaagtatggctgatattaaagagttgcgatgtattttgagcaaccaattacatgggcactaaataaagtatacaagaagcatctacctaccaattaatcagaactgaatttttgtcatacattttcacatagcctcataaacaaatcacttactcaaatcaacacaactgctgggaggaacaaacataataacatttcactagtgagtacaaatttcagagaaggtaaaagcaacaaataatgaagataagaaatagttcaagtttattgtggttatatcaagaaaaggaaaaaaaaaactttttctagtagcaaatggatgaatttcagcatatgatatataaggacttcctacagactctggtgtgttccctacaagctaaagctagcaatatgaacagaacaaatgactgtagagtactttattacagtacagtctgcatgtcacaactgacaactattgagatgagttgtaagaaaagctgaaaacaggtaaaaatataaggaatagaaatatacatgaatttcaaatagtagcatacctttgcaaacaatactaatgtaaataggaaataattgatcgaatttcatctctcgcaaactacaaaagaaaactacctaggaaaaaaaataagcaccccagattccaataaatatgaagacaaaaaaaacatggagaagtattagtacattgagcgaacatgataaaaagatatgaacccccaacgatgaaacttcagccaaaaaaaaacattggtttcaaacatgtgttgcagataccaaatcaccaaagttgcgtattaccaaatagaagcttagccatatatcccctcttttaatttggccatgctaaaaaagtatccccaagcattttagatgaaatgttatctccaaattgagaggaaacaacaagttcaccaaatcacaagaagaactatagtagccaagttctgatccagcatttagtgtactgattgtgataaccaacaaaaagctgtaaaagactgcatctgccacaggctatttaatccaagcacattaaattcaaattctgaactgcttctgctataaaatcctaaattggtacaagcacatagattaatctcccttggcagtttaatactacctaaacatgcacgaacaccaactataaagacctggtatggcagtggcatggtagcgcatcaagaatcattacctacaaggactaccacccaaaatacaaaaatctgctattttagatttccaacacatatccaatctaaaaatacaaactataccgcagcaattccaccaattcccctttccatgtcgaaattacagtcgacacagaggcattctccttcctagatctctactattaacagcgagctgagccagtgaggcctataaccaggtcgggaccaatccaacacctcaaaacattatcgaaagaacagaacggaatcaggcggtgcggtggctggctgctgacctgcttcttctcgaggaacatgccggagctggtccgcacctcgctcatgacgctcttcccggactcgttgtccgccaccatcgacttctccagcttgtccttcgcctacaaatcgaatcaatccactattacccaaaaggttccccgaatgcggcgagatcgagcgggatgccacagtgtacactcaccagcgagatcaggtgctcgcactccgcgtccgtcaggaaccccttgtgcaggaacgccctagaacgaagcggcgggtcaggatatcgcacgaaccctaattcgcggcgggatggccatgggggagagagagagagagatcgtctcgtcagtcgtcacactcacctggggcgccacgagagctgcacgacgcgggatgggtcaaatgcgccgcggccgctccccgccgcggcggcggaggaggccactccggcgagcaccaggagggccacggcgaggaggcggaggctgccatggcggcggcgcgagctgagagcggccatggcgcggcgccgagatgcgcggaggaggaggaaaagcttcgaagggggagggggagagagaggcgcgatgtagtagtagtcgcgtagagtgagtgacaggtgggcccgacgactcgtggggcccggctgccagtgagagatggaggcgctagtttgttgggttccttctggaagcttccggggttcgcggggggtgatggactttgacttttacgtgttgctcgcacggaggcgtacttcttatctgcttgtacttttggtgaagcatttgtgagatcgtccggtgtgtgagggggagaaaaatcaagccaattccgtgtgctatgagaaatgcgtgtctgttgagattcaaacctcatttgaaacacatgaatcccagaaagaaattctgcgatgagttttcattaggttaacttttacatttgaatctctcgtcatctccgcggctaccacatgaccttttaaaccgattggtatcggacagcaatattgtgactgctcaagttttcagtcgtcagaccatcaaacttcagggaaatcagatgtgcatagctttactcccatttccatagctccagcaggtagtggcatccagagtcagagtcaggaggaccaactcacgaataggcagtaaattcaatttcatactatgcctcatatgcgagtaatttcagtttttttttctgttgttgtttggaaaacagagtaatttatgttcaacagcattggcatttagaacggtaaaaacctgtcaagacaaattggactataattcctatttcagacattttttatatgtagttacagaatagtccagttcagtatattgacagccgtgttatcttttgctaacaaatccagacgtgcagtgcaggcacagaatcaagtcaaacaacaaacaagatctgatgtttgttcgtttccagcttcttaaaaatagcagcagagtagaaacactcaaagcgaaaaaaggtagaagtatcctaaaaataaaacaggaatcctgatacagagaggtttcagagttttacagctcaaaaggaaaaacccattttatttcaggagaactaggtctgataagagtaactgcattttcgttcacaaagaaaacggagtaactgaatgatggtgcagatgaagtcatgaaactatgcagggggaacgcattggtgcttaaaaacagcaatacaacctatcatggtaacctaaacagcaaggcaacatataatggtaaccaagcatcatggaagtgtccattcttgtttttctctcaaaacaaacattggccatccaaggtgcagaaacaaaatgtcacaccagatgagcaaatcaagcactattattacgtataccctgattcctgataattcagttgatcagtacaggagtgaagcataacatttgccggaatgaccgaaggaggtcatttaatgtaattaagataagaagggagtgaagcataacataaggtggcctgcataatctagcagtccacatgaacaaaacaaatacctcacacaaattcatttgaagtcataatggagcaattcatgcatagatcactaagaaatgtgtattctaaaaaataaaacatatggctgagcggaccaaactttcaatcattttgttgtactgaacagcataacatctgcttattacagtgaatgaatttataaatctcactagcagaaaacaacaataatggtgtaataccaaaaggtacctcttctatctctcgatttaacaaggtatgattcatatgcagcaaatagtgcatatggtattgaactattgacatttggaatgacaaaataccaaatgtcctcaaaatttgtctcctaaaatacaaggagctctcctggatcccaattccattctaacaacttattattgcctgatgataaattacaaatggagatcacatacacctccaagaacacaacaaaaaatttgcatgcgcagctaagttctcatgatcaaactctcctcgtaaccaaagcacaaggcacgggctgcag

SEQ ID NO: 20961 - DNA, 14019 bp, Oryza sativa
gcaaaaaaaacaaaaaaaataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggcatggcggcaccgggagatggggaagagaagaaggccgggagcgggaggaacaagcacgggttcccgcgcggcttccgcttcgtgccccgggaccaggagctcctcgacatcctcgacgacaagctccgcggcgccccgctcgaccgcgcgctcgacgccgtcttccacgacacgcggatcctcgacttccaccccgccaagctctacggtagccaccgcctctcgatccctctccccctctctctctctctctccttcttcttcttctccggcgacgggctgggtgggtgctcttggggatttgattttgactcgggtggattggactggtttggggcgacgcagggatgtacgcggaggacgaggagaacggctacatctacttcttcagcacgatagagttcaaggcagccaagcccaagcagaagaagtggccgcggcgcgcggcgcagggcggacggtggaaggccgtcctcggctccagccagatggtggaggttggcggcgtccccgtcggccggaagctctccatggagttctacgtcaagggggtcaggaccaactggggcatgcacgagttcgtcaggatcatcggccccaacatcgaggtaaactccccatgttgtatctccttgtgatgatcgaattcatttggtctgatttggatgcaatttgtgcgatcttgagttcttgactcgtacaattttttctctgaactttcgtttcgccaaggttgcggatcttgccgtgtaccgcctacacaagctatggacgaacggcgaggagaagccgggagacctcgccgcggacgttgccaagagcacgaaccagagtggacaagcgtcggcggcggactactaccagacttaccagaacgcggtctctcaggcgtatgcgtatgcgccgccgtacgtcctccagccaggatggagccaagggtacccctacgatgtcgcggcggcgccaccgaccgcgccctggcctgtctgttgggcgccgccgtccgcgccgggatcctatgactgctgctacgcgtccacgttttcaaggccgccgccgccaccaccaattgctgcgagcacgctggacaaggcgccgataaccagtaccgaccacggcgcatcaacgaacacttcggcggcgacacccgtggcgaacaacaagccgccgccgccaccagttgctgcgacagcgaccacgctgggcaagaagggggagggcaagggcaaggcgccgacgaccaccagtaccgatcacgccggatcaacgaacacctcggcgccacccgccgcgaactaccagccgccgccgacgacgactacgccgccgctgcagggcacgcagcacgtcttcgcacccggcgtcgtcgtcgggcatgaggacgaggagggctacctcatcgtcgacgaggtcaacacgtggcgcaacacgcagcagctcgtgctcgaggatgacgacgacgacgacgacggccgtgccgccggcgccggtgcaggtgagggtggcgcttcagcctcagggcggtgacagtctgacatcagcagattaagagagaccctgaggcgtatcagttaatcatgcgtgtagttactagttaggctccgatttgagcattggaatttccagatttcccgactgcttagcttggttttgatctgcccgacaaatttccgccaaattcgtagtgttcaactgatcaacttcatgctctttctgtccgttggttattactttacttgttctacgtgagattgcaattctgatctgcaactgcttgtaatctggatgatcaatagctgcttccctgctttatgattgtggttttgctggttttgaaatgctcgagttaaattggctctccgtgccacttgatttggggtaaattaatgtttgatagatgaaccatacttttctaacatgggagccatcttttaattttatgatattgatatcaaagtgacatgcatattcatcaaaaagcttttttatgaaaaggtgacagaaataagtttgtggtggtgcgtgcctggttaaatcatgaaattttagctttgggctctaattgattgttcatagtccaaagtactattcagcaaggaaacaagatcactgaaattcgctccagtcaaaactatcttgggtgaactcaacttaggccctctttgtttaggcttataagccaacttataagtcgaaaagtctaagccaaaacaaacaagcagtttttttatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccttagactagagagagagagagagagtagctacaacctacaaaatcctagaatttcatgcgattaatttaagtgagcgcatgattttgtcaacatctcgatccatttgtcaatggactggggctgtgttcgggagtgagggttgggaatccactccctagcacgtaaaacgaagcagcgtttagtacatgattaattaagtattagctaaaatatatttaaaaaatagactaatatgattttcaaaagtaaccttcatatagaaaatttttgcaaaaaatacaccgtttagcaatttgaaaagtgtgtgcgtggaaaacgagtaaggtgagttgggaaagtgtcgacgtttgatagtcaccactacggtattaggatggtatggggatcgtcggtaccagagtatatacgagattgaagtaaaagagattgagacaaggatgtttatataggttcgggccccttatttgacaggtaatagccctactcctattggctgaagccggtgttgctcttattcatcataatcacaccagtacaacaattgagataacctatctatatgttgtcgacttggcggcatggataaccaactcgcgatcgacgacaaggtagtcttcctccttgagtatgaacccgtcgagatcagagatggtgctagatcccttttgccggcctccgttggcatcggatggggtatgtctaggctaatctctaatgtcgatatttggtggcatattggcttgtgtgtatgttgtgtcttgttggtcttgtggcttccgtctcccctctcctcctaggggagcttgtatttatacccatagatgtccccttctccaactctaagtagaactagaaagacaagtatggatacgattcgagtagtccttatagtatccatataaaactctatttgtcatttcttatccggaactccctctatatatgaggtatgattccgtataagacttggtatatggtaggccccgccgagcttagtcgattactattgggtatgtggtatccataaatctgacaaaaagtataggagtaccatgtaagagcatacccaggagctcatctatatttgatcctccaaatacccatatggtgtatcatccaaaaaagattcctcatccatatcccttttaatccaacagattatccatattacatcattcatatcccatcatcctatattttagtaatatctttcaactaatcttacatttgtattttaagggatatattttgaatgacttaattttaacggtgttgtttatcgcgataatattttgaaatgagtaaactttaacggatatatttttaatgggtaatttttaattgatatatttaaaatgagtgaagcattttttatgtgttgaacggctacatttccaacggctagctagctcattcaaattgtccaacggctagtacatacatgtaaagtttagctctatatataccactacattgcttgctatctttttgcaccatccacattattgtgcatagttcttactcaatgagcttccttttgagacatgttttattggatgaatcatcgtcatcgacgatgaaatcattgttgcttcaagaagatctagttaaacatctatggcaatttcatggtaggaactagtgtagtatgcaacctcccatttatgtagtaggcaagtctaattatgtatgcaacctcgtttacatatgaaatccatcaattatgtatgcgacctcatttatgtatgccatccatcaattaagtatgcaatcctaatgtatgcaacctgtatgtgctcacaattaatcatagcattcttgcatagtacagcataaaggtcacaaaacattaagttccaacaataaccattacataatacatcaaagcctacacggcatacaacataaaagttcacaacccattagaaaatagtaataaatagtacatatccatacatcatgaaatcaatccatatgagcctttatgatctcctgctgcaaacgcaagtaatatgtttttcttggcccatccatagcactaagatccatattcataattctttcttctctttcatgggtttctatatctaactttcgtttttctactttcaacctctctttctctagtgaaataacttcaaccaaccggtcatttctttcctccctagattgtgcactcatctcctttttctctgaccacatgttatttaatgcaataactacaggactactctcacttgagcatgaagaagtattacctcgcgggcattttgccttttccaccttcttcccaggtggtctcactaaaggatcagaggtattaatgtcggggctgtaatgaaattcactagagtttgtgcttgcagatggtctcactaaaggatcgacatgagccttctgtcttttctggaacaacctatcattccactttggatgatgatgcaaaatctcccaacagtgcattaaagaaaatgtcttcttctctgctgacttgtacaaagtaaaagcctgagttatctgcaataattggcaaagtcgataattggaaaaacaatatttttttaaagcaaggtactagctgaatgagatgcttacataatcttgaacaaccattccactttgaggtccattaagaatctgctcataatatccacaaaacttgttaacttgttcttgaatggtaccccaacagttgttaagtgaattttggttttgatctgaggggaaatttttgttttcatggaagtattgatgaatccttgcccaataagagtcacggtgttgctcaacacctgtgattgcatctaaagttgtattcagccaagctgacaccaacatttgatcttccgcagtgttgaaattttttgatcgcttattgttgggtctagaggaccctccaacttcagcacttggctgttcaccaaccataggactatgttgtggctgctgtcctgttgggggaaaattttgactaggatcccaattttctacatcaatgtttgaacccaacaaattaacatagttgtccatgtattcacatcatagcaacataaataaaatgaacataaaagcacagtacaaatatagcaacatgaatctaatttgtactctattcttattacttttctctactatgtgaatataaaatcaaagtaagtaacattccaatatattttctctccttctctgctattactacttaacattccactgtattttctttccttctcttctacttttcttctctaccttctttgctagtactactttgcagcgggatggccgataggcggcggccgagctggcaacaggcgacggcgggcatgcagccaaggggcggcggcggacgaccggactggcgagaggcaggggggatgcacgcgacggccgcggaggcggacaggcagggaagagccatggatggtcgggaagaaggcagccggcaacgggtgggtgagaggcggaggaggcaagcgacggctgcgcgcttggcaacagcggtaggcagctgccgcgggcagggcgacggcggaagtctgcaggcgtgcgcatggcgacgacggcagacggcagtcgcgcggctccagatctggtacgcctctccctctccactctcactccaccctccctctccaccatccgctgaaaaaacaacccaaaaaggtgcatggaggactcaccttcgctggccggccacgacggcgatggagaggaggtcgcggaagtttggataggggcgggagctcgatccagatgcggttgttacgatttggcgtgaggagagagacacgctatttttggcttttctctctctctgtttagcgcatccgacacttttagcgctttggatggcacatctcctggaccttgttttttcgctcctatacgccaaaatgcggatggagtagcgggtagcgtatgtcctgggatgctctgacagggaggtacctagtgtgcttatcgcctctgcacccgctctgcctctccttcacttggtacgccgtacgtgtatggtaaaaaaaaaaaagagtactagctggcaagctgctgtttgttaatgggcctaccccaatttgcgtgagggccttaatgggctcaactggcgcgcctcggaaagttgggcctcacacaggcccatatcttacggggaaagtaaagctacggcctaaatggaataacgtctttgcgccaccgttttcttccgcagctggccaactcgagccacctcatcaggaaaaaaaaaaagaaagagagaaaaaaaaaatctcgcctccctttcaaatacgccgccgcggccgcaaagctttcgctcggagcacacgcacgcgcggcgcgacggcgcgacctcgcctcgacacgagctctcgtgatctcgtctcgccgcgtctagctcgccggcgccgccgcgcgcgcgcgtcccctcgccgccgtacgtgtagcggagcgactccctctctccctcccgcctcacctccgggaccggtcggtcggtcgatcgatcgacggggcgaggggatggcggcaccggaaggccagaacaagttcgcgggcgtccgcttcttgcccaaggacctggagctcctcgccatcctcgacgccaagctccgcggaagcccgttaggccccgtggaagccatcttccacgacacgcagatcctcgacttccacccgtacaagctctacggtatccaccgcctcgatcgatcgatctccctctctctctctctttgtcgatctccttcttcttctccggcgacgggtgggtgcctggatcagatcatgcagttttggggattttgattcgggatttcgggtggatattactcgactgattttgcagagatgtatgctgaggacgaggaggaggaaggctacatctacttcttcagcacgatgcagttcagatgcaggaagattgtggagcgcgcggcgcagggcggccggtggaaggtgaacaactgcgagactctggaggttggcggcgtcgccgttggccggaagttcaccatgaatttctacgagcatatcggcggcgacaacgacctcatctggaccaactggggcatgcaagagttcgccaggatcatcggcccaaacaaggaggtattccattcggaaatccacttctgaatcttcgttcaatgatcggatacatttgatctcatttgggtgaaatttttctgatcattttggccaaaagctcgcggatcttgccttgtaccgcctatacaagaagaaaataacaagggggacaggcgaggagaagccggaagacatcgccgcggctagcgatggcgataccgagagcagcatgaacaagcgtagacgtgtagaagcgtcggcggcggccatggcgctgccaccgccaccgccatcgccaggcctgcctggaacaatgatgttcatggcggcggaccaggcgaacgtggcctcgacctcgcaggaatggcacggccagttcgccaacggcgctgcggcggcgccgagtcctagcggctgctggccctgggcgccaccgccgacaccgagcgcagtggagcctttcagcttctgggccagcgcgtcggcggcgactcctcctgccgccgcgaactaccacccgtcgccgcagccgcagccgctgccgccgcagggcggcgagtactactccagacacggcgccttctcggtggcgcccgtgcccgcgtccgcctgctcgacgccgtccccggaggcggcgaccagctgcctcttggctacgacgtcacctctgccggcggcaggtactgagggcagtgacagtcagcagcaagaacccccctgcgaattgatggaattttgaaattttggcgaattgcttatagctgattctgatctggccgacaaatttccgtcaaattcgcagtgttcaacttcgtactctttttctgaccgttggctgttacttcactagttctacatatgtgagactgcattgttttttgtactagtattaatcttggtgatctgttgttctgaaatgcttataaattttgcccttgtgccttgaagaatttgctatgtgcgtcacttgctttgatttgggatgaaatgtttgatgaacaatcatttttaattaccacatgcataggagcttcaggaagggcttgaatttgacagttgctatgtgtttagccatgatgcatgtagttttgtgatagtaccaacgcgggatattcataggatttttgtggaggttcctgttaaatcattgaattttaatttggaggctctgaagtgttcatagtccaaaatactgtcaagtaaattcaagtgatgaggtcatgactttaatttttcatagcaaataactagattaatagaccggcatgattttctctaaaacaaaatagttagattctgtttctggcaaggaaacaagatcactgaatttcgttccggtcaaaaccatgtagcttgaactcaacttggactctagagagagaaagagatactatatcatgcaagatatagtagatacaacctacaaaatccaagaatttcatatttttcatacaatgtaagtgagcgcatgattttatcaacatctcgatccatctactgatgaactgaagatatgtagtaccagctaacagggaggtgctcacgctggtcgcctttgttctacagctcgaaataaaaaaaaaaattaatatgtaccaattcttttgaaacgtgtatattttcttaaaaccggtggaaaaaatatttccaaatcttatttgctgcagctctgcctctccttcagttggtacgcgtatggtcgaaaaaaaaaagacagtactagaaacagcggtttttaatgggttgagcccaattttcctgatggacttaatgggctcaactggcgtccctcggaaagttgggcctcagataggcccatatcttgcggagaaagtaagcttctcgccgtgctcgtccacattccgccagctggccagctcgagccacctcatcaggggaaaaaaagggaaaaaaaaatctcgcctctccttccttacaaatacgccgccgcggccgcaacccgcaaagctcggagaacgcacgcacgcacgcgcgcgcgcgacacgcgacgtcgacacgagctctcgtctcgccgcgtccacaccaatcggcgccgccgtgtagcgaagactagctagctccctctcctccgcgagaccggccgatcgatcggggcatcgcgcgcggcgcgcgcgggcggggctagctgggcatggcggcaccggaggatggggaggacaagaatttcgggaagaacaagcacgggctcccgatcggcttctacttcgcgcccacggaccaggagctcctcgccatcctcgaggccaagcgcctcggccgcccgctctcccgcgcgcacgacgccttcttccacgacatccgcatcctcgacttccaccccgccgagctctacggtatccacccttctccgtctctctccttgtccccttcttcttcttctccggcgccggcgaccggcttggtggtggggatttgattcgggtggatttggaatgatttgggggcggcgcagagaagtacgccaaggacgaggagaagggctacttctacttcttcagcaagagggagttcccgacgagcagcaagaagcggccgctgcgggtggcggagggcggcgcgtggaacagctccggcgccgtttacaaggtggtgaagagcagcaagtccggcggcggctacgacgtcggccataagaaaaccctcgtgttccaccagcgtttccccggcgacaaggaggccgtcaaaaccaactgggccattcaggagttcaccaggatcatcgggccccagaacgaggtataaatcaaaaatcaagccacgatttattcccacatttcatcttcttgttgtgaggattgaattgatcgagttcatcttgatctcattcgggtggtgcaaatttgtgccgaattttgactcagagttttcttgaactttaatttgccaaaaggttccggatcttgccgtgtaccgcctgtacaagatgaggaaggaaggcagggagacgcctgcagacctcgccgccgacgaggccgcggccgcggcggccatgaacaaccgtggacaacaagcgtcggctgcggccatggcgctgccaccgccggcgacgggcctgcctgggggaaggatgatgtccatggcggacaaggcgaacatggcctcgacatcaaaggcgtacgggccgtcaaagtcaagctcatcgcaactccagcaggatgcggcggcggcggcggcgccaccgaacgcagcaggggctagcaactgggcgccgaggccttgcaactgccgggagtgcgcgccggcggcgggacactatggctacttcgcggccgcggcggccatgaacaaccgtggcggacaagcgtcggctgcggccaaggcgctgccactgccggcgccgggcctgcctggggtaaggaggatgtccatggcggacaaagcgaacatggcctcgacatcaaaggcgtacgcgacgtcgcagtcaagctcatcgcaactccagcagggtgcggctgcggtggcggcgccgccgaacgcagcagggcctagcaactgggcgccgaggccttgcaactgccgggagtgcgcgccggcggcgggacagtatggttacttcgcgtccatggttccacggccgtcgctggaccggaagggcaagggcaaggcgccgatggactgtgccgagcaggccggcggcggcggcggctgtcacgcggagtcaacgagcactccggcgccgccgaagggcgccgagtactacggatgcagcgtcgccgtcgaggatgatgacgaagaattgctgaagtttctgcaggcgatggtgaggggcgaggaggtggagggtgatggcgaccacgccatggccgacgagcgcggcccgcagcagggctcctccccggtggcggcggcggcggcctccggctccgcgcctgcaggtcatgacggtcgccgtggctcgctgcagggtggccaccatggatcctcctcccccacctcattggcggccgccgccgccaccggcgacgacgtcacatctgccgccagtgcaggtgacgacgtcagtggcagtcagcaggaagaccaccctgcgcgttgaacactgaaatttgaaatttgaatttgaaatctgggacaaattttcgtcgaatttgcagtgttcaacttcttactcttttctgatcatttggtgttgttacttcactagttctatgtgagagctgcaattctttactagtaatcctggtgatctattgttgctttacgatggtgatttgcttgttctagaatgctcgagattatatatttgttttgcctgagatgaattggttctagtgtactgtcactgatttggtatgaatgtttgacagatgaacaatcatatttaccatatctgggagatggatgaagggatttgaattgactgcttttatgctaacctgtagttttatgatatgaaagtgatatgcaaaagccatcctgtagttttatgaaatgtatgaagcagaggtctaagtttgaaatggacaaactgtattctgtatttctgttttaagcttatgtctctgtgtaataatggtgcaattgaacaaatgttgatctgcatagatgcaagtcttgatcactattttctgtgtggtgacacatggagcaattcttgcaccgtactactttaggcttagacgctttctctcaaaatatcatgttaatagttatgcaatattctcaaaatatttggcaatattcatgtgccacccgaatttcatatctaaactcaattcaccagagagaaagaagagacaaatccactaaatgaacaacaatgcttaaatactatattcacaccatggagtagtgtatgctggtgtactactcagtatcagctagtgcaaactcatggtaggagatcactgatcattggttacagagagatatttgatcaactcaaaagatattctagctatcaaattctagattttacatgcaagctaaggccagtgcgtctgtgcgtgcatgattttgtccaaacactagatgctgctcctatacatgtaaaacatctagatcggccttcaaatgggccgggcccaatttgcgagagcaaagtaagcccattaacacccaactaaacacgtcttaaatcacggagacgctccattgatgccggccaaatcaatcgctagttttcacaaccgtcttacggcgatggccgccggcggcggcggcggcgacgacgaccaacgtttcgatctccccgacgaccctcctcctgcgcatcctccggctcgtcccatccaaggaggccgcgtcgaccggcgcgctctcgcggcggcggggctcgctctggcggcgccgtcaacctcgccgcgcgcgtctacttcgacggcggggtcagccgcagcgtcagcctcgacgaacgggaggaggccttctcctcccgccgcgacgccttcgtccgcgcctcgccaggcggcgttcgcggcggccgccccgccggaggcaacggcggctgccgcggcgtcaccaggctcaccctcgacgtgcaggcgaactgccctgcaactccttgatctccaagttcctgaacaatggcggcgagacgacggcgaggtggacgtggttgacctcgtggtctcccaccctgcggcgcgccgcgtcgaggatctccgcgtccgcgttgtcccctgcaggtaccgctcctactccgacgacgacgaggagaaagaggcgagatgagacagcggcgtgtacagcctgtcagcctcaccgtcgagtccgcgtgctggacatcaccgggtgcagtgcaccaggctcgctctgccgtccgccgccgccgccgcgttcccgcgccgctgcgtcgtgcggctctggcatctgcagcgcctcatcgacgccgcgccggggctcaccacagtgcacctagagtccgtgtccgtctacttcgacttcggctgttcggcaaccacccctactagtactactacgatgacgacgaacaagactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagcacctacgacaacgacaacggcggggggtgcatcgcgatcgacgcgccgaagctacgctccttgcacaacctcgagtcctcgtcgcccgcaaggcgagacgagagccgagcacctcc

SEQ ID NO: 20962 - DNA, 10115 bp, Oryza sativa
acgacatccccgcgcgttgagtgaacgatgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaatgtaataaacagaggtctacgatgaaacaaaacaattcttttttttttgtttgtttctaaagcctatgcgcgttgagcgattctttcaatttactatagcaggcctgaggcaaaaaatatactataaacattagagtttaggataaggttcggtccaaaatttaaaacattgatcatcaattttatattagaacaagttcagaaaaaaaaatctaataactttacgatattacgataatacttttcaaggcaattcacatataccattaaacttaagcatctgagaaatcattattggtcaaagttttaaaagtttaactaaattttatcttaaacattaaatatttatgtatggagaaagtatcatgataagtaggagtaatagacacatcaacatagttttgctacaaaaagtactgcaatatttttttctttacttcacgctttttcaccatgtgattaattgctaactctacctactaagtagtaagtatatgttcgtctctctcttatctcttattttttgacttccatttttcattttttaatttatcagtccattttgcaccgttaattttcaaggaatctagtagacaattaattatttatgtcctagttctcactagatatgagtactagaaaaacataggcttagttcggcatcctgagttcccaacccatctccctcgtgttccgcgcgtgcgcttttcaaacaaataaacggcccgttttttacaaaaagtttctatacaaaagttgcttaaaaaatcatattgatccatttttgaaaaaatagcaaataattaattaatcacgcgctaatggaccgctccgttttccgtgcgcggaacatatgtttccaactagcagcagcgaacacagcattagtcatgtgatttgcaattcatagttaaatatataaaattccgtgtaaaataatacaatgttaaatatatgctgaaaaatttgagttttctattttctccttgagatacttcttcttttaatttacctttttttattggaattaatgtttttggactagttatttttgttttgtttttattttggatcatctaaactctgttttgtgagtacattagcatcctcataccgacaatcatcctttttacgtgcaactcatcgtcaagaagagtggttgcatatgcctagataaacgcatttgggtggtccaaagtgcattaaatgaaaaaaaaaagtaccaatccaaagtgaaaaagattcagtacagaatggtttaaagtaaaacagagaagctaatggagtagcgcactgtcttgctcagcttgcaagacggtcgaatcagtagatagtgtggagaggggaagccccaacgtgtgtttctgagcttttggctcatgattgtactcctaatacttgattaataaagctctctgtttgcggaaaaaaaaggggagtaaaacaatcggtaatgtttggctaatagaaatgggaaataattttccacttaccaaaagacatctttaaatcctaaccatttattccccctcttccatttaatcctaaccctttattcattttacaatcccgatcctttccctattttccattatccaaacacacccattgggtaataacaaccggtgcaaaagtgcgattcattccttttcaaaatgggtgtaggcacaagtaggtacagtatgtgactacgagcccacaattacccaatgaagtttgtcctgtttttattgagttgctataacgcctccctactttgaagcatccatgaattatccaatcctagggtattacagtgtacacttaatttcaagtagctagcatgccaagtggcagagtagtcaaatcacctctttgttacctaacctacgtaccatgatatggtactcctaagagtgacatatataacacatgctaatctcaaagagaaaaaaaatcgaaaggattggatagaagctttggccgttgctgggcagtttcggcgatccatccggcacgtatatacccgccaccactctacgcacgatagaattgcaaccaacgacactactaaagtactaaacgttaacttgacccaggtcaacaacgtgactgaattaaaattttataatatagctgaacttggaccccccacgttaacacacggagcagtagcattgcatctatcagcttaaaaatgttagatctgacggtaatggtgtttactttgaaagataagcatggaccagaagagtaatctagtcgtcgatagcaattagcaaagggtcgatcgaagctagaatatatatataatatataaatgacacttgatgaatacaatgataagcatattttccgagcgtcttcgttagctgttactccctcctgcctacaatataatataacgattttgagtttttatttgtaacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgccctcgtgatcgccgccgccgccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatgaatcagtttatatgacattagaaaatggccgtaggaaacagacctgatcaactgactttatgctttatgctttatgcagtttgcagttgtacctgatatgtaagcgatctctctctatacttaaaaattagtaaaacattagacttgttcactttgatgccaaaaaaaaccttaccaaattttggcatagttgtcaaaatttgccaaaattttgataaaatttcttatatagttaccaaaatttggtagcaaactaaatgtagccactttttttggtaactttaccaaaatttggtaaggttgaaaatggcatcaaagtgaacaagatcattgttatatactccctccattctataatataaaacacaactatttttttaggtgttccataatataaggcatgcatgtttgcatacaattaactaggacatcttctctattaaattattacttttttaaatcctccacccttaagatctctaattgtaacatcttgggtatttagctatagtattaatcacgctaatgacttgatcacactggctgagagcggtattgattgagccacgattctggctaggacctataaatatgttgattgttgttctattatggatcttaaatgatatttcgatcgttttcttgtcatttatttatcaagtcatatccatatgcatcattgatttattgttagttagactaaatctgttgaggagtgggataatttagtttcgatcaaactatacgtagattagttgtcacgaagctaggtatacatgcacagtagaaatcagaactgaaactatagtaaattattcacaaactatttggttataggttgcatacatacatacgtacgtacgtacgtacttacgtacatacatatacagactggcatacatccatgtgtacacatattcattataaatcttatacgtatgcatctcatatattgtgcagatacatggtgcttataaatacaaactgaactcatacgctctgcattcaagtaaaaggagaaattaaatgtattaggaaatgtttatatgattttagaccgcacaatttctatttaggaggttgcatatttaaaactttagttgtagtagcaataaaggaatttttgtgttgtctcaatctacaaattttgcatccaaccaaataggggcacaaaagatgtagggcctgtttactttgatgccattttcaaccttaccaaattttagtaaagttgctaaaaaagtggctacatttagtttgctgtcaaattttggtagctatataaaaaatcctgccaaaattttggcaactatactgaaattttggtaatgctaaaatttggtaaggttttttttggcattaaagtgaacaggcccgtaaaccgagccatctcaagccaaattccaaaattatccatttttgcataaaactccctgaattctagggcaattattaatcggtcccttaactctggagtaacctccaaaattccaaaagcttatagactagaatgcaaaattactaagtattccaatttcaccagatttccattaaattgtaaattagtgaaacctctcaaaattaatccaccgaacatgtcatggtgaggtgtcaatcaaggaagcagccaccaaacaacaagtaagtgagtcactggttaagttccaccaagttaactagttcagtgtgaaaccattcattccaaccaagcaactgtatcgtcgataccaagagactgttcactttaatgctaaaaaaaccttactaaaatttagcatagttaccatactaaaattttgacaggatttcttatatagttattagtaagattgaaaatgacattcagcagtaggcacagcagtagtagtactaccattttctactgcaaagagcagcagcggcagcggcagatcgccatagtggcagcaacattaggggcgagtagcagctatgaagaacaacagtacaagcagtagaatctcaactggagtaaggcagtcttgactagaaatcagtagaggttagggagataaagagatattcaaccagaaattatacacctcaccaacaccacagctcaaccatagtatccacagtaaagcaacttggtagagagaaagagagagatgaaccaaatctgaagaaggagaagtaggggtgttcggttcctgcatgaacagtgatttcagctctaggaggagatggtacttcagctcaagaaacaagatggatcagtaacagcagaagcaggacaagaagaaaggaggagaacaggcaactgttgtaaattggatcaggaggtaaaatcagcaagaacaagaaatcagaaaaatcgttagcaagggtgcaaatcaagtaggaggtacctgagcttcaagaagagaggggtttcagtttctggaggagcaggtggtgcttcagctcaaagaggagaaatcagagttccatcaggagaacccttgaatcagagtccagaagagtagctgcagaaccagagttccctatatcagtcacctaaaatcatggcaggtaatcaggagattgaaatgaaagtacaatcatatcatggcatgattcttgagtgatgcatatactagtatgtgtaggagttgtgagttgcatttgcatccattagaatatgaacaagaaaattaagtaatttgtgaaggataagtctttgtagtccttggtcgtggttcttcctttgcttttgggtagtttcaccttttaaggacagcatctactcctttagcatactttcagttgctaggacagctgcggttagtaggacaacagcagttagcatctcctttatgcctcatttatactttattcagtttggatgccttctaggacagcatcctattcaaatttcgaattttagactagggtgcagcaataggcttacagccagctatggctatatatatgtatccaacctccctcgggtaggtatggctttgagtttatgaataaagaaaaccagaaaattgccccatcctaagtgccatcctcttctcaatgagagtaactattaaaattctaacaatttgagctgtagagtaggaggtgtaactagtaggacataaatatttttttatttaactgataagtaaataggttaatgttagtttataattatttggggttagtaacaagaaacattttagtttttctagaatcattatgtaaatgcatttaggtaaacagctgcgcatgcatttgtttggtgaatcctgaaattataaatagttagaattaatgagtagagttataagtctctatagcagagcatctagggcaaatgattctagattagagcatggcatatattagttctgtaagtattacttcctccattttataatgtaagactttctacatttcccacatttatgtaaatattaatgaatctaaacacacatatatatctagattcattaacatacatatgaatgtggacaatactataaagtcttacattataaaacggagggagtaatcaatataaatcgtattccactgtgagaaacattagcagccttaaaaatcaaccaatgcattagttcttaatattagtgatactgaatgtataggattactctggatagcaagtgcacaggtatatctttagttcgaataaacctaaacttatgggtctctacagcaagtcatctagagaagagcataatatcagaatctaaactttagtagttgatcagcataaccttgctaagaccaataccataaacaccattatttaactgtgatttcagtagtaagtatactttggcatcaagatgaagatttataatttctaggtcattaaatccctcaagtgatactaccattatgcatcatgtatgaatgaaatcatattaatcctctagattactattcagcatggcaacataaggatctgatcatgttagtttattagtttgtaacaaattttaatatttagatgtgttgctttttctaatacaaggatctaaatcactaatggaaacgatagagagcaagagaatagagtagagcaaagaagctacattttcatatattacataagccgtagacaccatttacataggggtatatgtccttttataggacttttaggtcggtttctacaataagcgacccgctacaatagcatgtttttacagctcatgttacagctcatctaatagcacaaaactagcttgctaccaagacagacgtgctgcttgccaagcacaagcagtaatgaaactacctgatacagtgtacacctttgctagctagtaaaatttgctttgtatccttccatgccaacacaacaaagcatacaactcacttgtgtattctatagcccattatcactcatttacaactaagcttagctaatttgtgctagaaacttcaagcagcaacaagcaaccaacttgaccaactagtagtcaaatccaatttgactttgttatttcaagaacacaaattaatttccaacacgatggtcattgcataagcataattaaggatttaatcatgctagagtgatttctattttagtaatgcaattcatagacctattcatgtcagcattcattcatcatgaacatataggcatcatccatcttagcaacccaatttctctagaaccctagatccagtaaatacaaccctaagtataacatcatcaagtgaatcattaggacaaattcacaagcatcaccagtacatcacaatttacataacaacaccatacaagagaggacaccacactagtatatcacaatagggatcagagacgggaggatggaataggtagctcacctatggagcagagggatgcagccaccggagttgcctgtgtttccaccggccatctccacggtggctgcagtagcaggagaccggcggctggggttagtttaggggcagagaagcgaggatccaagaaaccgattcaggccggcgacggttgcggggcggtggctagaagggtcgccggagtggggtgtggcagcaggcgcaagggagagcgacggcactgcctgggaagcggcggcgctgggtggagagcctggttatgtaatctggatgatattctcaagtttggtattgaacttgtttgttctcaaatggttatatgtgcattatgggtacatgctaccatttttttatctatgtcaagtgctttcttgacttgtgtcaaatgctctacaaattgcaaggtacatgttgccaaaatttagggtacatgctgtcaaaattttgcttacatgctgtcaaaattttgccatcggagcaacagtttatgaatacacatatatacaatacatgcagcaatatatgcagcagttatatgcagcaatatactccctccgtcccataaaatatcgaatcctagaagcccgatgcacttttagtccaagcggtgaaagatcaaaatacccccatcaagtacaaccatgattagcacttttgttttgaaaaaaatctctgtgaacactaaattgttcccagccccttcctcgatacccaggcatcccaccaccggatgttcgccgtcgatgcatcagggctgcaggaat

SEQ ID NO: 20963 - DNA, 1939 bp, Oryza sativa
agcagcaacaagcaaccaacttgaccaactagtagtcaaatccaatttgactttgttatctcaagaacacaaattaatttccaacattctcccccttaatttgtattcttgagatcttcactttactccggtcgcttctttatacttgatgagtgctcacacttgatagtcagtaggacacatcttcaacttgactcatgtgtttgcctgagacggtgacgcaacttaacacgcctcgaacaaatactcattcagtcagtcggtcacatcttcgacttgccaaactccctcaacttcaagatgggtagtctgtcgcttctacgacttgccaacttgaacaaaacacacattcacgttgtcctagacacaactcttggcaccaattcagaacggtgaacatatcttcctcaacgtcctggactcaactcttggaaccaatataggactacaaacacaaactagctactactcaccctagacgcaactctcgaatccaattcaagacgaggagcacatctacctcaatatcttggacacaactcttggactcgaatcaggggactcttaactcaggatggcgtcacatcttctcaagatccggagtatcatcttccatcgattctagacagtgactcaacttctcatcttcccagactcatctaccatggtattaactctacaatcccaattcaaaatggtgacacatcttcttgtggacacacattcacaaaaactaacacacaactagctggtatgtatatggaatcaactacatacacataccgagatgacggttcaacaacatgcggtttgcacctcatcatggagccacatgctccgtactaggcacacaccaccgcacaccatctcaacttctcacaagttgttgccatcggcctcactgccacaaccaccatgacgataggtgccactccacagcattgtcatggtgtcatcgggggcgtgctccttacctccaccactttcttgctcctgctatgcccaacttaaaaacaaaggcttgaactctcaaatcttgctctatctatgcctcacctgaactaggctctaataccaattgttgctttttctaatacaaggatctaaatcactcatggaaaagatagagagcaagagaacagagtagagcaaagaagctacattttcatatattacataagccctagacaccatttacataggagtatatgtccttttataggacttttaggtcggtttctacagtaaccgacctgctacagtagcatgtttttacagctcatgttacagctcatctaacaacacaaaactagcttgctaccaagacacacatgctgcttgccaagcacaagcagcaatgaaactacctaatacagtgtacacccttgctagctagtaaaatttgctttgtatccttccatgccaacacaacaaagcatacaactcacttgtgtattctatagcccattatcactcatttacaactaagcttagctaatttgtgctagaaacttcaagcagcaacaagcaaccaacttgaccaactagtagtcaaatccaatttgactttgttatttcaagaacacaaattaatttccaacacgatggtcattgcataagcataattaaggatttaatcatgctagagtgatttctattttagtaatgcaattcatagacctattcatgtcagcattcattcatcatgaacatataggcatcatccatcttagcaacccaatttctctagaaccctagatccagtaaatacaaccctaagtataacatcatcaagtgaatcattaggacaaattcacaagcatcaccagtacatcacaatttacataacaacaccatacaagagaggacaccacactagtatatcacaatagggatcagagacgggaggatggaataggtagctcacctatggagcaga

SEQ ID NO: 20964 - DNA, 5363 bp, Oryza sativa
gcatcaacaccaaaaaccagcaagcctccacctttgccatctggatcgtgcatgaagccacgaactagcaagtaccaacaacatagaagaaccaagaacatgaactagcaagtaccaagaacatagaagaaccaagagccgagaagaaccaacaacagagaaaaagagatactacaagaactagcaagaaccccgacgcatgaactagcaagaaccctgacgaggccacgtccgctggtcgccgccgccgccgccgatgccgcgtccgctggtcgccgcagccgactaggccgtgtccgctcgttgctgccgccgccgaggaggccgcatccgcctgttgccgctgccgccaccgatgccacgtccgctggtcgctgtcgccgacgaggccgcgtccgtcgtcgcagccgccgctgccgccaatgccgtgtctgcttgccgccgccaccgatgaggccgcgtccgctcgtcgccgcggccgatgccgtgtccgcttgccgccaccgcccccgcagacgaggccgcgtccgcctgtcgccgccgccgcccccgccgtcgaggcggcgtccgccgccacatgatggtggagcgggagaaggctgaggagtagaggagagagagatggggagaaccgctgggtgggagaggataaggattgagcggtgtgaactgaacgcgaggagagagaggccatgggcccatcgatgtgctcgagacgacgtttctcgttttgtgcgcaggagtcagttttttgtgggacaaactccctcccctagaattcgactttttgtgggacgaagggagtatgccactatcctgctcagagaagaggaacagcagggcagcaggcgtcctgcagtcctgctcctgacgccattttgatctctatggcgagagaggcagagcagcagccagcacgcgctctgcctccccttccccccttcccgatcccgatccccttctctctgtatccctttccctgacaagtggggccaggggtaaaagagtccgaaaagagaaggaaacaacagaaaacgaaaaagaaaaagagaaaatgatggaaaagagagaaagtgatatgaaatcaaaaaattagcactcctagtagtgtattagagaaggcatgcggattgggtggtaagtttgcaaaggcgcacatatttagtggcttattgtcaaaaatctcgtggagagggtgagggagaggaagaagaacgagagaaagagagaataggaagaaggtggtctagatgggcttttctgttaggctttgacatgtgggctgtatatatgtgtactattgaatttaatgactattgaatataaatctctctcaagtaaagtaaaacttctttcaattaaaataattactcttttaaaaataaaaagtgcaatgatgtttgttttaacactaaatattttagtccaaaactaaattatgttatataaatcatagatctttaccaaatcaaaacatacaaatatatttaaccatattcaacttaaaaatacatatgggtcatctagttgagtcttgaggtgagagtggataacctatagtgttgtagattagctatgatattaaggttaggcatatcatgtgcatcgcattcatataaacattctcgtatttagttgtgttttattgtttctttcagtttggcgtttatcttggatttcttgggattcttcattaatttattcgtcttcgatttcaggtatcttaggcaagtccaacacctttgaccaactcttgttctattttcgtaattgcaatctatatgtatcacattgcattaaattatactttctatgattaaaataaatatgctgatggattggattgactggtggagcagtcggtcatattataggtgtgttctgaacttgccatggtggtgggggttcagttacatatatttatcatcataaggttaaacaacaactgttatatggcattcaagcgccgtagcgatcgtggcaaccacatgacctggaatggaacaggctagcttagtagttctttcttaatggctttatcctgcgggcttaaggacttccgcgaatcccatgagcgtggcctagcgatgagggttgccgttgttgcagaatccgattagatgatgtggatcgctgttgttgcgggatcacatgattcgccgttgttgcgggaatcacctgcagagataattgacagatgggattgatgaaaagcttgtgaccttagccttgccagcatacaccatgaagtgtgcttcaagcgccgacaggcgtgggcattaaaaggtttaaggcgtctgtgggtacagcgacacacctctgcagagtatatgaattatgatatgtcactccgacactccctgtttcgggtagaaactgcgaacgcggcaggaaaggaacctatcggaggttctaatacctgtggtgccttatatgcaatagattttataattacttaatatgagtttttactacactgttttatgaacttgcataaaactacttgttcgattatgggatttggagatatatatattatgcaggtgaattataggcatgtatttgttggattgctatagttgtacttgttgagtaccattcgtactcatcccttatatatattattccttgtagtgttgagctaacaattaggtgaagaaatgttctacatgattgatcaagatcaaagcaaagactcgttccatatctctacatcaactgagagttgaaggtcacgaagatatagaatagcaaggtattgttagtgattattttagcaaaagctaatttctttagtttttatttaatggttttcgctacagttgtttctgttatgctactctggtgtactcatttcttggtaagttggttcttactaaggaatgagccgtagaccggtattctaccccggaagtagaatacgagggtcactacactaattctattggatgcatgcattatatttattagggtaatctaaactaggggatgataataattgtttcttgatctttgggctaagagtggttgtgccttatattttagaatggaggaagtactactaatgtaaaagtaattataatcaagcggtttaccatatttgttgggacaaggactactccctccaaagactttaccagatcttatcccaaaaagtcaaatacttataactggagggagagggaccgagcgagtataagaaaatgacagagtacatggtaatttcacatagaattttttctatcacaaatcggactcgctcttccgaagtttggccgcttggcaatttcggatgtagatagtcatatatctggcacacacccaacgtacacgtaaagataatttgaccgaggtaaatagagtagaccgtgtgtacgccgtcgacttaattagatattcatctgccagtgcctcacaaagttcgtaatcaaaattgttaaatattaccacgtttgcagatgaaacattacatcaaacacaaaaaagagcttgatgttctttttaaaagctataatcacatatactaggtacatcgaagtgcgtacgcgcacgacacaccgatatttgtgcatgtattgtaaataatactccctccgtttcagtttacaagacattttaactctaatcgaagtcaatctgttttaagtttgactaagtttataaaaaaaatagtaacattttcaaccaaagacaaatttgtcgacgtttgatgtcgcgattccggtatttgcatagtatgaggattgttggtactaggatatatgcgagactgaggtaaaagatggcgacgaggatttttatacaggttcggacccctgaattgtcaggtaataaccctactcctgttagccgaagccggtctttgctcttattcatcataatcacaccagtacaatatttggggtagcctatctatctattgtcgacttggcggctataaaaccatcccgtagtcgacaacagagtagtcttcctcctcgaatccgtgtccggcgagatcagagacagcgctagatccctcctgacggtagtcgtaggaaccgtatagggactaactatgcttatcaccgatgtcgatatccggcagcttgtcttggcgcatgttggcttgtatgttgatcttgtgtcttgatctattgttccgtatcccctctcctcctagggggccttgtatttatacccataggtgtccccttgtccaagtagaattaggaaaaccaatatagatacaatccgagtagtccttatcgtttccatgtagaactctattcatcctttcttatgcggatctcctcctatatccgaaggttgtttccgtataagacatggtatgtggtggatcctgccgagatttagtcaactattattagatatatagtatccataaccttgacaaaatttattatgaaaatatattcagttattactatatttatctagaaacttagtcaaacttaaaacaatttgactttgatcaaagtcaaaatgtcttataacataaaacggagagagtataaaaggaatatagaaaatatgatacaaatacaataaattgggatgacatctttttagtgatagaagaaatcctacctatatatatccatatgaatatatttagagttagagtaatatgtagactctagaactaatgactgagaaacaataacatacaaaatgagaagacggaaacactaagtttcgtatattttttcgacttactccaaacttgctcctttattattatgcattaataaccaaaacgttacttgtttatttattagaaactttgatgtcgaaatcatcctactaaagatcaatcttctacaagaaatacttttttaaaaaaaacaaacgagactttttttaaaaaaaaaataattgtaatgacgtaggccttgtttagatatcaaattttttttacaaaaacgtcatatcaaatgtggacacatgcatgatgcattaaatgcggggaaaaaatcaattacacagtttgcatgtaaattatgatacgaatcttttgagcctaattacgccatgatttaacaatatgttgctacagtaaacatttgctaatgacagattaattaggcttaataaattcgtctcgcagtttacaggcggaatctgtaatttgttttattattagtctacgtttaatacttcaaatgtgcgtgtatatacttcaaaaactttacacgcaaggaactaaacacacctgtaaataacatgcgtctaagtaaattggcaaaatttgctacatgacactcaaaaaagtgtaattagctaggagacaccgtaaaaacgtgatacggctgatggacactaaaaaattgtgtaattggctataggacaccagaggcaat

SEQ ID NO: 20965 - DNA, 3536 bp, Oryza sativa
aaaaaatttctcacctattttgaccaagaaattataaaatattgggtccagtgtcctagaaccaattacacaatttttgtagtgtgcatcagccgtatcacgtttttgcagtgtctcccagccaattataagttttttgagtgtcctacagcaaattttgccaagttaattttatctagacttacaaaaagaaaaagaaaataacaaaattatatttatgtgaaaaaaatccaaatacaaggataagtgctctgaacttctgaagctttcaacggtaagcgtggacgacgactccacatgagcttgaccgctccatcactcatcatgttatactacttaagtgcctcaccgccgcgtgaaaaatatcatcagatcgatatcccaattaattccacgattgatcgatctctcgcgcggtggccaaaatgccagagtccatagccgagaatcgcagcaacggcttcgtcttcgccgtcgtcgtcgtcgtcgtactcgccgtgctcacgctcatctgcggctcgacgacgtcgccgctgccatgcgccggcagcgccgcggtggtggcggcggcgtcgtgcgtcctcgccgcccggcggatgctcgccgtcctgtcgccgtggttctacgtcggcggcggccccgtgatccgccgcggccacgagtggtcgcccccgttctacatgtacgcgagggcttgcgacgacgatctctccggcgtcgctctgacgttgggagcggcggcgttgctgctggccttggcgctgctgttcttgcggcggcggcgttcggttggtctaaagaaagtcgataaggtggagggaaaatcagagtgaggaagatgtaaaaaaagattattataacaattaaaagtaatttgtatttaaaacttttatatatttggtcttaacaataataaaacttctatatatttagtcttagcaataaaaaaactaacgctgtcaaaataaggggcaaaatgaactgcaaattttcgctttaaaaattaattttagcagcagcttactttgattgaagattcattgcccgtcgagtccgattcgtttattgcactcttctccccttaacttcacttccttttgtccatcgatcttgtgatttgtgcgttatgtcacatattagaaaatggcatgtaatgacaaacaaacaaacaatgaaattaagtggttgccatttttaccaatttttttgcggtgaaaacggtcgatcgccatgggaatttggccctcacgaaggtcatatcactggccgactttgggtcatggaccgtgatggaccaacacttttaggctgggcaattatccaaatacctaatttaaagttttttttctcctctaagatggtggttttcttaactatttgtcacttttatctatgtggcatgccaacatgacaaacaaggatagaaaataatgtgggacccagtagttagcctcacatccctttcatttcccctccagcccatagatggcgacggtgagcaccttggcgccggggttgtggtcctagaggcccaccaccttgtagacggaggcggcgatgacctgggcgtggtagacacgacgatgcggatggaagcagaggaattcttggtggcgaggcagacgtggcaagcgtccagcttgggctcgcactccctgcagaggcaacggtggtgacatgggagaagcaacacagtggcatcgccctcgccacacgacttgcacaaccactttgacactgctagcgaggtagcgacggtgtcaacgggcaccaccgcggcgcatgccttcatctcgaagcaacaggactggccgtcgttggccgcggtggcgagggggtcagagtcaccgagaagccctcgacactactggagaccggaaggctcccgtgtgctcaaaacctacggtaacaggccaaaaacacacggtaacgacgttaccgggtgctagtgcacgggaacatatactcggaggcttcatcagtttaccgtgcgcacttcccgggtgttttacgattatgcgcacgggaaggccaaaacacataccgagtgtgctgaatcacacggtaaggctgccgtcatagctggactcttgtgtaacggagctcctaacggaacggtggcttaccgagtgtccttcacacacggtaacatttggtgtgttaccgtgattcattcacacctggtaacatgtggtgcgttaccgtgtttgaagcacccgctatgagaacatgtgttaataaaaaaaaatatatgctatttgcaatttgtttactatatccatcagagcttatttccatcacaatataaaccaccaacaagcacacaagagcacaacacattccaacataaatatatatttcagtaaagaggttacaattaataattagcatacaagcaattcatggttcatgtcagttaaagcaatagccaaagttacaatagctaggaacatattatttggttgatgcaaggggggtggcggcggttcggtggagaaccagagtgggtcagaggtggcttgctagggttgaagtgttctatatatagccatatctgttgatgaatctaagccgtccgatttaaatccattcgaccacagtttacaagcagttttgcttggaaaaataatactattcacacgatttctgtacaaatccctttaatgagaacttaaatattcaaattatatataattgttattaaaacttagtttgtttgcaattgttccaaacaatatcatgtgtttgtatattaacagagtgggtaataacactacttgtttatgtgcaccgcttgaagtcacaccgagaacaacacacaggtgggaaatcctaattataacctactcaattaatctcatccaaaacgatatgtggttttgtgttcgtatttatactcatctgtgtccctatccaagtagaacatgggaatcaagccaggatatggttcatctagttctgttggtcttgactagctagtgcgatcacaactgacgttgcctttctatttaaaagataataatacctttcttgcacttttaaccatccggctctcttctcaatcatttgagccatcttgggtactgtgacatcctagcccaattaggatttggcctatgtggctcctgtgagctgtgtgcgcatgtttagtatcaccttactagtttagcacgagttgaaccaatttacaaggcatcttccctccaaccatgccacttccgggttaacccttttatacgaagcgatgaagaaatataagtcgagtggtgtgtgtaagtgggtccgcccgtcggatgggctgggctacgcggttctgaagggagggctattacaggtacattatctcctacttgtctatgaactcttgacggcgacaatgacaagcggtgatggaccgcaacgatgaaaattatcgagttttttttttggatttttatttttgcatccatccacacacaaaaatctgattttggcatgcagatgcgccacccatgtggaaagaactcttgacggcgacaatgacaagcggtgatgga

SEQ ID NO: 20966 - DNA, 7519 bp, Oryza sativa
  unsure (1)..(7519): unsure at all n locations
ggaatatatggaaaatgccttttagtagtgggtaagattaaccaatccaaaataaaaatattggttaaaaggatgatccaaagagaaaacatcggtaataaaagttagcgtaaagtgaaattcaatctaataataataaatcaaaattagttgtattatgtgaattttatcgtctactatattgggagtgtctagattgtagcacacgtcatgccaaatttattttcacaattttcctcattttctatacttttacaacttttatgtgttttttagattttataatattttcctgcaattttcagttatccgtaaaaatattgtgtacagtgagttgtgaattatagataccctattattgcgagttgtattgtctactactctactatctttgagagtgtcgatataaataattttcccttacattttacaattttcatgcatttttttatactttttaaacttttcttttaatttgaaattgttagacattcccgtatgtcaaaacgaaaaaacaggcgggaggattccgctccgttgccgccaacaaaatcatagtgcgtgccaacaaaattcaaagttcgtgccaacggagtgaaaacggaagtatggaattcagtcatgttaccgtgctccaggtggtcccacacggtaacttctctgttaccgggtgtttcgtggtagcgcacgatattgttgggacgttaccgtgttcctagtcctacacccggtaagttactgggtgttttgttaaacccacggtagcatctggttgcacacgggaactttcccagctccagtagtgcgacagcttgggcgggggcgaggcggaggagatggttgagcgtgccgcagaggtccgccacgacgtccccgttgctacgggtgagcccgcaccacgcctggctctcggcggttttgctaaaaatttgtcgacaaattttttgttagaaatctcccagattttccaccgtccaaattgcattatgatttgtgctatctgtccgttacaaccaaaaaaaggactaccataacctccgtgggagtcgatcccatgatctgatgctttgaacgtgaaatattttgccagctgagcaagaaggagcaactaattgtttcaccaaaacaatacttacttattagttatactgtattagttatactgtatgtacatattaattatattattagttacactataattatatatattagttacattgtacttacatattaattacatattagtcacactataattacactatagttacattcgtaagtacagtgtaactagggtgtaatttttttaaaagaaagattttggtgtagttacattataattatactgtagttacattcataagtacagtgtaattagggtgtaattttaatttttttaaaagaaagattttggtgtagttacactataattacactatagttacaagtgtaagtatagtgtaactagggtgtaattttttttaaaaaagcttttagtgtagttacactataattatgtattagttacactatacttacatattagttactgtaattacactatagtatagttacaaatgtaagtatagtgtaattagggtgtaatttttttaaaaaaaaagcctttagtatatgtgctgacaagtagttagttttgtggcttggattaacacgccttaatctacactatacgcgttgctttttaatttggctagcaagttggccgtttggtggttagaaaaatctgtgtgattttataacaaaaatctgtcgggtgttatatagatagatccggctctcggtggtggcctgacagaaccgctcctccaggcctccttcaagagtaggcttgattgatgaataggccgaatacatgcacgcgaaggagaagggccaaatttagttatgggctgaattcattcaaggaaatgatgtgggcaaaggaatatgtgcactttgactcccttaactagtggccaaatctaattcgtgggactcaaagtggacttaatttccgtgggcaaattcatttttggcccattgaaaaaagaatactgctatatgtacaacccaattatacaactagaaacatgcaaccataaatcaatcaaaggaaatcatgtttatatcattgtacccatttacaaccgttgatcaaattcagtcgcaagtgagttggacagttgggtcatatacatagcaatttccttgaaggaatggtcatctttatgtctaatttactgaacgaacctaattaaggttgtgtcttttttgttcctgactcctctctcgttttccacacttttttcaaactgttgagcggttccttttttttttcaaaaaattcctatacgaaagttgctttagaaaaatcatattaatccatttataaaataagttagctaatacttaattaatcatgcgttaatgtaacgttccacaagattagttcccagcaccaaggaaagaacgcaggcttagctcatttacggaggcctgtttagtggtccattcacgacggattcggcccattagctccataataatgatttcgataaatgtgaatctaagacaaaatgtatacactgcgataactattgcgataaaatctaaggtgatcatactaacttaccgcctaacctaaccaggtagctatagcttgtcatgcagatgcagcgaagcttctgttgtacaacgatgaagctacagatcgaagactttttccatcgccagaacagcatcatcctccagcaaatttgaatggtaccttctgaaaattccccaaatatcacctctttcaaaagtttgaatcagctagttcttcagaaagctgccattgctattcccatcttcagaaagctgcctttgctagtgagtggccctggccttggacgtgcccaataggctatttactgcgcacgcacacaggcaataagatatccgcgatgttcaaatggactgaaaaatatgacacattccaaacatccttcatggtttctgaaagtttagttaccatatgagagcaaaacatcgcattttactcattttccaaataaccttaatgcgagggcataaacatccttcttctttgctgatgtagcttcactcaccattttcactgcctacattagaaaaacattatttcagaattaaagaaaataagatatgattgtatgaccagtaccttgtgtgtatttcttaaaaacaaaaaaccatagaaccgaaacattgctgaagacttgaaaggcatcaaaagctaagttgaatgcacaccgctgacagaggatgtccctgcgtcatcaattctctgagttcatgctcaaggaaatcctcagatggagtttcatcagctgaaattaactttccctctatgagcactgtaatttctccctttggctgccgagttgcaaaggcttcatttgcttcaccaatagttccccgccaaaactacaagatgtatgtcaaattcaggactacaaagagaaaataagtaaatacaaatatttatgagtccaccatgtagaatataagggtacagcttggtctacagataatacacaaacaattcagtatagctgattggcatgaacaagaccgcatattagtttcttaattcagagtcaataccaagtagaatctgaccagtagcacttcgcagtaggttcagcaatgtaaagctggaaatgacagcactacaagttaagagtacctgcttatagtgggtgggatataccatctgctgtaactaccagctgaagtatatttattttatttgaagaaacagctctagtattttattgaagattgaaatataaacagagtaaaaatttgttgattacctcttcgtgtaatttcgttatctcccttgcaataacacatgacctgaatatcaatacataaacaaaagaaagatcaacaacgcatgcataacacattagcaccacatacaaatgggatgcagcatagagtgcagtatttcagttgtttatataatactactacaaattccacaaaaagaaattccagatcatgcaataagcaatgatatacatgggtgacagaatatcaattacctagaatcaccaaatgatgaagcagcatcagaaagaaattggtgaattccatggggaggaacatagaaaatttgtgtggcagcttgacaggcagatatttcaagcctttcttttcttgatcgagcatgctttggtaaaaaccccactagaaatgaaatatcagaactaacaacaaatattgttcattgttgataaataaagtaagtacataatcattttattaccaaatgtaaattcatcagttggcaaaccagatgcagaaagagcagctattgcagcagacggcccaggaatggggataacagggattccctcagtagcacatagtctagcctgtaagcaacagtacaacatgcttaacatctcacacatctagaagcagcatcgggctttaaaaagaacagtctctgatgctgttactgctaacttgagtagtgtcaactaactgatagcacatgtagaatgtgcttcaataatattgttatttgcagggcatttcactattagacactattcattgcctatttgtttattcatggtttaagagagtagcaggatgtactattcaaacagattggcaagtatgaatggtcaaaggagtgaagtgatttaccagttccatgccaggatcactaattccaggagtaccagcatcactaatcaatgcaactgcttccccttcatgaagtctctttaagatattaggctctctttcacgctcattaaacttatgaaagctgagctgcaaggtttacagtttagactaagttcaatggcactcatcacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaatgccctgcagcaaggaccatccaagcttaaagctaggagcatgtttcaggaaaggagcacacgctccagttacagcctattactacacggaggtagcctcaaggttcagccaaaacaactatgttttgtttttcctttttcttcttctttttttttgtgcaaaacaaaaagatgccctccctgatattttcctcatggtaaaaagtaaaggggattgataaaaaataataataactgatgctaattgtgctatcaaacaattaaagtttttttttctccctgtagagattntagcagaacattgctctatttcctcttttattctaaaagaagtgctgctaatcagctgattgcctattcacaaattttgttaagagtttacaacaattgtataatcagacaagtcccaatactttcgccttttctttttaagtaaaacggcataccactgtcagttctattaccctggtatacccttatgaatcactagatattatgacatagacatcaaaattcagaagatatttcgtaggcgtcagcttgatgaccaagtgttttcccacacaaaaatgtttgcagattgaccccataacagattaaaagctgataccttaaggtgatatcctcgaggttcccgattggcgttgccacaagatacagcccggaatccaaatcctgaagattgtaatagatcaacaacagacatcatgaaatagtcatggacaatctaattgaccaatatgtacatattccccacaaaatacagtacgaaagcattcttgcgttctactccagttctccagttcatacagaagagtagaagacacaagcacctgcataaaaagcaacattccgaacaacagctcttatttcacttgagagctgagaaagttcctcatggtccacaggtacgaatttatgcttgctcaaacattagaagaacatccgctcgcaatttggcacatagtaatgcatgaaaaacacacttatcttaacaattgctaaatgtctcaatactcataaaccaaaattacaccttccacatcacctatgattttagttctacggcccaaaccaatgcgttgttctgaaaataccaattttttttctagctcttctgagatgcactcacacagtgaaaccccccacgcccacacatactgaggccatccacccgtgagaaaactttgcaagagaagtgaaagaaaatcataagctgatgtactaatggagacggagaggtcaccggttccgaggcaggtgactccggcgagctgccagaggcggcggcggtggagaggcggccggcgagcggagccgtcgcagtcgtgacgcggagagggaggaaggggaggcggcggggtgccgttaggttcagggcgagggcctggaggcggagcagcgacgccatgggctgcggcggcggcggcggcggccggagagggaggcgaagcgtcgccgccgtttgctcccggagcgagaggggctggagaagtggggagtagatattgtggtgggcttcgctaccgttggatccgatctggacggcccatattggcccagggtttaattttctgggcctttgcctatttctcccaggtaaacctgcatttttaggatcgttttcaccgcgattttttgttttaataagaagtagaaaatggcgctggctagttaaccggtataggcatatgtaaaaaatgaataagcattcaataaagccgttatatattgtaaaatttatctaaagctctcctaatttgtaaaaccgttatatattgtaaaattttgaaatcctaattttttttcaacaaaattttatgaatattcaaatgttacttacaacttgtgttttatctgatttttgcaatgtaaaaaatcatacataataatcgataccattggacaacctatcaaatattgtcaaccacaagttagcctagccattgttattatgttttacgaattaacattgaaaatctatatgtctgttgacgcacccattcattagcccctattcttgtcactcactaaatatacacgttagtggtgcgcccaccaaattatagctattgtataacgttagtttactattctatttaggaatattatatagtatttataaaaatagattaagttctataaaatccgtgcagaaatcatatgttcaaaatttagttacaataattcttagttgttggttaggatcctagggtgtgttcgggagaaagagttgggaacccctccttcccggcacgcaaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20967 - DNA, 679 bp, Oryza sativa
ttaatgaatatgaacttagtgagaatatagacatctattatatatcaaattccaatatagagtgcataggattacaagcatttgcaccaaattggtatagggatattaagtctaaaaaggatatagaaaaaattgttcaaagattagaggatatccaaattataggagaaattcctatgaaatattgggagaaaaatgctctcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatagtaagaaatcatgcggaagaagttagaggtaaatctagaagcatagctgattatgaattttctttattaagagatatagcataacttattaagagatatagcagatgaatataataactctatgaaaagtgagtggcctaaaattagagacaaggaactttatttctatagagaactatccaggattaagaaacaaaaaaaagagaaaagcttggtcatagaaacccccagaacccaggaaattaaaatagaacaaataaagtcagaagaaccaagagaagaaatccaaaagttagataaggtattaagtgagg

SEQ ID NO: 20968 - DNA, 3542 bp, Oryza sativa
cctgtaaatgaattcatagataaaatgagttttggtttccaaacaaaaggatacgaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattagatttacaaattataaaaccagagcttcggatgatttggatgcagaatcatctgacagagatattatagataacagaagacatattatatctgaattgatggaaaaattagaccatgaaagtgaaataaaatattatgaagataaattaagagatatagcagatgaatataataactctatgaaaagtgagtggcctaaaattagagacaaggaactttatttctatagagaactatccaggattaagaaacaaaaaaaagagaaaagcttggtcatagaaaccccgagaacccaggaaattaaaatagaacaaataaagtcagaagaaccaagagaagaaatccaaaagttagataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggaaggtttgcataatctagataatgcaatggaagctatggaagtagatttgggaataggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtgggggatatgataacttatttagaaacatttttgggtgaatctgctaaagtcctatgggaacaatgggttgaaaagaatcctaataactatgaagagctaaaaagagcaggaagtaatcctcacaactttgcaaatatagtatctaatattatcatagctgaagacccagaattaggatatacaaccctgcaaaatgaaagattaaaagaaatagaaaaatatatatgtatacatatatatatatacatatatacatatatatatatatatacatatatatatgtctatacatatatacatgtatatatgtatatgtatatatgtatatatacatgtatatatgtagatatatatgtatataggtatatatgtatatatatagatatatatgtatatatatacatatgtatatatatacatatatatgtatatatatacatgtatatatacatatatacatatatatatatatacatacatatatatgtatatatacatatatatatacatatatatgtatatatatatatatacatatatatgtatgtatatatatgtatatatatatacatatatatgtatgtatatatatgtatgtatatatatacatatatatgtatgtatatatatgtatgtatgtatatatatatatatgtatctcagaggtacgaaagcgtggtggagccagaatcaaacccaacaaccttgaagcactcaaccttgagtctgaagaaagaattaatgaatatgaacttagtgagaatatagacatctattatatatcaaattccaatatagagtgcataggattacaagcatttacaccaaattggtatagggatattaagtctaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatagtaagaaatcatgcggaagaagttagaggtaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacctgtccccagggacactatgaatggctagtaatgccactaggattaaaaaatgcacctgccctatttcaaagaaaaatgcaaaacatttttaacgataatcaagaatttgtgttagtatatatagatgacttgttaatattttcaaaaacttataaggatcatattgctcacctagaattattttttagaaaggttgagcaaaatggtttaatcctatcaaaaaagaagatggagatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatacactaaattaagaaaaaatggtcagaaatattttaattctgaagacattaaattagtaagattaataaaagaaaaagtgaaagaactaaaacctctagaattaccattagaagaaagttactttatcattgaaaccgatgcatcacaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaactgattgtgaagccatctgtagatattataaccagcttaatagcaagaaaagctcaactagaagatggattttatttgaagatattattacaggaaatggttatagagttatatttgaacatattaaggggaaagataatagtttacctgacatgctttctcgtttaaccatatttcaggtatgaaaagatcaatgaattacgccggagtcgagtgcttcacatttggagatgacaacaaactca

SEQ ID NO: 20969 - DNA, 1933 bp, Oryza sativa
aaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactctggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatcttgttaagttgcttctaaaaagatagataggtgaggcttacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtattttgtctgaagcataagtgtctgaagcataagtgtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaatggacatatctaggagtctctttagaagaatagcaagcagagatgataactgttctgataaacaaaaaggcaaatatgatgacatagatgagctgaaagatgttgcacaagtagataagcagctcgaaagatatcaacgagatactttaagggcaataaggcctcaacaagtatactgcatgggattttttgagaataagaatgggctttatagaatatctagagaagtagaattaagtgttctaacaaagccagtagaattaaaaatagt

SEQ ID NO: 20970 - DNA, 3078 bp, Oryza sativa
aaaaaagtgatggggctatactaaatctagcagcacatgatcccatagactggccaaatatcattagtatttggaaggggttaatagttcaaaaatacatacaaaatcagcataatatagggaataaggtgggggatatgataactatttagaaacatttttgggtgaatctgctaaagtcctatgggaacaatgggttgaaaagaatcctaataactatgaagagctaaaaagagcaggaagtaatcctcacaactttgcaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattttgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcacctttcttacataaacgaaatgtaagaagatataacccaaagaaaacttatgataagacatgcagatgtttcatatgtaattcaccagatcatttaagtagaacttgcccaaataaagatcaaaaaagatattctagtaaatatgaagaacaagagagagttttaattatagatagcgtaaatgaaaatatattagtatgtgatgatgaaataaaagatgacgaatcaatatattctatcatagaaacagatgaaattgaaaacaccaatgaagagtatgaatcaaccgatgaagagttagatttaattgacgaactagccggtttaaaaatagaattgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtggaactagagaatctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaactgcctttcaaagaaattttgggaataagaataccggtaaaagtaaaactatcacccaaggtatcatataaaattctagcactagtagacactgggtgtacaaaaaatattattcatgataagtacttcataaaatgtccagaaatagttcatacaattgatgataataaggcagaagtctctacagacatgtccggaataaagaaaattcataatcagctagctcataatgttgaagtatacattaatggaactaaatatataatagatgagattacaataagaaacttatccatgataagtgatgacatgataattggcctaaggtttttacaacaatcggtacaaaccacagtaatacatgagcaaggaattacttttatcccatatcaaaacaatgtaagcggcgggtatcaactagtattcctaatgaaacacgaccaatcgttgcacggcctaaccgctcgtctcaccttgaaccgctagatcgagggtgccttgtagtggctagtgcgcggctcagataagtcatcctcaacggcgatagtgacatagatcgactttggcccggtgtatatagatggcggtgaaaattgggatgctacaaccatgacggcggtaaccagaattgcactacatgtcgcggcggttccggtggtgatgcattatatggtggtgggcagaaaccactgagaaggccgagctcgactaagagcaggtacaataacagactattagccagctacaaacatattttaatgagataaaaatgatagagaataacagcgggttacagatctgtagccagttgtaatacggactctaatacgtaatgtgtatatgacaggtgtgaccatataccaatagtatagtaagtaattattgtataaaatagctattagattggctatagctgaattggagctaatagttaactatactattaaacttgctctaacattgatggcgccagtggcggtggcaagcagcatgtcaaagcatatgtacgcttgatacgatcgagattcgagaggtgactgagagctcgagccaagagaccgcgagcctgtgcccgaaaaaaaagaaaaagaaggtgatctcaaagggccaaagaaagaaagaaaaaagaaaacgtgatctcaaagggccatattctttttccattggattgggccgaaatacagtttatccaatcactcttttgagcccaaggtcagaaaattcttaaggtcatgtatttctaaccccggtttggggccaattacattacagtccttccaatctggctctttccttctatccgaattttttcgtttttagattttttttaatatttacagaaataatctatcgaccaaaaaaattacagaaatagcccctgccgccctaatggtgggcggcaagctgacgtggcagacggtgggtcgaccgcgccgtctgccaccgtcggcaaaaattgcgattaggcccttgccacccatacagagggctgcaaggggctaattgcaattttggccgcccataaagagcttgcggccgtacttttt

SEQ ID NO: 20971 - DNA, 7252 bp, Oryza sativa
atgaaaaagtacggccaaaagatttttctatgttatgttaataataaataaagaagtatttattggtaaaacttgttaatattgttataaaaatgtattgaagttggttgttgcgcaatttcaaatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaattttaatatgctaagttgtccgataatagctaacccctacgtgaggatccctctcctctctcaaaccgcgctttcaggccggcctcacgtagcctgtaataacaaattaatatgtcattataaaaaatattacagtgcaactaacttatagtaaaacactgttcgtacctcttgacaaaggagtcgtgaaccgtgagtagctcaccgcacgtcgtgcccggaacgtcccaagctgagccccctgcaccgcagtaaggtgagaccggtgtcggtgatctatcgccgggtccaacaactgaggtgtatcctgacatgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagttcgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacacctaggacgtggtcgagtggaggtagtgccttcacccgtagggcgagctccatctgctgctgatcctgatagtcctgcctccgccgcacatggtttctccttgtctttaggacaatgcttgtaggtgtgcccatgttcatcgcatttgctgcaacgcttcaccctgccagcctccgactcgtccatatcgttgcggatgcgatgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatggctgcatggcctgtggagcagcttcggctttgcacaagagcaatgacatgtgccgtcggctttgagaacacactcctgcttcactctcttgcggtagatacccctacctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatccagttcttctaaccaatgttggactatccgttgggagaggtccaagagcttgagggtcagcaacggcggtcgatggagccgctgcacgctgatcactgcatttggctgtcaactcatctaatttcttccaaagctcattgaattttttctcatggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaataccatcttgcatgcatgtagagctaagaacgccctttgcagcacactcttgctaggatgttcaattgaggggaatttcttcaattcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccagttcgacttggcaaccctaaactctctatgaagtgacactgcaaaatgttttaccgcctccttcatatcttctgctctactataaatcgctccctgaataacctcattttctttgtactcccatctcacactatcctcttcagagacaatcagcccagaaaaatcctcactagcccattctgctggattaatatccgtctcatcatctgacgaatcaccttcctctacacgctcgttgtcagaatcctccctctccatttcatccacaatggcaccaacagtctccccctcgtcggccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattcattgttatgtcacttgtctgtggatcaactctcaagcccctcattaaccatccttttatagaaggtacactcctctcagccggtctatcaattcccctttctgatacaataaaatctgacagatctaccccagttggcccgtaacggaatatttgtttgttcgacatatctgtcaacgaaataactagatcatattactctttcatgcaataaacatctacaacgtaatatcttcttgtgtaagccaatgcaacggtaatgtattgattccaaactagcatatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaaaaatgagggctgggggctgggcagcaggccttttataggcagcgaggcctgccgcccggccagagggcggcaaggggccgcctgcaaaatagccggccccgactggcttttttgcgttcgggccccttgccgccccaccagagggcggcaagggttttcctgcaaaaaaccctccctccgtcaccgcccgttcctcccccgtttgccacgtcagcttaccgccccagaggtgggcggcagggtctatttttgtaatttttttggccgatagattatttctgtaaatattaaaaaaaatctaaaaccgaaaaaaactcccttctttactttgggcatcatggcagggtagggtagtagatagagagactattgttgttaatgactacttcaagatgaggaaggaagaagtcgatagcaattgccagcttgctagcggcacacacaaacatatgcactggtatgatactccctccgttttaaaatgtttgacactgttgactttttagcacatatttgaccgttcttcttattaaaaaaatttatgaaatatgtaaaattatatgtgtacatgaaagtatatttaccaatgaatcaaatgatatgaaaagaataaataattacttaaattttttgaataagacgaattgtcaaacacgtactaaaaagtaaacggtgtcaaacattttgaaacggatggagtatattgcgcgtgcctcgtgggtaggatcagaaggaagcaaggattctggggctttgctaatcgagcatcctttcttctccgtcgtctgatctgctcttcgacaaatcacggtcgtccgtgtggccatcctgtgctcaccaggcgccgtccgatcccgaccgtcaatcggccttggtcgatcctagccgttcgtccctgccaatcctcccggtggaccgggttcacgatggacaaccatcttccagttgttgatgcttgggacccacttgtcaccatcgtcaccggcttcgccacggctgatgcaataagtttcatttattgcatcataaatcgatatatccttgtctcagcacttttgaaattaataactaattcatgtaaactctaaaatagattattcaacttgcaagattcatttaaattcaagatctacatgtttgtttatttttatatacggttttatttcgcttttattagagttttttctcgttttgcgtgccaacgtgttagaatccacaatctcagaagaccggaaaagggttcaagagattaatcgaagatgccagacaaagtgacatatttctccttgaacaggttgaacctactttgtaaaaatgttttgtcgtttacaaataaaatgcatgctctgttaattactcgatgttggctagggctgcttgcccttagctcaatcaactcgtgagcagctcgcaaaacatctcaagttgactcgatattttaaacccattgaaacatcagctcaactcgtttagaaaactcaatgaactgagctgaacccaagccacgagcttttcgtctaggtccgtatacactacacaattcctactacacaattcctgagttcatgttggtagtaactaaattatacatgaattatacatgctatccccctgcaccatcacatattagtttctttgcgtatatatatctgactagaaaactgtcagtgcggcaacgggtaaatatgttttttatggtacaataactattaagagtcgagtaacaaattaaaacattgggatcgctatacattataattgaaaacgttaacgaaatattttcttggttttgggcaaaaagccaatttcttcgttccttttaacccagcccagttcgttacctcctccgctcagcctgcctcccttcggcccaacctacaagtggagccataggcccagctagcacaaccaaactggtgtctttgatagtgtcgtacccatatgattccggaaccgatcctccccaccaaatctgtctggatatttgttgatctctcaaaattggttgagagcttcttagccactcaatctcctctttccattttttccaaaatcggaacaatccgcaaaattggagataaaaacagcctagaagctcgtcgaccgcctatcattggcgactgttaattggagattaaattcggtgaattaaggccaaactgaagggaaatcatgggacaaatgatgagggaggagcggggaatcgacttaagacagatcaacatggtggtggcggtagggtttggcacgcgcagtggctggaggcaccctgtgtgctagcggatcgaatcagatgaggacgacgttcggaaaaacagaaacattgctattttttattaggtatagatatagataggtatgatctattagcttaactatcgtagataaataataaaagtcttataaaatcaagctcgttagaagctcgagcttagcccggtaaagctcacgagctttagctcggtaaagttcgtgttgagctcaagccgagctcaagtcgagcctgccacccatcaagcttgagtgacttgtgagcctcgcatgtttttcattacagccctagcgattcactatggcctagtttagttcccaactttttcttcaaacttccaacttttccatcacatcaaaactttcctactcacacaaacttccaacttttccatcacatcatttcaatttcaatcaaacttctaattttggtatgaactaaacacaccctaggtcagccctcaaaataaaaaatatcaatagcaacttcgcttatacactatgtaccgtgccaccaactaactagattacacatagaaaaacctactccctccatatataacagggaaatgctacataattattctgactattcgatcagaatgatacgtttgatatctggtaggtatcaactaatacaccgtctgaacaagatgatacctctaaggtattgtctgatatttggtatgtattggctgatattaaggtatcaggtgatattttagaggtatcatttaatcttaatgggataccactacgtagcattcctccgcataatatagaggcagtaaaaaaaaagaaaagaaaaact

SEQ ID NO: 20972 - DNA, 11607 bp, Oryza sativa
cttccaaccccccaccccccaccaccaggtgagtggatctcccatttccccccctctccccgcgagctcgccccgggcgggggatcctagtcttgacccgtgtgcgtgtgtgattcattccgccgcaggaagagcgtgcttggatcgcgcgggggaggcaacgctggcggcgcgcaggtgatggcggatccgcctggcggtgggggatctagcgcttgcgtctgtgagcggagggaggcggaggcggtggtggtggtggtggtgccggagctggggagaagaggaggagagcagcggaggggaggatgctgagcgtggtgcgggtgcacctgccctcggagatcccgatcgtgggctgcgagatcacgccctacgtgctgctgcggctgcccaccggcgtcgtctccaccgacgatgtcccggaggccgcccctgcggatggctacttcatgcggtacagatggtgagtaactcctcgagactctgaaaatcttagttgaatcagatgagagctgtggattgtgtagttctgcttgcttgattgctaaatgttgcgcactaaacttattgctgaatgttgcgcactaaactttgaccaagcaaggggaattttcgtagctttggtcaggcagatttctatgtgcttatatagttgttaaagtttggggaatgctcatttattggctcaactccttcataaatgaagcatagttggatgtattcagattaaatggtctaataagcttatcgtttgttttgtctgaaaaatggagccttagagattgtaaaatttagatgcggaaacatctatactgctgagttggaaacatagtttgatgcatatgaattgaaccgtttggtacatgtttttcaaattgcattatgacatatcaggaagcacagtttagctaatattaattgctatcatgagtgattcattgaaaagtgccattaattgggtggtttctgatgataaaacaagtgttattagaactatgggacagtagcaagtatttttgatatggggtatgttatgatggcttgagaaatgttgtcgtgcaagaatgttagtagtatccatcttcgatggaataggtatataacacactttatggtgttctgttggatcatcctatagttcctattgaaaggccctgttctatgagttctatgagtttctcctcattgtctgttgagttgttgtagaattggatccattacgctgataataaacatgattttatatgctcaagatgtgcaaatagcactgatgtacacgatgcttatagctagtttctgtgagctgataatgcaaaacactagctctttaggtggcctttgttggtttcaacacttccagttccaatgggatttggttataatgttttgatttactccttgaaggtaccgtatacaaagtgatcgaaaagtcgcaatctgcagtgtacatccaatggaacaagcaacaattcagtgccttggttgcgtcaagtcaaaaatacctgttgctaagagctaccattgttctgctaagtgcttctctgatgcatggcagcaccatagggtcttgcatgagcgagctagtagtgcattaaacgaaaatggagctgaagaagaggagctatttggcagatttggtagcactggttctggggttcttagtactactggttctggatcgatgtcaaatcttggacagagtcctggtttgaataatggccccgtgcctttatatccttcaggcactgataagaactcgggtgaaacttggtatgaagtggggcgcacacggacatatacaccaactgctgatgatattggacatgttctaagatttgaatgcgtgtctgtggatgctgaaaaaaaggtacctgttggacctccaacttcaattatgacatcccgtgtgattccagcaccaactccaactccacgtcgccttatccaagtgaatggagatgttttgagtcacttagatttggacagccaaacatctttcgggacattctcagtgctgtcctacaatattcttgctgatgcatatgctacaagtgacgcgtatagctactgcccaacatgggcactttcttggacatacagaagacagaacttgatgcgtgagattattggttatcatgctgatatcatctgtcttcaggaggtatcatatatatcaactaaatttccctattaacttttttggtgatttgttctattatttcccccacacagttacagttaattgaatgctatgctagattatggtggttgggctgctgtttcaactgatgcaaattttccacacttacctagagttttctgaagcttcttgtcatattatgctctaataatacttgattggtctcatcattttgaactgaattcatataataaaaatgctaagaaacaaaactgccctaaaatagtattgtaggttgacttctttgtgaaattgaatccataagtaatctaccttcataaaattaagttgaatcctactgttttcaggtgcaactgaaccacttcgaagattttttttcacccgagcttgataaacatggatatcaggcactttacaagaaaaggacaacagaggtatatttgactgcatctggttctattataatacgcatttatacgcttcaatttcttatttgattctgcttcatgtttttaaaggtatatactggagctcctcatgccatcgatggctgtgccacctttttccgtagagacaaattttcacacgttaaaaaatatgaggtacggccactgctgatttgagagtggtatgctaatctgcaggctgcagctatctaatatttcttgtacctggttgttcaggttgagttcaataaggctgcacaatcattgacagacgcaattattccctctacccaaagaagagttgctttgagtcgattgattaaggtatgataaattaatagaagaggatattgcatgctaatttattccattgctgacttttcattattgctggttctgttttctttgaaggataatgttgcactgattgcggttttagaagctaaattcggcaaccatggaactgacaatcctggcaaaaggcagcttctttgtgtggtatgtcaacaactctgcttcagagaagcacttagatgctaattgttagcagcattctgaagggatcagttaaatgttttctttggacaacggatttggactcattcaggcctcgtttggatgtgtcgaaatccgaaagcccagtccatatatgcatgtatgggatttcagttcacttttcatggcttacatgtggatggactgggattgaggcccatccaaaagatatgccttgggagaactatgcaaggtttacatgaaattaagatgcatccacatctctgaatcttgatgcatggctttagtattacatgtttgtcagggtgacctatctttaattgactttttttttggtgggggaatgggggttgggggttttatacaattcttcataccgataaacagtcttgacttgatgcattatggcgtcatgggggtcgcaggtctcatcactttttcaactgttctcactctgcaggcaaatacacacgtaaatgtccatcaagacctcaaagatgtgaagctgtgggaggtctgtgccatcacattttctttatgctagttttgtgtaacatcttagaatttcagattgacactgtatggcttttgcaggttcaaactctcctaaaagggttggaaaaaatagctgttagtgcggacattccaatgttggtctgtggggatttcaattcagtccctgggaggtgtgtataaatatgctatcactgtagtatttatttggtaaaattattttgaaaccatggacttctaagtactcaattatgctttcagttctccacatggacttcttgctatgggcaaagttgatcaattgcatccagatctggccatagatccccttggaattttacgccctgcgagcaagttaacccatcagcttcctctggtacagtaaaatatattggtctggtgatcccttttatcccatgatcaaagaactcttaccaagggtcttgcttgtttgtaggtgagtgcatattcttcatttgcaagaatggtcggtgtcggctatgatttggagcaccagcggaggaggatggaccctgcaacaaatgaaccacttttcacaaactgcacacgagatttcactggaacggttgattacatattttacacaggtcagttcctggaccagtttatatctgtatgctttgatattataattttgtagcttcagtaaacatcttttaaggattacacagctagtgtcatgaaacatttaatgatggcccacacttgctttcgtatttcagcggattcattgtcagtggagtcgttgttggaacttttggatgaggaaagtttaagaaaagacacggcccttccttctcctgaatggtcttcggatcatatagcactcttggcagaattccggtgcaagcctagaatcagacggtgacaccttaggtatgtcataagggcataaccacattttaattatactgtaggactgcggtgctctgattttgctagtgcaaacagcacatggctcaagtaagatttggtgcctgcttcgctgtcaaagtgccacatgtgcaaatacctttaaattccagtggtttacatttgtaacaattaaagctaagaaaattgttttttgcacaataactcatctgaaagtacgcagaaatcgtcattctagtcatgtttgttgttgtccatcacctcatttcatctcggtgaaaagtaacataacatgtagtggatcttgtctattatgcgcaacacacgacaccctttcttcatttgatgttccaagctgactgactttcttcaggtcgcgaatagatggttaacttcagcacccatgcggtggaacattcttccatggtgtgtgggacttgaggagggatggacgaaagcggatcctcggggaaggaccaccagcaccagcaggcttagggtagtggcctcatgaaagggaggcttgtaatgttgattacctcttacatttccaactcatgatgtttttaagcggccccattgtaatatcactttctatagaaggaaagatctcctgagagagagacatttttatgacagattcagatgccatcatggctaggccatttcaaattttcaatcccttctcttctagtactatactgcagtttttttacccaaccctgatcgtgcagtgtgtacttgttggaacttgtcaaacttttatggcaaattttagttgttgcagggttgacaaatggggagatgaatggttggtgctttggtgggcacctgatgtcttggccatttatacaggtactgtggttttgctgtttgtacgtagtatagatggtagttagccttggtgtccatgtgccaccgtgtcatgagttggctggaacatgttacatgtatttggcttattctaatttggcttgtctgatctgatcgccaccaaacgctcaacatttaggcgatgaaaacagcgagagatcgctggagataacataaccccgtggtgttaatgaccatcgggtatcaagctcaccaatcttgatttggtcatggacattactaatcgtactcttggaagtttctctcttcgttggttggtcaggtctattgggacccacttgcagcgagaggagtggtgggcccacccctcgtggcgcaggtcgatgctggactgggagtgacgggcgcgaatttttacttgtttgaccccgcaaccgcgtgatcttcctccggtgttttgtcgctgacacctgggccccaccagggacaacatgaccgctgccgtgcgtggccgccggggacccacacctgcggacgtgtgcaggtgtccgctaggtccgtcaacggccgtcgggcaacggcaaaggatgcttctattctggagttattgctgctgtttgtttggacggtttcatgatagtcttaaagaaagctcgttccactaagagcacccgtaatggtaaagtaaggtgctctctataagacatgtacatctcagcaatagactagattaatagtaaaccacctcaatagtatgtctacatagatatctatagctctctaatgcattgtctcgtttttctctatagactatctccaggttagtagatagttttgctctctctcttcatttaatctcttccaagtagaaaaatatgctgacatggatctcttgtagagagtctatagataactattgtgggtgccctaatggcatctcggagatgagaaattttaagacacatgatcgagtatctatgtcaaggggtgtctaatactagttattattacaggatcaagtcactagagattgtttgtagtggctatattggctatgtatgatgtataatataaagcataacaaataaaaactttgccacatttagtagtttgaaaatataatatgtacgcaatggccaaaaattgatataagtatgattatattatagttgtggtggttaacagggcatttttctaacatattacgtggtagttatgtataggcaactaggcatcacaagctttcatcactacagataacaagttctacgaatcctatttgatgataataggaggttttatgtttcttaaacacatattaacaaatgacatcaagatctatttcctttgaaacaatgccatgtattcaattgaacaacatatacaataaaagttagagaaaaactcacaataaggatttagtgataaacattgcaatgaaagaaaaatgaaaaatatggtggatgatagatgatatggctctagcatttacactcactctctcgttttagtaaggataaaatggtaacctcttcctacatactactatctctctactcaatcttacctaatatcacagtctcatggtgcgtcgcgaacttgatccaacaacaggatattactatggtaagccaattgctccatctaaggtgcgtctccttgattgaataatggacatttgctctacctttatatgaagtctatcaaactagttgtacttttcaatatgatgataagtatagagtaatgcttaatccagatacgggctcatgttttagtttaagatcgtctccttaacattatctttattctataattataggcctattgtttgaacaacaagcacaatgtacttgtcaaagtcgaaaatagcataggttccaagatcaagtggcaataattacaatagataccacaatgtgttatataaggggggggggaatgtgacatactgtcagacaatggtaattattatagacaccacaatgtgttatatgtaaggaaaaaataataaggggaggttcacctaaaaaaccattgatccttaacctcccatgacatctccctgcaacaaacaatatataaataatgcaattaatttgcatgcagcatccaatagccatatcacgtagtctcattcaatacttcttgctagataatatgaccatattttttatttttacccaaatttctattaattttagttatcctgatcagatggcattgatacatagtacattaagaaaaatcaatttaaaactggatatgacatattctagtataatgaatctagacggatgtatgtccaaattcgttgtaagagcaaggataataataggctataagcaagttatatgcttatgtggaagagagagataaaaaaaagtggatagtgttggctctcatgcaagagccagctccacacaagctccaagaaatatgcattaaattcatagagtgagaaagagagagaatggagaaaataaggttaaccttatagctgacctattatacaagttagctctaacatagacatagtaagcagtgagctctactattaaatctactctaataggatgtgtcacatctaatactaggttggttttatatgagacgaaggagcaggacagtaggttattctcccaaacaggaaaaagcagaaaacaaaaagtcattcgttcatatcatcatacgctgtactgtactccctccgggttgataatacttgtcgttttagacaaggacacggtcttcaaaaaataactttgaccattattttctattataatatgtagaaaagtgttaacaaatatatgatcttattaaagtattttttaagaccaatctatacatgtagtcaccatatttgaaatacaaatattttaaaaataattcataattaaagattgtaaagtttgacctcacccttgttcaaaacgacgagtattatcagcccggagggattacgtttcaaacttgacaaaaaacgccgttatcgaagcctccgtgaaattccaatcaaattcagggtgcaaaccacaaatgccccccatttggaccatttgcctctcttcctcctctccatctccacgagaggagagaagaagaaaaggagccaagcaaaaaaaaaaaaaaaagcgagcacgcgaacgccgcgtgatccaaatcgaatcgaatcctcctccgccgccgacgagggcacccgccgcccgccggtgagcccgcgcgagcccggccggattcgattcggccgccgcccggttgatccgcccccccgaggcggcgggtggtggttccgagatctcccggcgagccggaggctcctccgcgtcggatttggcgccgcgggggaggaggatgggctcgcggataaaggagatggtgcgggtcgccaccgcgcggctcggcggggagccgtcgccgcgtgggggcgcggggaactccgcgttcggccgcggggagtcgtcgaggacggcgcggctcggcggcggaggggccagcctgaggcggcagccgcagccgcaggcgccgtccgtgcggaccatctgctgcaacgaccgcgaggccaacgcgcccgtcgggtacaaggtgagcgcgccccctcctggcggtttgatcgatctgttgagagtttcgtttggaggaggaggagggggctggtctaggtctagatctcgttgcttttcgcgcgttccttgctaatatgtggttgtgctggagataggtgtgtcaatgagctgacacagaagttttttttttttttaaaaaaaatttccctgatgctacatggttttgcttagtttttctggactggattttgttagtcatttgggttgcattaatggagaactatgaggtcattgggcagatttgagcttatctagcttttggaattagtaatttaggtagctattgctaaaaatgagatgtagacaccgctcggtttctaggcttgaggaattatagtacaagagctgaacgatgctattcattcttgccccaatattcaccagatgcatgctgtgtcggctactgaacctggatcagtccgaccacaactagctcaccctcaccacttgatagcaccaagctaaattaaatttagtttttacttgtaagacaaccttatgtttcaaataacaagattgtggatcatgccctgatattgtgagtgcattgatgccaaaatgccttaatggaagggtgtttcaggtgtttcatggtcataccggaaagttctcaatttattctctttcatttggttgaatcctatcggtcaaaatgttcccttttcctccctgcgaaactgctttgactatgttgtactccctccaggttgaaaacaattgtgtttatggacaagactgatgtccaactttaaaaactgactatgaataacttctataaaatattttctttagaaacatggaaaccatatgtatagattgatcttaaaatatatttcaataaaatcatatatttgttgatatttctacatatattgtaatagaaagtagtgatcaaagtttgttttttggagaccgtgtccttgcccaaaacgacaattattttcaacctggagggagtaaattggtgtattcatgaattttcttttcaccacagctgtatttgcccccttgtttcatgtgttgtctctaaggattaaaatgcatcaacaccattgctatattgctaacgtggttgtagtttgtttgaccatttatgcagttctctttttaattgattttgcagtttcccgcattttgggtatcaaactgtcaattatgcaaatgctaatatcaggacgctacataattttggttgttttgctgttgaggaattactgatatatttttctctttttctataacgtggttttttacattgcctgttctcatttgcagggaaattctgtgtcgactacaaagtataacgtcctgacttttctacctaaagggctgtttgaacaggtattacaacattgtttctttgtccattacatatgttgccaatagagaaaatttaggtttaatctccttttgtgatgaatctaggtattgttacgagcatcataaccatccttgtcaaatcaataaacgtttaccacagtggatgtttcccatggctagattgctgctttgcagttattgctgtgacatcaactttttgttccataaaaaaaataatatcaacatgtgaaccttgtgtagtttatctgtttattttgctttgacagttcaggcgggtggcaaatctgtactttctcatgatttctatattgtcgaccacaccaattaggtatctctatccgacacacccctgcacgcacctgtgctacttttggaatccactggtttcatattgacatgttgagcacagcacttattcattggttaattcagtcatcgctgttttctttttgcagtccagttcatcctgtcaccaatgttgttccacttagtcttgtgcttttggtttctctgatcaaggaagcttttgaggactgggttagtattccaccattcctcaattctctattttgttatgctttctaaactaagataaccgacagccttacctgtttctttttgctgtttcttatacagaaacgtttccagaatgacatgtcaattaataacgcacatgtcgatgtgttacaaggtcaaaagtgggaaactactccatggaaaagactacaagttggagatattgtgagggtaatgtcttaaatcttccttacaactacttttttacccatctgtttgtttacggaattattgcgcattacttcttattgtgtgcggactttaactctggcctcaaagtaaataagaaaaactaatagtgatggcatttctttagagcagatcaaacaagatggttatttccctgcagacttgctcttcttgtcaagcacaaacccagatggtgtctgctacatagaggttcatacattcgtttttaccttttccgctattctgcacattttcaaagtgtagtaaataagctacagagatatctttctctaaactgaagttctgttgaatatatttttgttcatcttagacagcaaatcttgatggggaaaccaacctgaaaataaggaaggctttggagaaaacctgggattacaaaaatcctgaaaaggcttttgaattcaaaggtttgtgcatttttgttctgtggcaaggtggttgtaacttatagttgttgctttgttggtttggaaacttttcccttcag

SEQ ID NO: 20973 - DNA, 1218 bp, Oryza sativa
  unsure (1)..(1218): unsure at all n locations
aactccactccagactcaactcctggagttatatttaggagttggagctgtaccaaacaggccctaagactttctagcatttcccacatacatatagatgttaatgaatctaaacacatacatatgtctagattcattagcatctaaatgaatgtagacaatgctagaaagtcttacattgtgaaacggaggaagtaataaaatgtatttcaacttccttcatgcaaacaattttgcacttctcaagtcccagctatatgatgagttgtggatgatgaacttagcgcatataaaatgcataagaacgatcagtaggatttggcttaatttgttgaatgtagacatgtactggatatatttccacctatgaactatatagccactgttgcaaatacaacactaattgaaactaatactgtgaaaaacaaacaattccccccctaaaaaaacaattgtgcccagcagagttaggttttcattttccatgttggaggttgtgaagtacttcctccgcttcataatataagatttctagcattgccccgttcacatagatgcaatgattaangnaccaccaatgtaagtgtatagatccattaacatctatatgaatgtaaacagtgctagaaagtcttacattatgaaacggagggagtactttgtaggctttacttgcatgggctcttttgagtttcttatttaccttttatgttcattcaagcaccacaaggaagtgtcttgcattgaatggttggattctaagatggtttctaattgcctacattctaataaccttcttaagctctccttcccaatatgttcacatcagactgaatattatcttatctacttgtctctcctgctgtctgtgtgcacacgtgcgtgctcgtacatgcgaaagaaagaaaccaaaacttactgttgccttcttgccacaggggtgtagccttcggaacacagagtacattgtgggggttgttatattcacaggtcatgagacaaaagtatgaacatttcacttttccctgtatatttaacttgaattcatgatatctgctgttttgaagtttactggatgtggaacattgttacaggttatgatgaattccatgaatgttccctccaaaagaagtacattggaaaaaaagctagataaacttatccttgctctatttgcaaccctgttcacaatgtgtgttattggtgctattgggaggt

SEQ ID NO: 20974 - DNA, 4129 bp, Oryza sativa
atgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaaacaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccaggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccatcattagtcccggttggtattaccaaccgggactaaagttaagatctttagtctcggtgcggcacgtacggcgcggcggcgcgcacgcacgtggtcgggggctggaggcggtggcgaggacggcggcgtggccgagacgcgcacgggagtgaggacggtggcacgcacgcggacgggggccggaggtggcggcgaggacggcggtgtggccgagacacgcacggcggcacgcatggcgcggcggcacacacgcatgcggacaggcccggaggcagcggcgcagcgctctgaggatctcctccctgtactccaaagctcgtgccgtcgtggtcaccggtggcttcaggttgggcatcatggcctcccaatatgcatcgcgctgcccaacaacatgaaaaaacgatcatgcaagcagtcaggccacctcactgagacattacatcgaacactaggcgtgcgtcaccagtaaaacgagccagcgatgccgagccgagcagaccaatctgcggggagcacggctgagaggacatcgccttcccagaggtggagttgtcagtcgtcgggccatgtgatggtgagctcctgcggcgacagcaccgatccaatggaggggaaggtgaaaggaaggaagggaaagcacagcccggagatcgaggtagccagggaggtcgacggagcgcgcggggcggagggaggtcgatggagcgcgcggggcaaaccaccgtcctcgctgccgcctccggcccccggccgcgtgcgtgcgcgccgccgcgccgtgcgtgctgccgtcctcgccgctatgcgcgtgagagagaggaagagtgagagagaagacagagagtgagagagagaagagagtgggtcctacatttttttaatcaataaaatgctgactgaactgccacgcgtatgccacgtaaaccaaaaccaccgcggattgagtcaagggggtaattcgtccggtttacatagttgggagtcaggaatgtccggatttgtggtttagggggtaattcggtcgaccgcgatagttcgggtggggggtaatccgtactttttccttataaaaatgatagatttatatgtttaaataatgtaaaaacgatgtgaacataatgatttgacattgcttgcatactgagtttaaaagatacaacaaaattataaaatgatatgtcatatttacatgatatttaaaatactctagataataattgctagtgcatgatgatgtggcgcacatgcatattaaactttagtagtcagtacacgtcaactttataataaaataggatatgttacaaaataggatatgatacatggtggctccagcgcttaccatagagtttgcaccatcgcggcaagaagcacttaatggcctttcttgagcgcattagttttatgtttgatttgcaattttctgtgagaaaagagctgaagtgatctgagaaagaaatgtttctcatcttgttgatcttgtttatttgttctgagaggaacgtgaaaattaaatcacacaatagacttaacgtacaaatgtacaatgggtttgatcactaggaaattgggctaatggaaacatataggtgtattatctttggaaaaaatacgaattacccccctcccgaactatcgtggtcaaccaaattaccccctaacccgaaaaccaaacatcgttcaccttcaactttcaatatcggacaaattacctccctcgactcaatccagagtggttttgtcctacgtggcgtacacgtggcaatccagtcagcattttatttattaaaaaaatgtgggatccacatgtcatactcctcttcctcttttcctctctcttgcatacggcagcaatgggtgtggcgtgcggcgggcgtgacgggggcgcagcggccggcggcgatggcgggggcacagggggcgacggccggaaggccactacgggcggtgagcatggcggatctccaccggcgcctcttctcttgccgctcgccagcggatctctggtcgacgcgagatggcgcgccgcgcgcatgccggcgtggggacgggggagggcggtcag

SEQ ID NO: 20975 - DNA, 1300 bp, Oryza sativa
acattcgcctctccgccagcgccacaatggagagcgccgccgcccgcctctccaccatggccgccgctgtgtgcgccgactgccggcctactccctgcatttcctccacctccccatccacctccactcacccccattccctctacctcccttcgctgacacttccggctgttgcccgcctctccgccatggccgtcgtgcgcaccgacctctccctccccgcgtgccgccgtgcacttcgaccgccggctcgcccccgcgcgccggtgcccaccgctcgtccccgtgccatgccatgcgtgccggcgtgcgcgccgctgccagtgactgactgagagagagatagatagaggaagagagaaagagggggtatgacatgtgggtcccaccattttttaaaaaataaaatgctgaccggattgccacgtaggacaaaaccgctctgggttgggtcgagggggtaattcggtcgaacgtgatagttcggagggttgggggggtaattcgtacattttcccttatctttatccttagtaccaacgtgtccatgcgtggcaatgtgatttagagcaatacgaacgacttgtctatcaaatcttctcgtcggaataatggttctttttatagtttaggttggttttgaaacagtttgatttttgtgtggggaagtacgattgggagaggaggacgacaatttatattttgagtgatgtacacggtattctttaaacttgtgcgagtgtatcatccaggttcttgaactcccaaaatacatatttaggtctccgaatttgttttaggtgtcatgccatgtcagcacatggagcgagttggagcccgtttagacctatatgccatgttggcatgccacgtgggcaaaagtaacgaatagttaaggaaccaccacttaagagggaaaaaagtatgtacaaatataagaagggcattttgataattgccaaatctaatagtggcaaatagttaaatttcccagtctcttatacccattcgctcatcttcattcactagtggagaaaccatcattgtccggtcgaccaaaaaccacaatagtctcggatgcagtaaaaaccgggactaaagatggtttttagtcccggtttataagtagaacgagactacgtgatctttagtccaggttggtgttaccgatgatctttagtcccggttcacatgctgtcaggtgttgtcaggcccctccaggatctttagtcgcggttggagttacgaaccgggagtaaagatcggatctttaatcccggttcgtaacactaaccgcgac

SEQ ID NO: 20976 - DNA, 322 bp, Oryza sativa
ccgtccatctgtagatcgctgatccataccgtcctccgcgatttaaccatctccatctccaccgcagaaatttctccctctacgcgcaaagaccgtgcgaagactacgcctcaccctctatatgcgcgactccaccgctaccgccgccagagccaagttcttctccatccgcctccggagtcgtgctcctcgctcctcctcctcgcgtgtactgctgctgtgctggagccgtggtcttccccatacgacgtcatctccagtcgccgtcggagccgaggtcgtccccttccgtctccgccactatcgcacagcaccgctgccc

SEQ ID NO: 20977 - DNA, 1720 bp, Oryza sativa
catccttgagatgactcatatggaaaatcaactcagatccatggatatggaaatatctgatggatttttagtgcacctcatcatgagatctctaggtcttaactatgatccattcaaaataaattataatacccagaaagagaagtggaccatacaagaactgatctcacactcagtggaagaggaagagcgccaaagggctgaaaagcagaagataaaagaccagctcaacctcactaatgcctttgataaaggcaagaaggtctatcaaggggaatcctctaataagaatagcgagccagagggcaagtagaagtaaggcgagccgcaagctcagagtaactgatggagtgaagggttgttggagacctcacacttagtttctccaacagttgcaataatatcttatttgttcaccccattaagagaaaccttattaattatttaaagtcatgtgagaaacgggtcatgtccgttatttttccaaacagaacatgttatattaagcgtgataataaagtgattggtcttgcccttgtgcacgacaatcatatttgttctttggatgactatgtgactattataataattgcatgtaatgacaaaagatgagacgtcattgaaattgtgacattgtaattgatgtcacatttctaggggaggttggaacgtctcataagttggagagattctttcccttggattgattttaattacgttatttaagctttaagggaaaaattcacgaagttaagaaattagtcaacaagcgaatacttttggttatgtttaccccataaggctatgtttactcataagagacctccgatttcctttaagaaatttaagatactaatgctaaaatcaaatgaagttatgagatcgaattatggtggtaaacactaaataaagcttgttcaccttataagacattaaaaataagcgttcatccaaatggtttttgaaccatgtaagaataaattgagattgatgaacaaaacaaagaatttagtagaagtttctaaatgagtcaaaatagtaggccatttaagtgggttaataaaattttggctgactctaatggaaatttcgaacaattcaagtgaggtgaacaacttcatgaaaattaatggtgggaatttcattcaccggtactctatactaatgacattttattgtcaagcaatgcatattgctgatagaaactaaagaaaatttttcatgaaaatttttttggtctaaaggagtactgggcttatatcagtaagttataaattaaataaataatttgagagaattgagttaaagttagtcaagctgaaattaaattataaagataataatttatgattcagctgacagttagctcaaatctggatgcatacagatttggcatacatttcttactaggaatcttgacagtatttaaatccagactagaccactggtattaagaatgctttgtattatttgcaaggcaactttaagtaacatgctcatatttctaaaagtctatttgtcggtgaaatgggtccgggggtacgcatcgtgaggggaggcggcttccccgtccggcacgtggctgtacggccggccccttccctgcctcccccgggggggggggaggtcagggggttggaggcccgccgagggaccctcggggggccacgtcaccctcccctcaggcccgtaagggccacgtcacacccctcaagcccgt

SEQ ID NO: 20978 - DNA, 3206 bp, Oryza sativa
gccccaccggtcccgcgccgcattaaataaaacgtgggggaaggggggaacgtgcggccccgcacgattaacgcccgtcaatcagccctgaccagtcggtcggtggctgattggatgggcggcggtgcccccacgccccgtcctgtgttaggcggagtgggggcaggtatgacccgtcccatcagaccagggtcgagtgcgcccccctgcaaaagggcgcatccaccgaagtctctcggcatttaagagggaatggcagggatgtcccctacgacggactgaggacggcgctgggccccgcctaagaatgggcgaatgccttgcgtccggttgaaggcacggttggcagttagatccaggttaagtgggccgccttccggagaaggagtagataggggcgctgcatgtggtatccccttaaactataaaaggaggacctcgccatggggaaagagagagaaaaaaagaagagggtgcttgtaacgtccagagataatcccaaacataggagtagggcattacgtcttttagcggcccaaacctttataatccctagtttccagtttttcctcgggctaaaggaagcggctcccgatcctcgcgcccttctccccggccgaactcacaaaggggggtctcacgatcacccgctagagaggagctctcctcgacactatttgatctcaaaattttagagacatttggacacttattttgtgagatgtgtggatatttataaagattattaagctaatttagattaagctatatccacacataggggagcaataaccatggaaaagctccaaaataatctcttactgcatagtcgacgatgcaattagatttttaaagcatgttatgattaatcatatatttaagaatttttcccagaactaagagtggtaaatagcgctcataaaccactcaaaaggtgtaaaccacccaaaattatactgtgctataagttgtgcactaattaaacactgttttctattctagtagcagcatgttgtgtgttttcttcctaacacattgatatggttgtgaaagacatgtcccaggatcaaattattaagctaagcatttgctcatggatccatactctaaaggctcataaaattaataaacatttgctcatggatccatactctaaaggctcataaaattaagattaattaagattacgttctggccagtacatatgtaaattagagccttactaagatcctggatgagggggacttaatttttcaatcaacacccactaagttaagcttgagtttatttgagtactatagtgagctattgttaacgaccaaatttggtaatatgagtatcggagatgaagatcaaacagaagcggaatctaagacaagaatcgttacgaaaacagagcaagaatcggctaagtccgaattggttgcgaccttaatcggcagagttcgagtcggacaaggttaaccgattgagccgattttgacaatacgactcggtatacgttatcgggtcgagttgaagtgcttcatatggattgccatacacggattgagtcctaaggaggcaattttatctattaattaggatattttatgtaaattccttagagataagtttgggcaaaagtctgccgcaaagacttatggtatcttagagtttgttagagataagagtcgtgtccgacaaggacatattttgtaatctcgggtataaatagaccccgagccccatgtaataagataactcacgttcaacaacaatttcagcgcatcgccacccttttacgttcgttttgtttcgatgagttcttgctttcgggttgagctggatcagtttcgatcttcaactagaggtaaaacttgttatggcggcttgcgttctcaggattagtgcttccatttttatgatactctaattttgttcatgtaagttgtcgagttatcatatatcttatataatctctgacaatatcgctgtctaaccttcaatcggctaatatctatcattagtgggtagccgattaggttaaatattgacgttggcttagattatataggatatctaccattccataaagcttccaatagcttgattgtctacatattgtctttcttttcatacttatggctgcatcagttgagtttggtctcataagtcgtgtttagaactatagtctctagcctgcttcttggttgttgagtagagtagcatcggagtttcagccaatcttacctgatttagctttatgtcttatgtgctcaattgttatgctagatctgccctttgtgttaagatcctattgcatttaggtgtattaagctctctgtttgatatattttacttgctttaatatcttaatatagagtggtgtcggagtattagccggtgcacgctagatctatctgatcggctatgctgtgaacatctataatctcatcgttaatatatattttgatctaagtgatttatactgtctcggcatggcgaccgatccatcccaatcacttgatttaagtatatatcgacataaagattatgtgctgttaacatctacagccgatcgagtagatttagtttcaattcacttatttacaactgccgatcgattcacatatgacatcggctcaaagataaatgatatgtcatcggtggctggccgatcggctatcatttatggatttaactacagtttctttgtctctatttcttgttgattgcaggatcaaatcaactggcacgctcatgaacctaaaaggcaagattttggacctgcactggagttaagcagatctcccaggcctcgtgtttttcgcatcaacacacttttggcatgcccagtgggaccacgagtgttaacgacttcttcccgttggcccaaaaactaccaccgtcaccagggacaggagtcaaacctcccgttgctaaaacaggagctgcaaatccatcaactaaagtgaatcccagcaacatagttccagtcacattggataagctgacagctgaacaaaggggtgagcttgagcaaatgatgagcagcatgaaggatcaattcatgaattcttttcaagaaacccgcagaggcacaatcgtccataagtacaagctgaaggtagttgcagccgatgaggttggctcaagctcttctccaggtcatgcaggtaccgtggctggctcaggcgacaaaggtgatgttcctaaagatggtg

SEQ ID NO: 20979 - DNA, 4787 bp, Oryza sativa
gatggcacgatagctgagcatcaactacagggccatttatttaccaggaggtgttttcccgaactatcggccttcgatcacaggaaatcaacagggtgtttctagtgtaccaccaatccagccgatggcaccagtttcaactactgcaccagctgcgtcatcatcggcacaaagacaggtggtcaatcctagattgttgaccagagaacaaccacaacatgctgggcgaaatgccaatcggctgactcaggaacaggttgctgcaatgtttctaccaaatccacaaacagctgacccagtacagtcaatgctgaatcagcaaacgccgccaagacagcaaacggttcagccgattcaacagcaaaacttgcaacatgtatcggctaggttgagaacacctgataatcggctaaggcagcatgctgcaaatcaattggttcctgagcacttggtccataatgtacaggccgatcagtcagcaatacctcaagttgttcctgaacatttggtgcgtaacattcagccaaatttcaagaattatcaaggaggtaatttaaattatcaatataagccttcgtcaccttatgttcagtaccagcaaacaggatcgcctcaaccccaatttgctcctcagtttaatcagttcgagccgatgtagcaacaaacgcaaggagtacctcagcagaggccatgggctgatatgattgtagatgtgatgagggagcagtttgggctcaaaccaaaggacactggaaacttgtatcggcatccttaccctgaatggtttgaaagggtttcattgcctagccgatacaaagtgccggacttctcaaaattcttaggacaagacaatgtttcaacttatgaacatgttagccgattcttggctcaatgtggtgaggcatcggctgttgacgccttgagggttaggttgtttcttttgtctttgtctggatcggcattcacgtcgttttcttctctgccatataattctgtcaatagttgggccgatctggaaaaacagtttcatagctatttctacagtggagtgcaagagatgaaactgtccgatttgacaacaatcaagcaaagacatgatgagtctgtgcaagattacatccagaggcttagggagatgaggaataggtgttacagcttgtctttgacagattcccagctagccgatctggcttttcaagggttgatagcaccaatcaaggagaagttttcatctcaggacattgaaagcctatcacatcttgcacagaaggtgaccttacatgagcaaaggtttgctgaagctaaaaagaatttcaagaagatcaatcatgtatatccctatatgtatgattctgaagagcatgatgattccgaagtagcggcaaccgaatgggtcaggagcaagaaagtcataccatgccaatgggtgaggagctctaggaaaagaggagatgtttgactttgatattactaatgtgtaacatcctgaaaattctcaacaataaaaatcactaaaattttgaactttttaaaacttttgcatcatgctggttgttatgattcctattgcttgccaaaccataaatgatcaccaagaaagtaaagaaaagaactacatttaagcaatagatataatttacgagaatatatttaatcttacaaataattatgcacaagatattaaaagcaaataaaagaaaagttattataaacctattttatcaaatatgaaaatatttgaataatgtaggtgtgtgccataatatgagtacacatgaaatgatgatccttcaaataaactgagctctctgtatatataatagaattatgggagtatttaattcgatatgtagatcgatattgcaccaagttcctaattgcatttagggattgaaatttaatatattaaacccctctatataaaataaactaacatatagataaattgagctaatgtgctaatgtgttaataacagtctcattaggaaattatagaatctttaataaaacttaaatttggacaatattaatttgaatataaatttcgatgaaataacttagacgcggtgtatttttacattgtgacaaaattagtggcaacagtatatttttcctaattgcaaagtaccctctaaaatcaaaaatagttggctagcactgttcattagcccctaggtgttcgatttggtttctagccatcccagctctctttctccccactgctgcgccaccctagccggcctcgagccccgcccgcaccggcaccatcgctgtcgtgtcaccatcaccgcgccgcgtcgccgtcgcctcactctgccatcaccgccgcgcgccgttttgtcgccattgccgtcggcctaccacgctgctgccgtgcgccaactcgcgccctgcgccgccgcgtcatgtcgcgtcgccgtcgccgcgccgtctccaacccgccgcgtgctgtcgccgtcgccgtcggctgcgccgcgccgagccccgcaccgctcgtgtcaccgtcgccgtcaccagcgccgcgccgagccccgcaccagtcgcgtcgccgtcgccgtcgcatcagtgcctcgcgccctgtgcgccgctgccgcgccatcacgtcgccgtgtgtcgtcgtcaccgccttgagccccgcgcgccatcacgtcgcccttgagccctgcgcgccatcatgtcgccctcgagccccgcgcgccatcatgtcgtcctcgagcccagtgcgccgtccgtcgcgtcgaccattaagccacccttcccacaccctataaataccccccttccatcttccttcctccccacacaccttggctgccatcacaaggcctagccccatctctgcctctttctctttctcacacacatttcatcgaacacctagcgtgcttgcgggatcttcttctctactccacccccgcgacatcgaacttcgtcgttcctccatccctcggtaagtcctcgctcctctggcctcccctagttctgtagaaagtatagtcccctttaatttcgccaattagcaaccgtcgccgtgccggtccggccaccgttctgccgccggtgagctcgccgtggacaagccatcccggagctcctcctctccatctagtgagtaaaatggaacccccacactccgtagatgctcacgccctcgtcaatttggttggaacttagccctagcgccctatccccttgcaacccgagctcggccatggtggccatgctgcgccgctcgacctcactccgccgcgcgtcgccaacggtggagggatgtcgcccgagttccgccgcaccttccctggccaccgccgtgccggcctcgcgccgtcgtggttgcgcccagccgcgccccgcgatgcctccctctctctggcgagaggtagaagacgactcccggctgagtcgctgacaggccgggcctgctcctcctattttcctttagaaaattaatcccgtgaaaaagaaaatcaaagctttgaccccacatgtcagcagctgttagggataaggatatatttcggattaaaaataaatgaattaagaacagtgccttttcacaatttctcggatttattcaaatttgaatctttaaactagcgtaacttgctcattttagctctgattcgagtgaaacatgaatctaaattcatctaaaatcataatctttcaaatggtatataattcactatttaataaaatatatttataattataaaatagttaataccaagaaattagataatagtcaatttaaaaatgtgctaataaataaaattgatattgtactgtaaagtagatgtcaaataattgtctttaacatgctttatcactgtaaaacccatgtaaactaattaaaagcattgtttcaaattaattaaagcataggaaatgctagtgccatttattaatatatgtccatatataattatacccatgacgtccaaaatatataaataatgtttagcctcatattttgtgactaaaatatgaacacgcatggatcagtccttagcttatttgtgaggaataataacagaccaattataaataaaccaccaaaatgaagttgattaatagcatagggaatagcatatagttgatttggttagcatccaattattgcccgaacagtaaatcactcatggatccactttgatcacatatacggtatatcttgtagtaaataataattaatcaataaatgatccaatattaagacattgtgcacacacataatgtacatcccgttatagctatacggtacagtattaatttgcgtgttgcatatattaaattagagggagtttatgacaaacatgtatattggataaatactagttataaattttgacctcatataatccaagttcaattgtaaattaggattattcattgtaaaattatgtgatgggatagtccgtaaccataatatgattaacctaaatatttctaacatacaaagcatgggtaattgttaaccttttataatttattttgacaactaaaatatgtacataattagaataaagcctccatcaataaaataataatacaaatgattcacagtaattatttgaccaatccaaaatccatccggcaacagaacctctactgtataaccgttctatttagatagatgcatatatagccatttgctagactaaaccacatattagccaaatatgtatcccataaatgctatgttggttaactcctaacaagaccatgatgacaacataaagattacgaaaccttagttcttagcttgattagaatccattatgatg

SEQ ID NO: 20980 - DNA, 1258 bp, Oryza sativa
atttttattggtgaaatgggagaattgggtttagaatgttcaagcaaaaagtaacactgccatatataccaccttcgaactaataatattagatgggctgcttactttattagcaatgtcataggatgtccctaaatcttgttaattgatccctactgtgtgaaagcactttgaaatatgaatctattggtataacctttgtacagtatttttcagtaggtaaagaaatgcactttgtattttggccacccccaccccccaaacaaagctgtaaagtttgataagtataaataaaaaataccttatgaatttacttataatttgaccaacttttttttgtcacaatctacaaaatttgactttgtaaatcaactatgccttgtaaatctcttgcataaagtatatgatatttgtattccaccagaaatcttgtctctagcccttgtaccagcaataatcttgttaaagtgctccctattgtttgaaagcactatgtaatatgaatctattggcatcttgatgaatcttttggtataaccttcttactgcaaatttacttgtaatttgactaactacttttttgggggtcaaaatctacaaagttttactttctaatcaactataccttatatctctcttgcatgtttgatatttgtattcagcaggaaatcagttttgtaaatcacatggttgtttatctgattgagtaaacttagttagaacatgtaatgattttatgaatgctattaatgcagcatacccatgcttcggactctgatagtgaaaatcggcacaaaagacacaaaaaggatcgagatagctcccgcagaaatggcacacgtgatgaccttgaagatggtgaacttggagaagatggggagattcattagtcattcgtttctccgctgagattgtcagtactactgctccttgccatgttattagttaaataccgttttcttgttttgctcaagtagcgcatctgcttaagaatttggtagtgtcaatcactgttattagtgtacatgctctgagatttacttagtattttatactattttgcagtatcacaatacagtcccccctcctgttttggacatatgaaatggtgcattttgttggcaactataaatgctttcctccagagaaggacaatttctttatggggattatcttcttgtcttgatctggcttgttggaaatggacaataatagccttcattgtttggatgctcacaatgtagtcatgaaggttctt

SEQ ID NO: 20981 - DNA, 3162 bp, Oryza sativa
ctcgttttgacgtggttttcactttggagttgtttaacatcttgttatttactatgccatctaacatagttttcgtatggtagcagttttgtaatagtttgctgctatttatggtgctttatagatagatgtacttgcagctgacgctgttgatattctcatgaatacattgattctgtaggctatgtttgttggatggctgatactgaaacgataacatgatccatcctggtattatggctgtagattattaactttttttgttggaagggaacaatttactaactaatcttcacagacggaccctttgcatttgggtgtttaagtcattcattgctgctgtttgttcatgatgaccattatggtctgtactggagctgtctattcaactagtttctcaatccctgtaaccgtcgggttgcatgcgttttgtgatgtgtggcatgtgtgctgcgtttcaattggcttttattagttgcaatgaattatccaccagtagttgaaagtcggcaaaagctgcatgcttggaaactatccaacggcaaacaagtcatgcatgtccagacaactcgcctacaacgggttgaacccaaatctgtacagccataagatttaggggtccttaggaatggaggaaaaatcaatttataggtaaaactttttatatgtgttcttagcgacttaaaagccaatgctgaaaaagaaactacgttgaaatatcttaagatcaattttaaaattaagtttgaaaattgaaattttggctttgtcattttcttattaggagaaccgatgtagccgctcctttttaggttgtctagaccaatctcaaacatctgttttctcaaagatatagtttctatcaaagctccatatagggctggacaaatagctcgggctcgtgaactcggctcaagctcggctcgggctcgcctggctcggctcggctcgaatcatgaacgagccgagcccgagcctgggttttagctcgttgtgaaccgagccgagccgagccagctcgcgagcagctcacgagcttagtaggctcggtttgaatagaaagacttctggctgaaaaccaaaaagcccaatcaatttgttatatgttggctgcatataatatacttaattatctttgtagggacttgagagttattatctgaataaccaagtcattgcaaagtaacacaactgctgctggcaatacaactgctgttattgcaaagctcacgagccagcttgagcgggctcgagccagaccacgagccgagccgagcttaatgtacagctcggttggagagccgagccgagccaagccgagcttggcatttcgcgagcttccacgagccgagccgagcctggctcggctcgcctcgtttccacccctagctccatacaacctctgtttcaattttcttatcgctctagcatttaaaattttggtgaaagtacttttcgttctcatactccaaaacattttccgagatgtatactttccttcttacccataatcaatgcatccatactactatttgtactcatcactggaaattttaatacttgccttaaaaagattattgttatgttattaatacggtagcgatgtaaattgccacaacgatttaatttgtaacatatggagaacgacaagcaaattgaagaagtaccaacttagggcagtctcaacccatagtgtccataaacagtgtctatggtgacatatcaataagacattacaatggaaactacacttcacaacccatgatttcttaaagtgggtcattaataaatacatcatctctcttctttaccaatcatatttattcttcatctactatgaagacactattttctcccaatgcaaaacttgatagtgtctagtgcatatgttctcgtgttgaaactgtatcttgcatgagacccagtttctttctctcttcactctctctctctcttaattaatatagtgacacataagttaaaagtcctacatgtgaatgtagttaataccatagacaccatcctaaatggagggttatgattgcccttgtatcacttcccagttcccaccgctaatttaaaagaaattgagactaaaaatcaaattctcatactgatccacctttatttctcactgtcttaacttcccatcctcttccccaacaatgtagacacgaatcaagatgtccagcgcgttcccaattctgcagccataaaagaaaaaaaaacaattttgagctagaaagatggcagttaagtatggcaccaagtcaccaacggccaatcaaaccaaactgacgtatttgcaaatgaaacataatttataaataaaatttttatatacatatttttggcagtttagaatccaaggctaaaaaataaaatacgataaaagaatcctaaaatcaaatctaaaatgaaaattttaaaatttagctgataaacgtaagaataagcgagaagacaagcctgaaacttcagtcactctcacgcgtggagttcttcatcagtccatggctggcagtgtccagcaatagctgcgtctcgccgcgcagcaaacggcggagcaggcggagctgcacgcgctccggcaatgtcaggtcgtcgtccagcaccgccgccgcgagccttgcgtccacctccctccacgcggcgaccaacacgaggcgccgtcgtcccccacgctcgaggtcgagggtcgtcagaatcccggagccgagcgccgccgcgaccaccagctcgtcgaggagggctggcagctcaagctcggcgacggcgacagcgacagtagcgcggccgtgctgcttgccgtctcgccgccacgcctctgactccgcggcgtcgccgttgatggcgcagagcgccgcggcgagctcgtacggctgggagtccgacgggtctttctgcacggccgccttgtaccgccgcagcgcgtcgtcgaagtccccgtccctggcggcgaggaaggcgaggaggaggttgacgtcgaccgccgcgaggtcgtcgccctccgcctcggcgtcggcgagggcgcgctcggcggtggcgcgcgcctctcggagtcgctcgccgcagagcggccgcgctcggagcagcgacgcgagcatcgcttgggagcattccacgaggaacaccggctgcaggttgacgggcttgatttcg

SEQ ID NO: 20982 - DNA, 7975 bp, Oryza sativa
gtctgtccgcgaccagccgggcgacatcggcgagcgcttggtcgaatcggccgtcccgagcgtgtacgagtgccaggcccatctcgacccggtagacgaccgtggactccgcggccgctagtttcttggcatactcacggaggtacctgccggtgaaggtcggagcgcggagtgcaccggcggcgagcgcgtgggccgcgtcgaggaacaaggcgtccctgccgctgctgctgccggcgagggccgcgttgaggtcccgcagcccaaggtgcgcgcggacgaggcccaagtgtccgcgggtggtggtggcggcgccgtcttgcggcggatgggagacgcggacggaaatccccgacagcttcgccgccacggccgccgtcccggccagtgccgcggcgagggcggcgcggcggagtctggacatgtagccgtttgctctccggcggcgaggagaaagtctcgtggtttgctgaggattcgtcgtgcttgtactggacgttactggacgctaggatgcagagctctaaaagatgaaggaatcctttccctatataggtgtactacgtctggaactctggatgttctgcgcttctcaagcgaacggcccaatacaaattttgaaatattttcgtccaacaggtccatgcaggagcatagttattagtaagggtgaaaacggtaacggaaccggcgttcgtttctgactttctaccggtcgagctatatagaaatggtaattgacccaaaaaattggaaatggtaaaaaatatggagatggaaacggaaatggttttgctgttataccgatcgtttccgtatttaccgtatttttatggaaattactgtttcttataataattactgtatttctagatatgttgatatttatagggtatgtctctactttacccacagtttagagattgattgactcttcaatcaaatcctaacttgagtgcgtggctaaaatggatttaatttataatttatatagtatagcttaaatttatttatacatataacatacttatgagttaaatatatgttttctatagtttaatgtttccgtatttgttaccgggttccgatctgtaccaacatatttctatccgtattattccgtttccggttttccgatatttccgatatcgttttcgtttctgactttaccctttttgatttcatttccgagaaaatatgattatggaaatagttaaggctgttttccgatcgtttccgaccgttttcgtgaggcgaggcaggttcaatgtggcttcgtgaaaataaaattttctatgccacatcggacgtttcaccggttgttggaaggtgttttcggacacgaatgaaaaaactaattttataactcgtctgaaaaccacgagatgaatttattaagcctaattaatctatcattagcacatgtgggttactgtagcacttatagctaatcatggactaattaggctcaaaagatacgtctcgcgatttccatgcaaactgtgcaattagtttttctttttatctatatttaataatgctccatacatatgtacagagattcgatgtgacgtttttgggaaaaaatttctgggaattaaacaatgcctgtatagcacatagtatgtattactccatccaaaatatagtaatttttagtcttcaggacttatactaaaatatactactaacaacaattacaatcatccgccatttaatttctccacctacctccacttctcatctaattacaacatttcatcatttaattctacctactttctaaataaatgtgtccaaccctaaaattctgtaggtagtacttcactactgaattgctaaccttcattcgacaaaaattttaggtgagaattctgttgaacccttcacggttggattcatgtcacattttttcttctcgagctccgacgaatgaaggcggcccgacaagttcaagtctcgatttggggttggggtggaaagggggtgggaggggggggaagaggtgggagttcgacagccttagagggatggccatgggaggctgcgacccagcggtgagccatggaatgggtaggcggtgccgccgaagttgtggggttggcaactggcggcgaggggcaaaacaaagtgagtgattaggaggcatggggagggtgtagatgcgaaaaacacacactggcctggaagatctgcttaacttcagtgcaggtccaaaatcttgcctttaggttcatgagcgtgccagttgatttgatcctacaatcaataagaaagaaagacaaagaaaccgcggttaaatccataaacgatagccgatcggctagttgccgatgacatatcatttatttttgagccgatgtcatattgggatcgatcggccattgtgaataaataagataaagctaagtctactcgatcggctgtagatgttaacagtacataattgtcacgtcgatgtatatttaaaccaagtgattgggatagatcggtcgttatgccgagacagtataaatcacttaagtcaaaatatgcattaacacgataattatatgaatgttcacagcatagccgatcaatctagtacgtatcggctgatactccgataccactctatattaagatattaaaataaacataatacattaaacaggaagcctaacatattctaatacaataagatcttaacacaaagggtggatttagcataacaattaagcatataagatataaaatagctaaatcaggtaagatcggctgaaactccgatgctatctctttcagtaaccataaaacaagcaagatattacgattaaaaatattacttaatagatcaaactcaaccgatgcagcattaagcataaagataaacataagatctaagcaagatgatgaaagcatctaagagatggtagatatgctatataatctagattaacagcaagatttaaccctatcggctattttcctaacaataagaactagccgattgcgggttaaatagagtaattactaaagattatagaacatatatgataactcgacgaattacatcaacaagattagagtgtcataaagatggaagcactaatcccgagaacgcaagccgccatgacaagtttacctctagttgaagatcgaaatcgatgcagcccaacccgaaagcaagaactcgacgaaatagaacgaaagtaaaaaggtggcgatgcgccgaaattgtgttgaactgattgttaattgattacatggggtttgggctacttttatacccaaagtacacaatatgtccttgtcaaacacgactcctaacactattacaactcaagatacaaacaagtccttaaggcggacccttaccgactcaaagtataaggaaattacacaaaatatcctaattaatagatacaattgtcttctcaggactcaatccacgtgtggcaatccgtatgaagcacattaacttaacccgatgacgtgtactgagtcacattgtcagaatcggctcaatcggctaccttatccgactcgaactctgccaactctggtcgcagccgattcggacttcggccgattcttactctatttccggaacgatctacagaaattttggtgattatataagatattgtcagagattatataagatatatgataactcgacaacttacatgaacaagattagagtatcgtaaagatggaagcactaatcccgagaacgcaagccgccataacaagttttacccctagttgaagatcgaaaccgatgcaactcaacccgaaagcaagatctcgtcgaaacaaaatgaaagtaaaagggtggcgatgcgtcgaaattgttgttgaacatgtgttattttattacatggggcttggggtctatttatacccgagattacaaaatatgtccttatcggacacgactcttatctctaacaaactctaagataccataagtctttgcggcagacttttgcccaaacttatctataaggaatttacataaaatatcctaattaatagatacaattgcctccttaggactcaatccgtgtatggcaatccatatgaagtacttcaactcaacccgatgacgtataccgagtcgtattgtcaaaatcggctcaatcgactaaccttgtccgactcgaactctgccgattaaggtcgcagccgattcggacttagccgattcgtgctctgtttccgtaacaattcctatcttagattccgcttctgtttgatcttcatctctgatactcatattaccaaatttggtcgttaacacatgccccccaagttcggaatatttggtaatgtttcagatttgccatatctgtttttccaagaatatcgctcgttgccgtttttcgaccgttaccgcggtgttttaaatattaactgtcatctccgagaaatttcacaccgtcacctccgttttcaccgcttaagcaaaccttgtcttctctctctctccggcgatcccctcggtgcgcaaggcaattccaaggcgatctcctctccggccaagattccgcccgcggcgatgtcgacctccgccagcccgtctgtcgcgccatcggctgagtacgcagaggtacgtgctcatcagctagatccctttttccgtgcagtatatcagcttttcttcatctctattcttttgcatttgtagcatctctccaacttggtcgcggttcccagtctgtcaaacgagcaccagtattttctcggtccgatcggcaatcctgatccccatgagtttattagtgccgagactaataggattcctttcagactagccaacccgaacataggtcattggaaaaacaccttcaaatcttggccttccattgagaaaagtgcccctgagaaaagttggcctgtatggtacaagcgggtatcggctagcaagcaggctcactgggacgaaattggaatcggccaagcacttgccctgaccatagcaaattcggctaaggacaaacccctgatggccgctgcagcctatttctggtcgaacacacttaatgctttactctttaaccaagggccaatgaccccaaccctgttagacatcacaatgatcactggcttagatgtcacctcattggctaatcccatgagcttgaacactaaaaacacttttgagttcaagaccaagagcattggaggctggtcagggtatattgcagcgtacaagggcaaagggccagtcacccctcgagagcatgtagtctttctgctgatatggcttgaaaagttcctgttctgcggatcaagttgtggtcccacaaccaactggcagtttccagctgaagccctagaaacaaagagacaattccccttaggcaaaatcctcctcggctatctgtaccaaatgttgaataatgcatcggccaagatagctgtcggctcaattgttggtgtaggtggaccatggtggttgctgcaaacttggttaaacttgttatccatgaaagttgttaatcagccaactgctgctgctatcctagtaaattttgtcttgagaaatctcaaatccgctgtacaatttgtcttgatgcttacctatcttcaactttctctcttgcaggtattagccgatctgttctcgtttgatatcaaagattaccttgatgaagagacagaagaagataccaccagcaaggctctagctcccttgtccgatgacgtgaagaaaacacttaaagatatatctcatcggctagggtcatcgttagatagcttagtagccgattgtggttcaatccgggctagattcaaggaaattcaactttagatcccagatgatcttgccaatattattactccagcagtatacctcgagcagcatcaattcaagctggaaagagctaaacaaagattagctgatcggcgggagcacaaggatatcgaagctacaatccaagccaatcggcaattggtgcatgaagaaaaatccaagctcgatcagctgtctaaggttccgatcaggtccaacattgatcggctcgaagcccaaaagattgatctcttggcacaacttcaagaatgcaatgccgagctggatctggaacacaagaaactagctgatctcccaaaagctgttgaggagcagaaggctaagctgagatcggccattagaaatgtcgccgatatgactaagtccttaacagtcatccctggaaccgatgctcaagacgcccaagcgatcgaagaagtagagtaaattagataaagggttgtatcggctatccaacattacttatcccaatgaatatccatgtaataggacttagaaaatttttgtaatcggctagaaaactctgatacttcatctacttgttctgatattctcttgtgccgattaatataacttctaaagttgttcaaaaattctcaattttttcttgcatatatgtgccctcctaattttgcaatgacgaagacattgataaaattataaattagtctaagggcgatataaccatatcggccatcctataacggcaaaacacagccgattatgtgaatgaaaacaacccgcttagggcgatataaccatatcggccatcatacatcggcaaaacacatccgattatgataataaaacaactaagggcgatataattatattggccatctcaaggcgatgtaaacacatcggctttacacgtatcagcaaactcagccgatcatgaattaacccatacacttgagtaatatttcttcaagtattttccattaagtgctcgtccataaacttcaccatcaagtccttgcaacatataagctcctttagacacaaccttgtggatttgaaacggtccttcccaatttggtgaccacttgccgaatttattatcacgagttcctatcggcaagattagcttccaaacaagctctccctcagaaaaagacttgggtaccacattcttgttgtaatgtcgagcaacgctctctttatccttggtaacttttgcaagagctcgcaacctaaactgaaccaaatcctccctttcatcggccatgagattatagtactcatcggctgtcaacatatcttgtaaatctgttcttctcgagctgattctaattttccatggtaaaactacctcatgtccataaacaagcttgtaaggaggaacttgaatcgatccatgacaagccatccgataagacaacaatcctttggccagtctagtatgccattaccgaggataatcagaaatctttctcttaaccaacttgatcaaactcttgttagacgcctcggcttgtccattgccatgtgcacagtaaggtgaagaattcaacaatttgatacccatgctgccggcaaactgaacaaactcatcggacacaaatatcaaaccctgatcagttgtaatggtctggggaataccaaatcggtagattatgtgctccttaacaaattgtatagcatctcctgaatcaaccttcttcaaaggaatagcttctacccacttggtgaaataatcagtcgcaaccaatataaatttatgccccttacttgaaggtggattaatctggccgatcatgtccataccccatcctctgaacggctatggcttgataataggattcatagctgatgctggtgctctttgaatttgtcacgaccgaaaataacccaacgggcgttccttacgtgcgtgtattattccttgtcccaggaggcaaggtacaccaaaagttgatacaattcagagtttaacaagcggaagcgtaagtaattaatttattacatgggcggcgaaggcccagcacacaagaagacaaacgaaaaacagcggaagactagggcgacgaccacaggcgcttgacggcaggcacgagctagacaccaaagccttcatcatccaggaactcctcttctgggtttgggaaaaattgagcaagactgagtacaaccaccgtactcaacaagacacacccacaagtgcaaaataga

SEQ ID NO: 20983 - DNA, 3448 bp, Oryza sativa
aaggccgtgaacccacacgaacctgccttaacccaaggcctacgatgattcaaaaccgaactggccaccccaccctgggtaccagctcgtcccaagccaacccaagccaaccattccatattttaattggtaagcatgatttaagaattaaaacactaacttgggtacattgctaggcttgcccataacgagggcgcggctattcgaataggttatactttgatcagaggtgtacatctttacccacaagacacatctttctcacgtgtaatcacgtgccacataccatcacggtatacggacggaagacgtgacatagtttccaacccatcctagccatagacaagagtaccgacccaaccccacctatggccggaacctccgggacaggtaggtaggactgagcccctagcagcaggacaccagccctgtgccatgacatttcgactaccgggccgcagctcgtgtagccttcatttgccctagagatgtccatcgacccccgacttcgtccatctccatccgtgtacttttgttcataaccagactgagccacaaactaagccttacccactagacatgtggaagtacgatagtgctttgcaacagaggcccgaagaccggtccttatatggccgaggtgttactatcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaattcatactagtggtaccataaatagagtacccactagttggggttttgtttattctagggtgaacaaggtaataataacaataacaacaataataaggtcataacaaaggtaaataggcatggctaaacaaaatagtgataacgcgggaatttaagtaaagcggtaatgcaataattttaaatcaaaataattttataaactgggattcaatatgttcaaggatgatgtgacttgccttgctcgctttcccaaacgtcggcttcaacctccacgaagagcggatcttccgaagctgcagcgtctacacgaccaacagaaaagaaaaggcttttactctaataaactccatataacaagcaggaacaaggcagaaaaatgggtttttgacctcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacccgagggcgcgggcagctgacggccgggccccatgcggcagacactcggcgcgcccgaagcggccatgccggcgcggctggcgggaggcggcacccgcgcccctatggtcgccggcggcggccataggcacggcggagcggcggccgagagaggggagggagagggggaaacgaggcagtggtccacggctcaccccgaggcgacggcggcgacggaggaggcgctcggagcggaggaaggcggcggcgcggctcgggtcgacggggacggcggcgctacggcggtcggcgagctcgacaagggggtggacgaggacggcgacggtgcggcgaagccgaaagaggcggtgccaaggcgggaggcggtccggggcgacgacggcggcggaccggagctcagcagcggcggcggagagagagagcgacggcgcgagctcgattccggtgaggagaaggcgcggcaaagggtgaaaacgggcgaaggaagtgcggggagggtttaaatagggttggaagggggagagagcggccggggaggaaggaaaccggcgcgggaggtccagccgccatcaatggcgccggcgagatttgcgggggcaaatccgcccgtttgaacgcgagagagagagagagggaaaaaatggggggaaagggagaggggatcacggggagtatttccccccactttattgcacgcggggacggtaggatgcggcggatttggcggcggcggcggcgcttggcgcgggcggggcggcgggagcggcgggaggacggggatgacgggtgggccccacccgtcagcgagggtggcgggcgggcccgcccgtcagcggcgcgcgcgcgcagggagaggccggattggccgcggggagagaagggagagggggagggaaatgggccgagccggcccaagagagggagggagggtttttttttagggtttttatttttataaaacctttttaactttgtttatttcttaacaattattatttgtgctctgaaaattccactaaaatttatttacacattttaggattttaggaaatatacaaaaatcctccaagccttaatttgacttttaactttgcacattttaatttttgaaggctttcacaaggattttaattattctaggcataatttaaaggatatattttagagtcattttgggacgtgacagaattgctccaaatttttgacaatcttgacatcctttataatatctgaaacaatcttccaacattattggccaaaaataccctgcacgccgaagtaaccacttcatcttgtgagccgattgatgagtaccacaaattccttcatgtacctcacctatcgcaagctttgcttgatcggcgctcaaacacttgagcaacaccccatcgattgttcgataatataactcatcatccaacaaggtgtattttaaagccttataacgctatttcctcgaagctgattgagatgggttttgcaaatactgatacacatcatatctccgatcatcggctgtcatcgtggcaacttctacctccacatcttttaacatcggcttataccctgatgctccctgagccaaatcattagcttctatattctgctctcgagaaacatgcttcaaagttaccagccaaaatccatccatcaaccttcggcatttctcattgtagaccattaatgtatcattcttgcattcatactctcctgccagttgaccaataaccagtaaagaatcacccataatttcgatagcatcggcttcaacttccttaagcatttgcagccctttgagaaccgcttcatattcagcttgattaatagttgcataaggcttaatagtataggcaaactcaaaacttgccccctgaggagaaattataaccaagccgataccacaaccatgagtgcatactgatccgtcgaagaacaatgtccaaggc

SEQ ID NO: 20984 - DNA, 734 bp, Oryza sativa
ccagccgataaatataatctgaaatgtatccctttctgtggaggaatcagaacaggtggggaactaagatattccttgatattatccaaagttttctgttgttctgccccccaagtgaacttttgatcggccttcaatcttaacaaaggtgtaaagggttctaaccttcctgataaattagagacaaagcttctaacaaaatttaccttgatgatcaattcctgcaacttcttcttgtcctctggaggttgaatcttctgaattgcatcaacactcctttgagttacctcaatccccctctcatgaacaagaaatcccaaaaactggccagccgatacgccaaaagcacactttgtcggattcatcttcaagccatattttctagttctctcaaacaccttcctcaaatcggctatatggtctcctatttcctttgacttgactaccacgtcatcaatataaacttcaaccaaccaaccgattagatcatgaaatatgtaattcatggccctctgatatgtagctccagtacttttcaaaccgaaagtcatcacaacccattcaaacaagccgattgcaccaggatatctaaaagctatcttatgaatatcttcttctgccatgaagatttgattatatcctgcattgccatccataaaacttaatatcttgtatcctgaagcagcatcgaccaactgattggccaccggcattgggtactcatcctttgggat

SEQ ID NO: 20985 - DNA, 4838 bp, Oryza sativa
ccagactaatgtttaaagctcacgtgacaaaaatggcgtactatatcttcttcatgatgattcgttttgttcacgcttttgtgcaatatcaccaagcacatccttaagctgacccttctgaagaaaattacacaaataaggaatcaattactgagttaagaattaagaaagtagatggatacacatggttatgaaaaccggggacaataagctcacttgcctgatgcatatctaatatgatatcagatcccccaacaaactctcctttgataaatatttgtggaaatgtaggccagttgctgcacaagcaaagtagaataagtagtgaatttatcgaagaataaacagttgcctgtttctgagaaccagctgaagggcacatgacaacccatgtgttgtatgatacacaatacttaaagtcaataaaaaacgaaaccttctaacagtaaacatgacaagtggagctccattatattgtatatagaacacaggctggtgcctctaataatatgttgtcgaagagaatgatgtaaagcatcaaaggacaaactatgccaatctaaactcatcttgcttgggctgtcattagcttaagattctttttaattgtaaccatttcttcaagatgctttcataacctaaagttaaaaggtcaaaacaattgccttaaacctttatgatataatatcatacaatattcatgccatgaataatttaacctaccagtctagtttgttcccctgttgaaaaacaagtactctatctacataacacaagattatgaaggaatgaccaggagccacttacgtgtgggctttgacactctctttgagcttgaggtctcccaaaatatccctagcactgatagggacatctgcaatagattatgatatagtttaagaatctttggagtgtattatcaaccatatttcaaacaaatcagaactcagtgataatttaccatattgcttgaggactctaactgccaacgcactgaacccacacctaggagcatcaggataacccttcatgtagatcaggactgggttctccttgatatcctgcccaacaattatgaggcagcattaacaaatggcagaaatacatcatgaaactttaagacatgcctagctttgccacaaaataagttcttcaatttaaatgtccaaaaagctcatttagaaatgttaatacctgagaaacaatgtcatcaaaagacatgttggaacttttggttgtaggctggaaatcttgatgtgtatcaggatcagcagcaactcgtgttgaacttgagtccccagttgcagtagaatcgccaccaagtcctgatgagtagttcctaaactgatggatagttggttgggccacagcctatctcccggttatcatggaaaacaagtatgccgcagaaacatgagatcaacagggatatattacctgagcataatataagactgatagaacatggctaacaataaacgcttgtatgggaaaaattatgaccccgtatcagataattgcataacaggtaaagctatacaatttgcttacaaaactttagcagtgcaagattggtcacttctctaatacattggaagtgtaagaaaacctgatacttgcataacccaaggatagaaggttaacaacataggcaagagcgccataagcgctgcaccaaatttaagcattaattcacaagagagcaacatatgcagaagcatcataagcattgcaccaaatttaaacattaaaaggagaaaccgtgggaagaatagcacaggtactatgtggaaactaaacagaagttagtagttttgcaagtatcgtgtttattagatacttcctccgtgcacagtataagtcattctagcattgtccacattcatatagatgttaatgaatctaggcacacatacatgtctagattcattaacatcaatatgaatgtgagaaatgctagaatgacttacattgtgaaacggagggagtagaagccatccacatatacagaatacagttactaaataaagctaatgacgcacaaaaggtcaggtcacagtaatccatatttcaaaccctaggcctagatagagggttctcataaaggaaaaaaaaatggtgggcacaaaatctatcgaatatttcgtaacagaatcactttgatgacaagcaaaggcggataaaatgaacaaaacttcacttcgatgacaagcgaaggcggataaaatgaacaaaactatcaaggagagggacggcaagagagccttacagctacggtcggcgagcagctcgatctcacgagacccctgatgagggcggacgacatcaatctcgccatgactaccctgcagcgacggcgaagaaatcattcatcaaacgccaagagcccccagcgatctaccaaacagaaggtcgcagcaactgctaacccgcgcctacggcctgaaggccgcagcaagtacctgggaggcggcgggacggagccctgcggtggtcggaggcgccgccggcgacagaggagaaggagcggctagctagggagagcgccgccgccgaccttggagcagagttcttgatgtggttttcctttttttttttttccagaaaactccagatgatgttttacccactgggctaggccttacgttgggccttctcaaagccaacttgacgcccaagtgcattcctagggactggggcccatttgtagcccacattgagcccgtttcaaggcctggtaaaactactcagatttggtttgggcaggaagaccagccgagactgcgtgcaagtaccgagctattcgtggtttgcctcgcaggtacagaatatgtattatgtgctgaccgaaaaaaaaaattcttcgtcttgcgtgtgtatacttctccaacgattaaatggtgagtctttttaaaaattaatagataaaaaggttgttttaaaaaattataataatctatttatcaagtctaaaataatgaatactcaattaatcatccggttcaccttgtcctgcatgtcttctctcttcccctgcttccaaacacactctttagtgttgccaaattacttatacaacctgaacctggtgcagtggtgcgcacaaagcacatagcaatgtagattagatagggagagacactacagtttttttatagcgtgattagttatttttgtaatatctggttgctgtaactgggatttcttatgtggtttccagatgagaccgtttgtaaagaccatgtaagtttcacttgttaagatagtaaagaaggtaaatcattagcacattattggttaagaattattgttttaaacttgaaaatagaataatataatattttaaaacaatttttctatagagattttttagaaaaaatgtcatttagcagtttaggaagcgtccatgtgaaaacaagaatattttcttctcttttagcttttttttcaaacggacatgctttttttttccatttgcctcatgcgtggctctgcaacctttgtttctcgtctattgttattcgttctttttggaaggaactgtaggggtacctgttttctccaaacatatcgttcatctaactaatgaattgtttcatcatggttcaactccatattgcaacagtaagccaatctttacgcaacaaatttcaaaaaaaaagaaaaagaaaagaaaacatcggatgaaacaaaacgatgagaacaaaaaatctcactggagagatatgacaacaaaataagaactgtacaacatccattttacaagaggacgcaacattttgcgacacatgttgcagggagttgataatcgtattaaattcaaaagaactacaaatttaatacgactatcaacttcctgcaacattttgcgacacatttgagatggctacaaaatttgaaataatcgtaaaacaatgagaacaaaaatctcactggagagatatgacaacaaaataagaacaatgagaactaaaatctcactggagagatatgacaacaaaataagaactgcaaattggcaagagaagactaaatttaaaagaaccgcaaatttaatacgactatctacttccggcaacattttacgacacatttcagatggttacaaaatttgaaattatcgtaaaaccgcatctccatttgatcgccgggcacttgacacaaagaataattgaacaaatagcagatcaataaccaattgaggcagcacgttgctgctcgttggcaactgcaataaaactatgcatttgatttcaagatctcaggcaatataagcgtggcatcaccttaaatttctcaaatctcaaaacacagctcggatttaaccacttctatcgaaagtccaatggccatacgggcctacaactgaataccatacagttccactaacatacttttgaggggtcactcattacattgctttagaaagactgatgccttcccttatcttcagcgtgcttcatattgaacaactgcaaacacaagacacttgatcaaaaaattgctcatactatccaagacaagcaatctgtggtggtgacggatgacgttgaacttggtttagctatagcattttcaatttgagcatagcgtactttgcttgtcagaccatatgagaacacaaacaagatgccaagctgataatcagttttcagttttcaaattgacggcaacaattaaatgcagttggtgtgatgaacatttcactaattataagcattactttctaaatgcaacaggaccacaaccagctataaaacaaagcacagagcagtgttataagcacaaaatgcttcatttttagtgttataagcacaatcatttcaaaatgaaaagga

SEQ ID NO: 20986 - DNA, 2707 bp, Oryza sativa
acatttttgctggatccccaccaatgtaaggtacaaaagaaattattgcatagatgattattacatgtacttgtgtgcttcaacttgtttccttttactcagagcttaataaccaatcaaacatcattgtacatataattttagtgtcgtcactaactcaagtccactgaactcatccgatatggaatacaaaattcttatatacaaacattcttcagagaaagccgaatctctttcaggaaaaaagtggactacaaactagcccatagagctacaattcgaaaaaaaaggaacaggatttccccatttaatgtgttactgaaagaaaatattttgccttaaaaaatatgacatgcaaatcgcaagctacatttatatatatcagatagaatcttgcattgtactagaggataaccgcaagaataaaattcagttctcaaaaacagggtacgagagatacaacattttttagtaaagataagtttgcatttaattttggctgaaagattttcattgtttgagttcaagggctccttgtgatcatgccaccttggggcttgggcagataaacacaggcacatggtatgtggccattgagttgtgaacgacaacctgatcgttctaactatatacaatgtactttagcactaacccggtccaccgtgcccctactattgtgtaagctaacctatggaaactcaagaaatcaaacaaaaaatgacgctctaacaaaagacgatgacagcaacaaaaggtagcctttttcaagaaattggttacgggttaaacatactccggcgggtacgcttcttgtagaggatgcgatagccacattcacggcactggatcacatctcctggcttcagtgtgttctcagctccgcaatctgaagacaaagaaaatcacatttgatatcaaaatttgacaactgaaccgaattcaactagccataatccaatccaaccgatggagagagaaaccatcaccccaaaataaaaactgggaacagaaaaaaaacatcccatcccatcgtgcgatggagctccaagcttcgacggcgttttaactgctgagtcgtaagccaccccccccccccttccccctgatccggtgcacggaggggctacagccatcttcaatcatcaattacatcatggaacaagaaacttgcgttctccctccgacgcccgtgtttctaattctccaacacaaatcttctccccgggccaaaaaaaaagaaagaaaaaaccactgcggcaaatcggccaaaccctaaccggcgatgcgagaggtgaaggatagaaggaatgacctccacagagatagctgacgggctcaggttgttgcggatccatcggacgcagcggcgctggtggagcgcggcggtcggccggaggcggcgcgaggcaagacgacggctgcaggcgccgggcgggagaggaggcggcggcgcgcgcggctagggtttcgacgacgacgacgactcttgtcaagcgagacgaggttggtggtggtggagaataaatcgattctattgcctttattttgggccgagccatgtcaagaccggcctaactgggcccgttaggcccgttatatgggccggcctaacgccgcaagcagcgtgcgagacaggcgacaggctgtcaaaggaataagttcatccgaggtcccttacttgtcaacatatccgattttcgtccttcaaccggaaaaccagatacaatgggtctctcaactatcaaaaccagtgcagatgaggtcccttggcgatttagatagcaattttggctgacatggcacatacgtggctaatttgacacggtcttcatctggcgtggtgcttacgtggcaattcaatccggaaaaataatataacctgtgggacccacatatcagtttcacacacaaaaataaaaaaaaaagtgggacccatgtgggctccacatgtcatcctcccagccatcctcttcttcctcctctctccatctctctcaccctctcctctctactcgctggcggacataacgacggcctggagaggcgtgacctcctccactcccgccccccgggcctatcgccaacggccactgggaaagaagcggcgcgcgagcgtcagccaaagggaggagaggagcggcgcgtgcgctcggccaacggaaggagaggagctgcgggcggaggccgaggggagcgggagaaatccgcgatgcgctccgcatccacatgctctctcacggtgccccgtgcccccccgcttcacaacctaccttgtcacgtgcgtcaaccaccgtctcccgcactcgccaccaacgcctcctcatcctcgagggtgatggtggggtcgagaggctcctcgacctcctcgacgcggctgacaccggcctcgatgcacatgctgcacttgagcacgagaacaatgtgggtcgttgaggccgtagagatggacgcggagcgcggcggtggcggcggagaggggacgcgcggcgctggtgtggcggaggcagggcgcgaggaaggaggagaggctgcagtccgcggcagcatcgaggatgcggagcttgatctcgacctccatcacgggggtggggaggataggggaggctaggatttggggttgcgattgggattggtagggaggccgatgcagtgggacttggagtgcgcggcaccaggcagtgggtggagaagggggttggagttggag

SEQ ID NO: 20987 - DNA, 21832 bp, Oryza sativa
  unsure (1)..(21832): unsure at all n locations
agatgaagaccgagtcaaattagccacgtaggcgccacgtcagccaaaaccgccatctaaaccgccgagggatctcatctgcaccggttttgatagttgagggatctgttttttctgttgaaggataaaaatcggattcgttgataagggaccttagatgaacttattctggctgtcaaacgcggaggtgtccctagcacgcgctgcctccgacgaacgcgcgccacctgttcgacgaattgctgctccgagacagccacggcctcgacccccgtgggcaccctcaacacgctcctcgccgtcgagctgttgaagcggatggacagaagggcgagggcctgtccacagactgttgctcccaccatctacacctacagcatcctcgtcgactgcttaccgtcgcgccgcgcgtacccccaccccccgacctaaatcaaagtttactaggatatttagacttttccattttttatggctttgtttcaaattctctttcccttgcgggactactttcacataaataatcgccatgggtatctaactaccagggtttctccccttaacatccaaacaacctgtaatatactcaacgccccttatgcatatgcatatccgaatcccctattatcaacctaaaaatgagcaaaacttttacgtatgtgtccttagcaattcaaatccaaatgttgtaaaataaactacaatgaacaaaactacaaaatcaactccaaaattaaaatttaaaattcaaaagttaccttataagtataaacataagcaaaatgatgcagctgctagtctaaaacaacaaaatttgaatggagtaaaatgattcccacaaaatcttcgtgttaatatttcccttgaaaatttcacatgaaaaatgaggagattaatgaaacaacctttgctagaaagtacagagcaaaagcagcacgttcagttcacccgaccttgctggcaagtggcatcacaagagtgcacatctcatgattcatgatggcattccaacttagcttaaggtgtcaactgtcaacaacccattgcataaagctgttctacaatatataactgctacattttagtcaacctatactacagaagtatcagagtgagacatcagctgctgattatgtacacgtttcaggcatccagtacaacagtagcctgatttccagtaccagtgcagtctagatataaaaggtttgtgtgcaaaagaactcctaggttatacagaacattatccaccattcatcctgcacttgatgtctggtagcgttctccaatactgattcaaagattggggcagtactgcagccaaagtaccccacgattcaggcagaatgctcaagatctcttcctcttttcgctctttcgcagacgtcctcttcttcctgtcaagagtgtgtttttccatgtaagtttctcatttcaagaagaaacaaagtctcacacatttttttcctaaactgaaaatgtgtttccagattccttttctttcccctcaaaacagacacatcaggaaccagaagatgaattgacgaagacaaaaggtgtttccaggtttcatttttgtcgaaatggttacatcagagcattgaactcccaagtacaaagacagataacgatcttttatggagtaattgtaactaagatgccaggcaacaaattagacaaagcattcaactaacctttacggggcgtatcatgtatttgcagcttagcagcagcagtcacagcaactgagccaacctacaatgggtgacaacgtacatggtttagtaaagatgcagtagaaggtaaaaaaaaaaaagaccctcaacaaagcggcgtgtttggtttagaacattgaaccctggacgttcatggccaaaactaaaagtccataggtgcttactaaaagctgggcatgttacgggctactatgctaatgcatcctcattagaatatttagtaacatggaagtccacataagagatcctagaaaataagcttcaatattttgtccagaacgaaaggaatcaaatagccaccaattgatatgatctacagatagcctttttaaagtaactaaaacgactatttagttatattacatggatctataggatatgtaataacatgtggcttatctacatatattatttaagcagcagcatttcatcagtcaaattgcatcatgatcattgtagacatacattgcacaacgtattgtggtgaaaagtggaattaaagcttaaatgatttgcatttaattagctatttctattttttcttcaaggagcaaaactcaacatacattttcctgagaaataaggcctgtgggacatgtgacatttttatttggtataacgttctcagagaatgtattgtcttgcatcctcgccctcttgtagaccttttttgttgaagcactagttgaaattacgatcactttgccattccgtaatcgcctgactgtactgccttctgagccttgaggaacaccaaactgtggattcatcccttcatttgtttctaatgcatccttagtacccaggtgtgttaaggatttgccacattttggtgttgcacaatctcctaagacagaggatacatgacttgtactatcattatctaatacagcatcccgtttagcgttactcttcgcatattataggcagaactacagatggtcctacacttgatgttccatgctgaactttattcccattctcacatgtattcatgagcatacataaatgctggttattttcttgatcattaccacatgtttcactaggggttgcacgaggttcttcaggcatgtccattctgccagtgcaaaactcctcagaagtggccaatgtgcccatgaaattaacattacaatctgtatttgcagtaggatcctcaacagtaggtcttccattagaagaattagaaagcctctcgctaggaaatctgtctgcatcacttctagacccctgatatatgttgagaccatcccaagagaaaagtcccattgaatattttaagtttccccgcaaaaacttttctatataatattcagtagattttagtggagattgcggctgcttgttcatctctgccatgtttgcattaataatattctcccattgaaccggaaagccaagtgagaagtgtttggacacctgcatgaatttgatgagatagatcatatattcatatatgctgaactcactgagccatcagtttaggatctcttccagatattagattggcagagtatacaaggcatgtcaagcaaaactgtctaaattatgcagcagaaacaagaacaaaatcactcaattgttttaacagcagataatgttacaaaacactggtcattgaagacagaggcagaactagaaacaccttttttttttttaggtggggtgcccacgaaatgattagtaatttctactacataattttctaaagctacagtcatttgaatggaatttgtatgctgttgggggaggtgaagcccctgctccctccccacccctatccagcactgatcaaggaccgataaataaagacagaaactaaatacctcgtcaggaaatccattcagatgcattttagaaatgttcggtggacgtgcaatcattatgatgataccatcttcagtctcaaggtcaccactagcatgccgtgttttaatggaagcagaagtgaatcttctaccagctcgactcctgttggaagagtgaccaatttgtcaataaaaaatgtttgttcatccataaaaggtctgcaaatggtttaatattgtatttacagaagataatactgttgtcacaagttgcaaaccaaaagatgagaaataatacccaagctaagataaatgctatgccagaacctgcagatatttagcaaaagaaatccagagacaatattataacataaattagagaaatgaagtcaccagtttctagaatgaaatttaaaagagtcacataattagtctcttcatatttattttggagttataggttagaagcatttttgtttgtaataaaatagaaaaatcatactagatttagtaaatacatttcccctaagtaacaagatagtatcaaattccagcacagcacagcagccacaaaagacaagcatttttgtttgtaataaaatagaaaaatcatactagatttagtaaatacatttcccctaagtaacgagatagtatcaaattacagcacagcacagcagccacaaaccattcctaaaccaagcacctctaatcttcgaatcccactgactagtttttcacatagtccgtatgttactactaagacgccatttcagacatcctaattatctctggtacacacctctatatgtacaaaacaaaatgttaaaaatgtaaatgaccctgaggtgctttcaatgatgaatctaccggtaacattggcatgtgtatatcagtggacaaagctcaatttgcacacaagcggagtaaaacacctaaaattcacaaatatgctaaaccttcagtaacggcggttaacaatagctactcagcaaaagtgaactctatgaaggtaggtaaccaccaccatcttacagatttttttttttttggtttttggaaattgaagcatagcgagcatcattacactaaaaacacacagatgctatgaatgattaaacaaaaaaaatcgacaggaggatacagtaacaggaacaagaagggaagggaagagagcggcttattacgtcgtggtgttggagccgacgacgcggaccttgccttcctcgccttcaaccctctccagccaccagtcgtcgagctcgacctagatgaacacacacacggaaagagaagcgggatgagatccagagcccaccaacgccccccgcgccgacgcgcttacgacgatagagggaggggcggatcttacgcaggcctgcaagtaggacacggcgggggcctccttcgccgccgccgccgccgccgcgccgtcgccggctcggggttgggtcgccatctccggcggtggagaggggaacgagttttccccgctttttctttttaaacctttttttttaggagtcggagggttttggaagggttcggaatttgctgggaagacttgtcggcccaattgggccttttcagctggagtagattgtatgggctgggccttagttgatgattggcactattttaacttggaataagttcattttaggtctcttaacttgacagcgagttcgattttcgttctttaacccaaataccatatacaacatgaccccaacttacaaaatcagtgcaaacgagatctctcgtagtattttccctggttttggttgatgtggtgcctatgtggcttcattgactaggtcttcgttctacatggcattgatgtgacgcttacaaggcggtttgataaaaaaagctgtggggcccatgtgtcacttacataaaaaaataataataacatggtgggacccatatgtcaaccggcttccttcccttcttcaccatcgcggccacgccctcttccaggtgccactccctgctgcagtgctgcagccgcccccactcgttgtcatcgacacgagtgctaaccagtccagcagcgtcaccagcagcttcccctctaatcgcacatcgacgtggcgcaacaactcgttcgtggtgctgcagagctccgggtcaaacatggagaggccgagcatggggcgaccgagatggcaatcccgacggcaatgtcaggtggcctcggcggcggctatacctcaaggcatcgctatcggcgaagaagaggagtggcttcatcttcccaccatggtcggggtgcggggggctgttcagggtgctcaccggcctccccgcccccccctcaccgtcctccccgcctcctccctctctgtgcggtggaggtggtgtctccaacggcggatttggacttgggaggagcttgtcggcctccccacctcgtccctctccacacgcgcgggtgtccgccgcacctccgctgattcgacctctactgcgcctctgctcttgctcactggcttcctcgcctcaacctcttgtcatctgcagcttaagtccaccagagccacctcctcgccgattgcccacagtagccaccgctggcgactaccaccaccagagcaatgccaaccgcatctgggaaagcttaaggggaggaggggagaaggagaatggaaagagatagagaagagaggatgaggtaaagaagtggggctcactgatatatgggtctccactatttttaatcttattatttgactgacatgtgggcccacatattttgttttattttttaaattgttaaagtttgctttatgtgccacgtcaaataaagaccgagtcaaattaaccatgtaggtgccacgtcagctgaaaccaccgtccaaactgccatgggacctatatagcaccggttttgacagttgagggacccattgtatctggtattacggttcaaggatgaaaatcgaactcgctatcaatataagcgacctcagatgaacttatttcattaaactttgacaactatatactaatatatatatatatatatatatatatatatatatatatatatatatatatatatatatatatagttcattccaaattaactccccactaaggcttcgtttgttcctttcatactggatttttggcgcacgtgaaatgagaaaactcattagtacactattaattaagtattaactattataaatttaataaatggatttatttctttttaaaacaacttctctattcaaaattattttcaaaacacaccatttaacagtttgaaaaagtgctaacgaaaaatgaggaagttgaagtttgaagaggagggaaagaacggggcctaagtatagtttatgttatttctcaattctctcgtgaagccatatcattccaattatttttagcatttggatgatagatctatggtacaaaatatctcttctatcttctctcataaaatcatgcaatttcagttattctaggttcaaaattcataagtaaaaattacataaaatatattcaccttgcactatatttttgaccatctgtaaattatacatagaacataggaagtcatttttttttaaaaaaatatatattgcggcttatttgtacaaattatgcaatgtaattttccgcagcaacacaacggcgtattcatctagtaataactctgaaatggttacattgcaatggacgaaagtttaatgcatatatttaggaggctaacacattaataacatatggtatccttttaagcactttgggcatgttcaaaggtagagactggtttgggctcttagtctagttagaatgttagatactatcctcctacaacaattgggacgacaaaagactctaacaattagtacaccaaaacggttttttattatctttctttcctgttctctatcctcatgcagcaaagttttctttaagaaatgctaagagtcaatgttaaatcattgtcatgcataacaatgatctttctctcttccatatcaacaaacttacctaagaccctgttattaattaccattatacatgcccttatactatttctctacaaaactatgttaaggtttaaatataaatggtgtctggtgtcatttgttactaaaaatgcatctaggacctctaatttattttggtgttaatgacaacacaaatacgaatgttctattgttttttgttgagatggttgcaagggtcaaagtggtgttgaagttgaataaatattagcgtcattttgaatgtggtaattccttgtaaatcttgtttaattgtgtttaggatgtcatactattaagagggataccacgtgcatataattggttgaatactagtgctcaaaatcatttgttttaagtgttcctgttgtttaaatcagactatccgatgtgacagacaatccgaaatttcaccgaaagtcactttgtctctggactgagtgttggcttaaaatcatcggactatctatattcccaactatatgaattttcatgaaacttcactctgtcttaaattgaaaattcttcttgagtaatgtaatttttctaagtgtaaaacgaagcgtcctattatggaacagacagttcgatgacacggagactccgaaatttcatgaaatttgagtctctgtttgaggatgaaattttgctcctaaaatatcagactatctgagataaaatcggactatccaaaatttctaagaacttggttctctatctctcacttctttgggggctaaaaatgtcggtttgtccgatgttacatcagactgtctgacgtgggctgaaagattccccttcaaggaccacattttggggatctatttatacgctccacctaacccttctctagggtcacccattctcattcactttgggttgaggttggtgctaaggcgctttggatctttgagctctttctccctctctcaaatccctctttgctctttgtatatttcactcaatcctaagcactaggatttgtctaacggttggatggtgtttggtactcctagatgttgaggactcctagacagctaggcgttgctcttgagccaccgatcttcttgtggttggccaagggaagtttgtaaaggccacatctcaccctcgcaaggaaagacataccaccagtgggaggagtgcatttatgcaacttcaagagaaaagggttggaaaagatcctgttctttgtgagctcctcaatggagaatagaatcccctcaaggatttgaactccgggaaatacattgacgaaaaatcttggtgatattctctctctgtctctctctctctctctctttacttacttgttgcataatccatttgccaagtttgtaataattaaaacttaattagtcatgtgctaatgactttctcattgtacatacgttaacttaactctatcgtacgttgctactgatactgtctcatgtctgcatgcctatggctctactggtagtagaatgtaatctgaactgttgatcttatttgatcgaagagtttagatttatttatactaccacttcagttagtggtagtagaaacgtggagtggcattattgtaaaaaaaaggtgcggagaggtataatcatcatttagtagtaactaaacatttttttttcttttttggatccttttatggaatatgagtgatgccagcacaatggatgattatggatcgatttaaccggtattatagtaaattactaatttaccctaataatattggtagtataatactactagtagagagtaccggagcatcacttgaccaattaaggcctaagcatgacaattaagtattaatctaccatctagtggtgcatggagcagggcaattgcccacactagccaggccttggcacagccactgagttaccttgtccttgccggagcaggacaagtgcttgggttctctgttgcgcgcccatccctactgttgttgttgctagatttcatgctagtgtggcgactgatgagagagaagcccaagtagggtaaggccattcgcagcgcaagacaacatatgaggaaactcgaagtgccaaataggatggagcactttgaaacaactctctctacaatgcaagcaacttatgatgggacccacctaccctccatagtccccacctcagtccctctcccctccccctctcctttcatagtctcacgtctctgaattttgcagatgagtggttcccttcaactgtagctttgcaggccaagcaccagggtctctaggaagactcgatcttcctcacaaggatggatatgagccctacctccacatcagtagctatcatacatggagggagaaggaaacttgccacataggagcattgtgaagggcctaagtgcatgggttttctaccggtgaatccaaggtcggacaagcaggacaagtgcatgggttctctgtagcgctcgtccccattgttgtcgttgctagtggtcattaaaaacaaggaatattggaaaataaatctagagtctatataggaatataacatagaaataactaaaaattaggatttaaaaataagaaatattgaaatacgggtttagagaccaggtttcagttaagttggcaaaaagaaaaccacacttcattcactactagaaaaatgatttttagcaatgttagccttttatttttccaggtggatatgaccattggagccaaatggctgcctacaaaaatgcaaacccggttgaaactcgctgtccacctgcgaaggcgaaccacttaagcggtccgcctgcaaaaatacctttatttttgcaggcggaccgcttaagcggtccgcctgcgcagatgggcatggatataaatagacaccaccacacatggattttttataagtgtcatagctctcctctcccttaggcctcaccactcctctcagctctcctctcccacagcttcctcagcaccggtgatgggagcggcggaaaccgacgacggcgaggcgctgaggcggcggggtcggcggcgacaatgacaaggcggtggggtcgacggcggcaacggcgaggcagcggggtcggcgcggctcccctcccctctctcccagatccggccgaaggggggaggggggcgagaggtggcggcggcggcgcttcccctccctcccagattcggccggagggaggctggggaagggcggcagcggcggcggtgacagtccccctccctcccagatccagccggagggagaccgggggagggcggcgacagcggcgacagtccccctccctcccagatccgaccggagggaggccagggaagggcgacagcggtggcgacagttcccatccctcctagatccggccggagggaggccgggggagagcggcagcggtggtagttcccctccctcccagatctggtcggagggagggggagggcggcggtggcggcggatgtgggtagaggcgcgggtggggtgcggcgaattttttttgttcgtcaagatgattttcacaggcgggtgactgggtcgcaggcgatggcatacagacggatcattcatccgcatgagaggttcctttttggccacctgaaaaaactatttttctagtagtgagtgtaacgatgtttactcagatgacactccggaaaatactctgtcggtgcctaagtgtacttattatagtaactccaaattccaattaatcatgagaggccgcagctagcttatcgatcggtggtttactcgtccgaacgatgctactcttttcctatgcacgtaaacctaactaattacgttcttggcttcacagatttgctttgtcatcgtcccattttaccattttgatgcaggggaattgagtggtgaggagccaaacttaactgctaaaacctgtactatcttaccacagtccacaagtgttggtctgaaaactgtgatgagctgaagtgatgccgggacttcgataaaagaggttggaggtggcaactagttctcttttaatattgtcgatttaacgagtaacgttggaattttgcaaaactgttgcgcaaaatttttaacaaggaactgtcaagcttatcagtttatcctgtgagcagtggtgcgggtgtcaccctggaattagcccgggcgattgatcgaataaaagtacgtgtgattaatggtaaaaaaaaccgcacgtgtgaatgcgatccaacaacacctggttccaccacacatgcagttagttaaactgataatcggaagaccgattccattcaaaagagatcaggtagttaaatatttcagttgatcattgctaaaacattatgtcatacatgggtgaaaaaagatcactaatagaaatatgaaccatgccaccctatatttacaaaatttgagatatgccacccgtatctcaaagacatgtaggaaccacatgagtcaatgacatgtgggtcagggtggcatatcacaaattttgtaaaatttgtgtggcatggttcaaattgtccctagaaagatttaattttttttgaagcatgtcgctatagtgtatgaaacattaagtttaacggtttgaaacatatattttctttcatcagaatataatcgtatgatatcttgctataaagatttaattacgacgaatacaatgatgtaatcgaatcatagatcggataaataatttgggagaaaaattattttaaatgtcactacatgcatgcatgcaggaatggaatgcagagagagaaaatagtttgggtagagagagtaagagcaggtgcttgtgtaagttttgtgaaacattatgaaaacacacgctaaagcatatcgctatagcttatgaaacacagagttttaatggttcgaaatatatgtttttctttcaatggaatataatcatgcgatatctactttgtaaagatttaattacaatgaatatattgatgcaatcggattataaatcagataaatagtttatgagaattttttttaaaaaaattgataatatatatgtgtgatagagtgaagagagaagcatgtatagttggttgggaaattggaacgttcgatatttttttttatcatgtaccgataggtgtataacaaaagtggccacgcctattgaatgggcagcgtaatacgtgtacacaaatatgcccgtacagatggaaattgcgacaacgacgagcggcgcatcgcgcgcgccgtggatgggatgagagctcgcgatctcgcaccgtcacacgctcgtggaaccaccacgcgtgcgcgacgctccacgaccaatccactggtcggcgtaaggggtagtactcctcagtttcaaaatatctgacgtcgttgactttttagcacatgtttgaccgtttgtcttatttaaaaaatttaagtaattattaattcttttcctatcatttgatttattgttaagtatattttgatgtaggcatataattttacatattttataaaagtttttgaataagacgaagtgtcaaacatgtactaaacagtcaatggtgtcaaatattttgaaacggagagagtagtagctgggcgtcaacaccacactgcttacgctttcagcacaccacactgctgctgtttgcgctttcgcctgccacgatttgtttccggccggctggccttggtgctctcgcggcctcgcctacacagtttgctggcttgtcggttttctaggccggcccggttgttgacttgcacccatttgggcccatttgcctttagcctgagcctgtggaggtcccgcgcctcgagcggcctgagccgctcgccgtggaccacaggagtcaggacgtacgagtatgcaaagccgtacgacaacgggtatttgacactccgtgaaaggcaggatgccaccatccttgctcctaaccaatattgcacccatgtcggcacgtcggtatggccacatcacgcatcatatactacttatgttttttagaagattagaaaaggtgtccttgcattgcaatggaaaaactaaatcgtgacacattttatgtgcagcatttgagtgttatgaattgtgaaattgtctctcatgtgactggttattgcattgcgatcgcttcacccctgattacggaaatctcacaaaaaaaagaatagaaatattccaaattcggagatgatagaaataactggaagatgcacatgactatatgggtgtttatgcaacaggctttaaaaaaagagaatcccttatatgccattataaattggccaattctcttatatgccactcaaaattggcttctcccttatatgccactggttcaaaattttccacccttttataccactcatagtactatagtgttagttgactgttagccaaacgttagttttttcgtaaatgaccaatataccctctcaactaaaaaaatgtgtaaacttcaaaaaaatcataactaatttattttaattcctttttgagtgaacaaaattttgtcagaaccagtgaaaaatgctatttgtattaaaaatactgttggaaaactgcatgtttcatacttttattgaaaatttatttgtgatggtaatggctaaaattgcatgtgatgaaaaaaaaatcaattttcatatgttgtatccagtagctataagtagtgaaatacttatttattggttgtatatcaactctcaaggacaaatgcgtctttttactatgaagttaacggtcaactgatagtgaagtgacgacaatggcataaaagggaggataaacttgaactggtggcatataagggagaagccaatttaaagtgacatataagggaaccggttaatttagagtggtatataagggattctctcttgaaaaatagccaagacgtatcatctcgtccatatctcaatcggatcaggattacattgcagttgacctatagttagatattataaaatttttatatgtataaatctaatttggtcatgcatgctaaaaagtaatatatgtatcatatccatcccgttgaattgttatataatttttcatgactttggaaggatgtcttcaactttatggtacaattggcatttagccaaaattaatacaggaggatctcatgcctttggtctatgcaatctcgaagaagaaaggaaagtccctgcttcaagtaaaggaaaacgatgcttggatcgacaacttataccttgaagccaacccctcaatctcagtggaccttattggtcagctagtcgccttatggactactgtgcgggacatccaactaaactaggagaagcctaatcaaattatctggaagttcacaaaccatgggcaatattcaacgtcgtcggtttatcaggcacaataccttagggcaccaaacactatatgtgattcgctcatttggagagcttgggcgtcaggaaaatgcaaattccacgcatggctaatgattcaaaatagggtctggatctctgaccgactcgcgacctgaggatggaaaaataatgggctttgccccctctgccatagagaagacgaaacagctctatgtctccttgccagctgtagatacacaaaaaaaaatatggagcctggtagccacctggtggcttaccagcagcttgatcttggataatgggaggccacccagaccgtaaaagcatagtggaaagctctagcaaacataatagggattcccaaaaggggattgcgcactctcatcctccttatcgtttggtcttcgtacacattttatatacgaattttatctatacaaagtttaaatacactaatagaaagtttctatatactaatgaaaagtttatacacctatatgtatatacatatgtatctacccgtatgtgtgtgtctatatatatatatatatgtatatatacatatgtatatatgtatatatgtatatatacatatgtatatatacatatgtacatgtatacatgtatgtacatatgtacatgtatatatatacatatatgtgtgcgcgtgcgcgcacacaaaagtatatacatgagtatgtcatgtattgaactgagcgcacgcgaccagtgtccctacgatgacggaccatttttttggatgacgattgaatatgatacgaatttgaagtcggacaacgtatcgtactcgaatcgaacaatgtatcaaacaatcgataaaaatatttttattttttataatagtagagataatattgttgacttttgtacacatatttgactatttattttatataaaaactacgtaattatcatttattttgttataagttgttttatcactaaatattttaagtatgatttatatcttatgcaattacataaaaaagctaaaataaaacgactgatcaaaatctatattccaatatcaacggtgctatctacgaagtatttttttaaaaaaagaatacctgataacccacggtgttcgctggtgccgtggaggacccgcgcggccgtgccgctggagccattgtgctactgtcgtgctggattggtagctcatgacccatgagcccatttatcgtagagcccggccggccggccaatttaacgcctacgcggccactggcgtgcgtggtctccggccagcccgtgcaagcgggtcgagcgagcttgcgaccgtggacaacaacaacacgtgacaaatcaaggtgcaggtgcatagtactcgtacgtagtactatctccgtctcaaaataagtgcagccataattttcagcgcccaactttaaccattcattttatttgaatttttttaagaaaattaaaaacataagtaacgagtaaagtattatttatgttttatcatcttataacaacaaaaatgttaattataaaaaaatttcaaataaaacggacgatcaaagttggacgcgaaaactcatgactgtattattttgggacggaggtagtagtaggcagcagctgacacagatgaattattttactagcacgtgccggcagcttcaggagtacgtgttggtacgtcttttcacaatttcactgcaccagcgctgcgcacttgtacgtccaccaccgcgtaccggcgtactcctacgtacgtaataaaagtgatggtgttagtgttgaattgactcatcagttcgtccaatgaaaacatactcaacctagtaccaccgatacgatatgttctattattataaatctaaatatatatctattcagatttattttactagaatatatcatatttaatatattcggtttttatggagcggatcggatggagtaactatgagcagggtgctacggcactgagcaacagtacgtgatgccggtcgttaccctgatctgtggcacccaatcacgaaaacgttttacatattcgccggtactgaacagccgtggtacagagtatacgtacccaagtgactcaaaagttttcccttaaaaaatgactgattcttgtattatagtatatttattgttctgttgcgataatttatagggattggttttagggaagcacagtgtaagactccaccatcagtcacacaggtggtgttcatttctaatgaatgaagataaatttaaggtatgaaaaataaaagtaatcattagcgcatgatttttttaagttttaattattacaaacttgttaatttttaaagtaacttttatattgaaaatttttgtataaatacaccgtttatcagtttaaaaacatgttcatggacaccgaggtaaaatctttatcttaattagaaaagaaggaaccatttagtggtttgctggtggcttccaggcctccaacgggttggttgtacggccatccaagtccaatcttatccgctagaatctcttttgagggaaaatgcttgtaaatatacattgtcgtcggtctcgttggctttgctactacgcattgatataagtttttgttaagttcacagattttacacgagaagaatatgtactatgatcataaactaggcatcatgtacgcgactaactcaaactgacaacgtggtgcgcaaccactatggtttatggatagtataaaggacgctggccactgcaaaaggcatatagaaaaaagggtgcacagtcccatccttctcatggtatgagatatttggaagaaagaaattaaatagtatttcaacacaagaaactcatggcaatagctctgaacgcaaagacaaaaaaaaaatgtactttggcaggagcaaaacatctttctaagcttttagcttaaccctctgtgtaaagtatttttcttcttatttacctgcacattaactattttactcctactctattcaatttaaattgacatatctcgaaagggctgaatatatgtgtgtagttttttttaattttttttagagaaaataattttactcagcctctaaatctaatcggatatatgcagcctttttaaattagaaacttagtctcaaacagggaacttcgccatcaaataacccaatctaatattcgctcgtatgaagatttgaactcagaacttggggtgctattcagatcactgcaaccactagactagtgctttttcatgcgtgcatatcttctttaattccacgaagttggaaaataaaaccaatagcttttctccacatgtatatttgacgtttaggcagcattttgtgctctgatctatgacaaatccaagaacattaagaagcacaaaattacagttttaaccgtacgtttcgttgattaccacggcgagcaaaaatgcactctgtgcgcccacagacagagaggactgacggcccaaaaacagccgcgcacgcggccggggtttgcctggtgcctagctaacgacggtggtgcggattgccctagtgcggtaccacactagttaatgaaacgcgacagcagtacgtgctgctactccgtttactccaggcaggtcattacagtacatgaatatgaatgttgatcgatctgatcacaaaagcctgaatacggaacacgacagtctgacagcgcctgtgcattaatgcgagctgtaactgcctcagataatttacagtgaactttgtattctctctgtcctaaaatataaaaatattagcacttaaaatttgtattaaaatataacaacttattcactaatattctcttctcaatcaattacgggcctcatcttttcacttatactttatcaaatcaataattgaatatattttcaaaataaatttatcttgggttaaaaatattacaaatttttttttacaaatttagtcaaacttaaaattgtttgactttgaccaaagtcaaaacatcttataacttaaaacggagggagtacatgatagttcaaaacaatcgatcacaaagggtgtataattaacaaaatttatacacgaattaacttataacttaaacaagtatgtagacacgttaagcgtgtgttgttgggatacgcgtaggctacgatagcataaattaaaattttctatcgcttaaaccaggaaccatgcaagtactagagcatagatcgttaccactcgacgcgctgcgcagcggaagaagacgctgagaagtcgaaggaattctcgtgaagtagcgcgcgtcgatgtagaggaagtagtcgatcgcaccggctcgaccttctcctccttgtgcgttctcctcgccgtactcccacgccgattagcaccgcaaaccagcgttgcctctaccggtatccatacgtacagggacggaacgccacgcgcagatgtgctagcacccgcgcgcggctagggttttgctcggggagggaagtgacggctagggtttctcacgtgatgcaatgcctccgccggtcacacccctcacgaatatataggatccatcactcgggtctccaaggcccgtaggactcctattcggatccctatccgaattaagctcatattggatctctatccaatccccttattccggcccattaagcgtgcgaccctataggttcatatatactcggctgtaacccgaaaactcctttttggtccacgcgtcaacagcggcccctagcagaacgtattgacccaccgggcatacataaagatcatatcggctgaacctctagtgtatccttgtatgaatccctttgcctcacgatatcgattaagctcaaggctagatatgtgccatcctctaatagctcaatcattcactcgaatctgttgatagattatataacttatgattgactcctcaatcacctttggcatggccatgcacttctataatctacaacatcgaggggcccagagatatctctccataggaggggcaaatctcatcttgattattcatatcccactacatgtttcatagcatacccgaaatctacttttataactacctaattacggagtagcgtttagtagtccctaagtaagctactacacatgttgagaactatgataatctcatgtctaagtattcaacaccaacactcaatgagatcactgatgacacaacacatatggctcttgcagtgtctcatgttgggtctatccaacaacatgttcaccaacatgtgtccacattattaatttggtatctctataccatgatccatgagacatgatcatcaattaatacatgtgctgatcatataaacatatttgttccacacatgatatttgatcagggatcctttagaaatagtaacaaacaacataaagagtctcatgaaagaatcacatattcattaactaataaggagttatctatttcaaggaataatgtcggaaaaatatgtaaacatagtatgtgatacaatcatctctatgattgcctctagggcatatcactaacagtctcccacttgcactagagtcaatcatgaatgtatcttacaccctgccctagtgtgtgcctcatgcttaggctgagggagtggctttgtcacggattctgcaccattcaatccggtatgtatnntgcatatcttcacatctcttctacccactttctcgcgaatgaggtgataccgtcgtaaaatgtgtttggacttttgatgcgatctaggctccttggcttgcgcaatggcaccactattatcgcaatagaggtccatagggctagaggcactagtcatcacacctagttgagaaacgaatttctttatccaaacagtctcctttgctgcttcagaagcggcaatgtatttggcttctgttgtagaatcagccactgtatcttgcttgggactcttccaactcacagcgcctccattcaggcagaacacaaatccagactgcgatctaaaatcatctttgtcggtttggaagcttgcgtcagtgtaccatttacaacgagctcttcctgtcctccatagactaggaacatatctttagttcttctcaagtactttaggatattctttatagctatccagtgactctcacctggatctgattggtatcggcttgttgcactaagtgcatatgaaacatctggacgtgtacatagcatagcatacataatggatccgattgccgaggcatatggaatcacactcatcttgtttcgctcattagtcgtttgaggacactgattcttgccaagattaatgccatgtgacatcggtaagaaacctttcttagaatcttgcatgttgaacctcttcaacaccttgttaatgtatgtactctggcttaatccaattagcctctttgatctatctctatagatccttatgcccagaatatatgctgcttcccctaagtccttcattgaaaaactatttttcaacgatgtcttaacggattcaagcataggaatatcattcccaatcaataatatgtcatctacatataggattagaaacaccaatgcgctcccactaatcttcttgtatacacaaggctcttcttcgtttttgacaaagcccaacgccttgactactttgtcaaaacgaatattctaactccgagatgcttgcttcaacccataaatggatttctgcaatttgcatatacttttagctgattgtggatcaacaaatcccttgggttgtgtcatgtacacatcctcatcgagatttccattaaggaaagctgttttgacatccatttgccatatctcataatcgaaataggcagcaatcgctaaaacaatccgaatagattgtagcatggtgactggcgagaaagtttcatcataatcaacaccttgaatttgtctaaaacctttcgccaccaatcgtgccttgtagatgtgaacatttccatctacatctgtctttttcttaaagacccatttgcactcaatggcttttacaccatcaggtggatcaaccaagttccaaacttgattgacatgtatggattctattt

SEQ ID NO: 20988 - DNA, 566 bp, Oryza sativa
aatatcagcttcttcaacatgggatgattctaaagcactattcgaagatagccaagagtacaagtaagggcaatcctctgaaaattactgtattgtgacaaatgtttaccatgcctcctggttatactaaactggttggtgtactggctttgccagctggaaggaagttagttccgtaaataggatacttgtgttcaacctggtggtaaataggatacgtgggttcaatcttgcaattttgtggggggaagcaatcagaattggtagatccatgtatttcaaggtgtcgtttagatgacgctgaagccacaaggcaaggcctaagaaacctggtctgcgggacgagcccacattccacgtcgtcgtgacgcatcatagatcgtggatgggtcgttgcctgatcatcgtcccgggcgtcaattggtcgctgcttggtctatgaagtctccatggcgttgcctcagccattagatggggaacaaactgaagaggggagggagtggacaagacagaaatggatgggggcgtcaattggtcgctgcttggtctatgaagtctccatggcg

SEQ ID NO: 20989 - DNA, 1111 bp, Oryza sativa
gtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggacatctggggtt

SEQ ID NO: 20990 - DNA, 600 bp, Oryza sativa
atcctttactttgggtgtgtttagttcacgccaaaattagaagtttggttgaaattggaacgatctgatggaaaagtgggaagtttgaagaaataatgtggaactaaactcgggctttatcagactgttgttttcttaagcttgctgacagttgatcgtgtgcaccattttttttttgctacccacgtgattcgttggagctagctttcttgacattctgtgatggcatcatatttagctggtgcgtgctgggtggtcaatctgcacaacttgcccaaaaactgaacctgtctttgcatgacttggtggtgatctgaaacaagcggtgaggctcattcatactagtacaacacagtgagagtatatgactagacatcattgtttttggcgaaaaacgcgccaacgccatacattctttgtagcttgatggcatagctctggcattgagctacgtaattgtgttttgacttggctgttgatgcggcgttgacccctgttggacatgtgaacttggctgtgcataatgtgcaattaacatgtggtacatgaacaagcccggatgagggagaggcaagctcactaatggtttatatctgtcag

SEQ ID NO: 20991 - DNA, 712 bp, Oryza sativa
aatcgtgtcgttaatgccgaaacaatctgtgagaatgaatcgcgtcattaatgccgaaccaatctccatccgttgcgctgttggtgttgtccgccgacatggtgaggatcgcagccatgcataatccaagaaaagagcagtcgcatggaagaacgctgcccaaaaacatgattgcccgcctacccatgctagcagcgcagtaacagaaggaggtaactagcgacgggaggagaggcatagagaggagacccgagaggactgactggcgaccggagagaggtagagtctctaccgagagtaacgatcgctcgggaattaatcgcgtcgttaatgccgaatcaatcttagggaattaatagcgtcgatgatgccgaatcaatctccgtttgttacagaacatgagagagagagagagagagagcaccaatatgagcagcctgcctcgtcacgggcacgggccgaccggacggtgctcgctcgcatgtggcagtgcgcccactatctgaatccggcaatagggactctcctctagttatctgttgaagttgagatctctccacttgaatttccgacgtggatttattaccctcaacatctaatgccggcctatggaatgcaatagaatcatagtcgtcctagagcattgatgacaacagtccctgtcttgaaggtgtctggagaaggtgatgatgatcaagtaccccgtgcgcaa

SEQ ID NO: 20992 - DNA, 581 bp, Oryza sativa
caaaaggaggtatggcaaatggcataattctggttctcattcgactaacgactgcaaagttttcaagcagcaaatccaggtggccattgagggaggaaagatcaagttcgatgatttgaagaagccgatgaaggtcgatggtaatcctttctttgttaacatggtacacacttctgggaggacagccgataggggaaaaaatctaaatttccggatgaattcggctagagttattaacaaatatcagaggaagcatgataagcagtaggaaaagtattatgaagaagatgatggtggttttgatcatcattgggattgtgaatttttcagattttgctggaatgaaggtatgaggctaccgtcgattgaggattgtcctggatgcagcaatgatgcagggagttctagccgatcctatatagaggcaatcggctgagtcagaaaagggtacctattcatcagaggttgggcccggtaaattaagattatcaccataatgaagatgatgataggaatacacaatggtgtcctacaagtattttcaccaagaatcagaagagaagggttcaaaggatgaggaa

SEQ ID NO: 20993 - DNA, 701 bp, Oryza sativa
gtgaccctatagaatactcaagcttttaatgaggttagctctttgttgtacgagctagaatctgtcttagcaattacatggaatgtgaaagtcttctattgcatcgctttattcttcactgagtggttcactgaagccaggcctatttgtttttgcagtatctaaaccagaggaaaaagcttgaagcagaagaaagacgtatcaaacagcggaaggcacgtgatgattttttagctatgctagaagtaagatatctaactcatgttatgtcccttactaatactcatttgtcttgactatactgactattttactttctgctatgtgttttaggaatctaaggagcttacttcatcaacaagatggaggtatgcgccactgacttcaagcttctattcatacataataacagtcctgtgatagttcgatgcaattttgtttaccaaactgttagtttctagttgctgtttacattgtaactttttgtgggggtgctggaggatgccttatgtttgttcgtgttcaatgttatgcagtaaagcaataactatgtttgaggatgatgaacggtttagtgctgttgagcgtccaagggagcgtgaagacttatttgagagctatcttatggaactacagagaaggttctgtcttatagacattccgttccccttttaaattttaattggtgttgggcttatctg

SEQ ID NO: 20994 - DNA, 5359 bp, Oryza sativa
ctaagtcatatcaccattaaggctaaaatgacgaagaaaataatgattgacgatatttagattttttccttaattacatcaccattgggcagaaataattaaggaaataacaatcttaatgaaatcacctttctttctagataaacttcccgttggttccattaatctagaaataatttactcagtattgcaactgataataagcattgataattgcatataattagtttaccatggcttaatcaatcatatgcaaaataaacttagaatttcatagtcaaagcaccattggtcataaataattatgaataatcttaaaattaattccttaattatatcaccattgggtagaaataagaaaggaacaaaattataattgacatgcaattataataacgtgggttaaatataacttcacatcttaatgctttctaatcgaatttctcgttggttccattcgactataaataattaagttaataaggaaatgaccatcatagtgatgttgacatgaaatcataatatactttctagttgaattcccattcaactagaaataaattaaatggcttaaagaaataataatcttaataaatattgacatgaaatcatattaacgttggtcaaatataatatcatatcattaatttctttctagctaaacttcccgttggttccatttaactagaaataattttctaagtgttcaaataattgaccataattttccagcaattttaaatggctaagaaagttcataaatgaatttttggaaataaataaaacataaatggcgggcttaaaaaataataatgtggcccaccacttcctaagccggccaaaaatcgtgccggccatcttacggtcaatgataattttacatcattatttctttctggctaaacttctcgttggttccatttaaccagaaataatttacttattaatcaaataacattttcagccatttaatttagctaataaaatggtaaggcaagatgcacatttgtatatatctcgggagtaagtaatcaaagggtattgagcatagccagtcgtcaaatcttaattttgtgacaagctcacaagctgagaggtgtgaacaggggaggacaccatgccgtagatcttcactgtccatgtggtgttaagtcggtagtactgggtcagttgtttaattagcgtattgattaaaatgacttgatgtcccatgtaaataggttagtgctttaatttgtaagatcatgagacatactcctatgcgagaacataataccagtttattagtttgtgtattcatcttgtttatgtgagcttgaggcctgcataagttgcagtcctatttccaacagataggagcctattatctcgaaagggtgagtgttatatatttaatctaatttcctattaaaaatagccctaattaaagggtccttttcttttcggggcaaaaccacttgaatatctacccttgcgattttgtcagtgacccgtgcttgtcaactgatggataggcacatccttaaaaagatatgatgcacgtaatttttttttatgacggcatatcacatacatacacaaaatcaaacaatcattcatgaaggttctgaaccgtgtgtgaatgctattcagggtcttttaactatatcgacaaaattcgcctcatacctccatatctccatgtacaaaatcttaaatggccaccctttagttgtaataaattagtgcgatcatggtttccaaataggagtatttcattgcaaccaacaaccggaggacggaggtgattgctagcaagaccattacaagaagcagctgaagatacatatacagctgtttgggatatggtagtcagtcctacacaagtgccagttcaagatgttcgcaaatgccagtcctacacttgcaactcaacaatctgcatttctggcaatgtggcataaatatctcaagctacgcatgaaaggcgtccggagttggagggcctcattttctcaccggctagtcaggggaatatacaggtaatgtgctgcatgacatgctgagcaagcagcgttctccatgtaccgtgccttttgatatcttcagcgcaacgcgcccgtggtgaacaatgcatctacttgcttcgtgtcttgcttcgtggttctaactgatctcgactggctgaatggaggctgcattgcatcaacgaatcacatctgggtgcctgcatgaaaaacaatatgatcagaagttcagaacctcgctatttcatccatatgcccaagctggctcacaaggcctaggtttgtgagattttttttatcatttttttaacacagaaaataattaagatcatgcgtatctaaaaataaccaagtctaaacttgatattgagagaaagtaatagattcctcgagaagaaatctgaaataaaaaaattaaattgtacagtgaaatttgtttttccagcttcaacttacacatataaaatctcatgtatccagctaaaattttgtgaaaattatagttgatttgtcgtacctatgctgcaaatagcctttttggggaaaaagcataccatttcttagaaaatgatcaatgggttaagaactcctaatttaacttcatatgcatattttcttttaagatgaaaatgcactaaatcatatggcttttatctctattgactcttccgacaaacagaaggcgaattaaatggatggatgtgtatttgttccacattcatttgcaaataataccaaaggtccaagcttattccaataaaaaaaaaaagctccaagcttattgaaggcggagaaatagttggtgtaaggacttatttttctttgtatcttttctaagagaaaacataactgaataattagtcatggtaggtagcgaccatacaatgccactttgccactttgcttctctccagtcttccaacaagcactgacatactacattgtgtgtttaagatagtccaatcaataggtgttcctctatatatatataggaagaattgaggtaattgtcacactatataatagtgtacactcatgttgccagacaaaaccagcagctaggaaagaacagcccagattgctagcaaaaccgtgtgccatcggaatagtcaacgaaattaagcagggtatagtatattaccagaggggtgcaatattggaaggcatcaagaaatcgtgaatttttggactggtgttaaagatgatataatgtgccggttggtgaaatggtctgctttggctagaccaaaagattatatatggagatttgggtttagtagcgtccagcaaaatgaatatttttcaccaagctaaatggacaatggacaatgaaactcttgaagctttaggattccagctcttgcttagagatagtaagcatagagtatatgttagagagaggttttttctttagacaggtaatggtagagtttctcagtttcagaaaggattacatgctatgaaagagtggctttggcgagaattacagttgtttgtggggaaatgggggagttacattctttttaggcatggtatctggagagatatttgtcctatcaaattcctctgttgtaaactcctccaaataagtaatgaacataagatccttgtaggtgaggtacacttgagaggtgctaaggcctatcctggtagagatagctctgctagactttaacaaaaagtaaaatcttattcaaccaaaccactttagatcttgttcggttaatccttttacaagagaattgaagatgatttgaaggggattaattcaatacctattgtggtttagaattatccctcaatccccttcaattcctctcttttgagaatttatcgaataagaccttatatatgtctgactttctagggaatagctgatgatgatacgggatgtttggaagccccaaacatttaaaattaaacacttcctagcttggtatgatagagtccagtctgttgtacaataggtcaagataaactgaagagggggaatcacatatgtaaactttgtggtatgcctgaggatgctgaacacattctcttttaaggcccttctgctgtcattatgttgtgcttttctagatatgttcctggcggatgagactcccctgtagaatcgaatagcaagaactaagctaaccaaagggggtgaatggttggtatacccaaaaaccaaaaacttttagctgaaataaaagttactctcgaaatcgatggagatcggtctgaccagagtagattagccggtctgaccgaagcgtagccgccggtctgaccggtgtagatctcccggtttgaccgccctggaattcctgccgcgcctgttgccgccgccgctggtctgaccacccgtatgccatcggtctgaccgccgcgtgccgccggtctgaccaccggtatatcgccggttagaccgctgagacccggtgaaacacaaatcgaagaactcttaaagtggatgacgactttattgattctctctgtgtttacaaagtgcaccaactgcactccttacaaaaatttcgactaaactcaaaaccctaactcaaaactcaactcaaatactctcaaaagcgatacaaaagtgataccgggaagcctcacgctccccctctatttatatcctgaggtaggcagcctaaaggcacgaaccaaacccatactacgagtcctaaacaccttaggaaaccctctagtataagaaagaaactttacataaccaatcgtaccaagtttggactccttccaaattcgactccgcatcccatacgcacacaataactccatcgtatgccatatggaatctctatcaaccacgtgcatcaactctagcctaagtatcccgcatgatctctgaccaccacagacgtcgtcttatccccaagccgactcccggtccatcaccgcaaatactctcccgaggcatcgagtcacctacacatgaaataaacaaagaaaccatattccgagaccaagctatctccaacttgactcattagtagcaaacaacagtattacatacgtatagtatccatctagaagccataatcatgaaataatcacggatatccaaacaaacaacccgaaaccgaaaccgacacagagtcggccggtcagaccgtgggctagccggtccgactgctcgatcaccgccagtctgaccggcaacacctgcccggtctgaccggtcacatgaaataacagcgatttcctgtagattcacctgtgaactccaatcatctccaaaaccacttcgtgaataaattccaaataacaaaactaataatctccaatgcccaattattcatcacagaataataatcaaaaatacctttgattttacatccctaacg

SEQ ID NO: 20995 - DNA, 13768 bp, Oryza sativa
tgaccatgtcgtatgcgcgtactgaccatgacaggccccctggcttgcacactagaatctgactgatgtgtccatcgccaacgattgcagcgacaaggcttggcaagcacaggatcagcttgcttatgtgcagatgctctgagccgcggatatgcatccatgtgacagggtatgcagtgccttgttgatcgtacttagcaactgcatttggtggacggaggcggacgctggacagggcaaggagcgtcacggtggcgccggtgaagggattcaccaagaagcagccgtcgtcgcgcgggaagacgagccgtctgccgcaggtggccttgtagccagcgaagccgaagccggggaagcggaagggctcgtcgtagggggggctgtagaaggtgccgtccgggagcgcgagcagcggcagcggcggcggcggggggaggggccgctgccgcgcggtggcgcgccactgcgggcacaccgcggcgaagcgcgcgcggtcggcgtgcgcggggaggaggcggagcaccaggccggcgatgtccgccggtatgtccgaccacgacttcggcctccgtggcgtcggctcgtccgccatcgacgaccttgcaaagaaacacaaggaaaaggaaacacgacaacgttgcatcagccgacgcagccgaagaagggaagcacgccaagaaaaccgaaacgcgccacactcacgcaggcagaggcaaaacgtcgaacagcttgcgtgcgcgaccacctataggcggaggatagcaggaggaagagcaaggagcaaggagagggaagcggcgggagtaagtagaggagatggaagaggtggataccgcagtagatcgatggatttgcgatcgcgcgggcggccggagagacgaaatcgttagactgctgcctgctggtgtggtgagagccggagaggcggagacagttgacgagaacgagaggaggcagagtgagcctcagcaggcaaaaccagttcagctggttggcagcacttttactagcaaaaccctttttttagtctatttttttcccattatctttctattcaattattgcgaagagtgaatcagtgaaatacatggccggtccttaaacttgtggtgtggtgttactttggtccgtgaacttgaaaattacatgtttagatccgtgaacttggtttaatgtaccacccccgatccaatcgtcatttgaccacgtttgaccgccacgtaggcaacactttgcgctcagcccccttcacatataccttcgcacataacttgccctgaactcaacctcatggattagcggcgggaggcagcgcaatacgttttcactcaacgtagacgcatttgcactctccacccctatgcactcaacgtatgatggatgtctatgcttattatatattaagcatgattcgttcgttacatttgtttaataattgcactagtttattccctactaaagttatgattattatcttgataatttggattagaatatgccgaattgtgaccatatttccaacagggacgagcttggagaatccatgaggatgcctagtgtgcaagacgcattgcgctgcctcccgccgctaatctggccgcactgtgcaacctctatctgacctatctgacctcaatcgttggatttttctttccagctggttttctacctcagccttatagatcttaaagtaatgcagtgcttcatcctttgttttcaataagtacacaaagcaaaatctagtgcaatcatctatcagtatcatgaaatatttctttccccctttagtcaacacactgttcattttgcatagatcggaatgaacaagttctagaggagccaaattcctcgcctcagatgcactgtgaggcttgcgaggttgtttcgattgaaaacaggtatgacacttggaacctttaactaaagcaaattttggaattaaactcatgttggctaagcgcgtcatacaaccaaaattcacatgacagagtcgcgaatgccacacatttgactcgtcatcattgcttacatggtccaaagaaaagcggaacaagcctccgctatcataacattttctaataaacgttccatatttagatacaacacatttattggattcaaacacaaatctaaaatcatgtctacacagtagagagccgctaactagattcttctttattgaagggacatgctgcacgtttttcagctgcacggtctttcccgaagtaaactttagatcgaccgtaccaacaccaagaacagccgcaagcgacccattttccatcaacaaggaggaacctctcccgacttgataagaagaaaacaaggaaatgtcagcacacacatgaatattaacaccagtgttaacccaccaatcaggtgagtgacaaataggaagaactgtaggtaaaaatttaccataccccgatgttcctccgcccttgctaatgaccatgtttgcagactttctgtctttgcgcttaggacagtccttggcccaatgcccaggcttgccacacacaaagcagtcacccttagcctttcccttgcctttcttcttaaaagtagttgtagccttgggtttgacatcaggcttgactttcttgttgttatgggatgcttgagggtttttcttctataccaaattggtactagaactcccctccacctttttgccgcggttgtcctttgccctcgccttctcctcaacacccaaagagcctatgagatcagtgacactgagctcttgcctctgtgttttagagaagtagcaaagtcggaccaaaaaggtggcaatttggctatgatacctcccgccacgaacatgtctggcaactcatagcggttgttctcaagttcctttgccagcatctgtatctcatgagcttgttccactacagatcgatcatcgaccatcttgtagtcatagaactgctccatgacatacagctcactgccagcatcagaaaccccgaatttcgcctcaagtgcatcccacatttccttcctgaaggcatgtgcatgtacacgtccactatgttgtcgatgagcacactgatcaatgctccacggaatatgcaatccgcagcctcgaacttggcctcctcctcaggagagagaggcggtttactcagtttgccccgtgaaacaaagaaacattgcatcgctgtcaaccatagtagtgcacgtgctttccatctcttatagtttgaaccatcgaaagcgtgcggtttcagtgatgcggcaaatccaactaccgaaaaggacctatcaggtttttggattgttggaaatatggtcacaattcagcatattttaatccaaattatcaagataataatcatgactttaacagggaataaactagtgcaattgttaaacaaatgtaacgaacgaatcatgcttaatatataataagcatagacatccatcatacagcaatgcattgaaaacattgcgctaaacagaaacacaataagaattaacgcagtaaacaatagtatagagagattatacccagagaatggccctccgctggattgtgaggcataattgtctccgttgatgaagcctccagtaccatcctgtctagccgtacccttcccatccgcgcgcgttggtgttgtccgccgacatggtgaggatcgcaaccgtgcaaaatccaagaaaagagcagtcgcgttgaagaacgctcccaaaaacatgattgcccgcctacccgtgctagcagcgcaagaacagaaggaggtaaccagcgacaggaagagaggcacagagaggagacccgagaggactgattggcgatgggagagaggcagagtatttcccgagagtaacgttcgctcgggaattaatcgtgtcgttaatgccgaaacaatctctgtgaattaatcgcgtcattaatgccgaaccaatctccatccgttgcgctgttggtgttgtccgccgacatggtgaggatcgcagccatgcagaatccaagaaaagagcagtcgcatggaagaacgctccccaaaaacatgattgcccgcctacccatgctagcagcgcagtaacagaaggaggtaactagcgacgggaggagaggcatagagaggagacccgagaggactgactggcgacgggagagaggtagagtctctcccgagagtaacgttcgctcgggaattaatcgtgtcgttaatgccgaatcaatcttcgggaattaatagcgtcgttaatgccgaatcaatctccgtttgttacaaaacatgagagagagagagagagagagcagcagcagcagcagcctgcctcgccacggccacgggccgaccggccggcgcgcgcgcgcatgtggcagtccgcccactatctcaaccggtcaatagggactctcctctagttctctttttaagttgagatctctccacttaaattcccgacgtggttttattacctctaacattaattgtgggcctatggaatttaattgaattatattgggcctagaccatttattccaacagtccctgtcttgaagttgtcggaagaaggtgttgttgatcaagtacccgttgcgcaaggataaggttattttggagcgcagagcaatggcaattgctaatccggaccgcattttctatacatgcaaggagaagaatgagaaggaagaacgattttaaggattttttttggggggattctggtgtcactatatagctacaaggagatatatgcgacgtgttgtgatgtggagggggctgagagcaaaaatgttgtctacataggtggcatgccacgttggcggtcaaacgcagacaaaggacatttggaccaggtgtagcatcctaaaaaattacaattttctagttatgcatcatgtcggttcttatgttcttattaacatcctaaacctaggaaaatataattaaagagacctcctaaaactaacttgcttaaaacttcttcgtttatttaattccttttatgacttttattaaaaacctatcttgagatatttcttgatttgatttcaaactttcttttgctaaatctttctttatttaaatatagtttgaaaacccctttttacttttatgaattatggtccaagaaaccttcccatattcccctagaacataaaccaaagcaattccaattttattggaattaagtgtcaacccatcctttgatcttaaacctcaattcaaatatccaaatccttacttttgacctagccactgatttaaatcctgtggctataatacccttctcggcgcaagaataatattatgaataattgctcttgtgctaagaaaataggtttcatctttttatccaaaatccaagttccctattagcctcaaatacatctccaaaatccttgccaaataatttgaggctaacatcctatttatttcccctccatattcttcccacatttccaaaaatatatccaaatttaggagtcctattattcctagtgcagaaatacccctacttcttatttgagtacttccaaataaattccctcaaactccacttctaaaaatattgcactcaaataaaatagaagatctttattttggaattcacatataaactccctccaaatataaccccatctatcaattctactcaatctgggccgaagtaccttcacctaggcccaagtcagaaaatctaatttccctccctctctctgtgggcgcatttggcgcccaggctacggccgccgccgcccacagtcctgccgccgtcgccagccaatcaccgaacgaggccggcgccgttctcttcgcctccactccaccgacgccgtgccttgccttcctcctccaatcttacggcagccaccacgtatgcgcgccgcccttttcgtccaatgggagaacgaagccgacgccgtattcctcttcctcacgccactgtcgccgtgccttcctcgtcttccaccggcgaaccgaccttcatgaaccgacgtccacctcttttcgccatccgagccttgagctcttcttcttctctctctcctcccatgtccggccgtcgccgccgacggtcgatctcctccctcgtagcttctctatcctttcccttgcgccactatgatggcgaatccattttacccctttaccccttcccttccaccttgagttaagccaccaccgccacctcccaaaccggccggggctaagctcttgccgctgctgttccggccatccctctcttcctctctaccaaccaccgacctccccgagtgcgcgtcgaccgggaacacaatatgccgccgacgtcgccacactttggccactggaagcccggcgccccgctcaccctctcctctctcttctctcggctcactgtgaggcagaggaagaagagaacgaaggaagaagaaagagagaaagaaaaataaaagaaaaggatattccctgacaggtgggcccctatacagtaccctttcatattttctagatttaattcaaatcctattatttagaagcccatatctcctaaatcatagatccgatttcagtgaaacttggacctaaattcatctaaattcaaaatctacattttgataccaaatttgctattttaatattttatttgaatttacttaatttattcaaataccatttgaataaatatttgatttaatcttataattgaatttacaatttaaacttacatttgcttttcaaatattttattttatttccaaaataccctttagccactaaaaagttgccggttggaactttacgccttacatggggacgttcgtgcggtctaccgaccccaacgtcggaccgttggttgtaaagcccagcaaaaccaaacctaaggtcgaagtgctgctcctggcaccccacgcctcgatgcatatagtggtcggagcttcactattccctcgacctccacagcacgccgcacagttagctctcgggctctatgtgatcctagccgctccaccgccactcacggttgttggagtaacacttccgcccccactaatcttacaccaacctcctattcctctagccgatatgttgtctgtcgacaccggctagagaagacaccaaatctagtcgttatgctgccaactctagcaacgactagcaaacaaccaaaccctagccgataccttcttagttaaattccagccatcatccaaattccatatcctctacaatattacctatccaccatattctccgccacctactctccacctaccagaacctatatataaactatagagcctaaccgatgcgctatcctattccacaattggctctaagatataactaaaccccagctattatattacctaaacctaccgccatcaaatactagctagccacatactcgcttaaccaagacaactatccaaactagctacttcccatccttccaaccaatcaaagccttcacataaaatataagcaaccttagttgcctgatcccttctccaccttagcctccaacccttcagaacctccaaatgaaatagtagcccaataatcctaataccctataaaagagataggctataccctaaaccctagccctcctaatcgtttaccgctttcttgctattttatggcttttattgaatttggttcttcctcttcttcagtagagtctattatatttggatggcaacctgtggtatttcgagcatcggataatcaggttgcctatctcggatttatttgcgttggagcaaggtaagttattattcctcctcttgagcataattatcctataatctatatctctattctatgcattagccattcatgattttaaatgcataacctgaacatatagcaaaccagatatgctagcttttgcttagccatgcctagttagattgcataaaatataatgaacttagattgaaacaatacggtagaagtggttgatttccgggtggctagtactgttccaaccgatataagactgccaagtacatgtgaagaacatacgagtacgaccgcaattctcgtatgggcatagacctagctgattaagttatctagcaaaggtgatacctctgtatagtggttcttcttaagtcctcgcgcaggaggcaattctatgccgagcagggcaattatgatatttaccgaggcacaggtaaatatacttatattgatagtccaggggactatgttatggccatgtgattttgtgaaccctgattgcgatgacatggtgtcatacaatcagttctctctaaagacctcgggaacgccagaactcctcacactgctgacaacgttacgttcagagcgcatggggactagagttcatggaacaggtaccactaatgttaataactgaaaagctttgccatgacaaggctaatgtgtttggcacgtcatgggttgcgggtaaagcgtacatttactgcagtaaagtataaatgaatctattcgaatagccgtgctcacggatttgagcattgggactcatatagtatttggttagaaacttaattccaaactttattaaatactgttgtattaaaatcattacaggctttctacttatatattctctgctttctgcaactaatcatagccctactcaaatattaccatttcatacattcattattgaatataatagcttgctgagtacgttgtactcacccttgcttcaacccccttttcacagtcaatttggagttcttactgaagctgggagttcaatcacataaattagttcccttttaacctagtcttcaaatcagattatttagatggtttaagtctataacaaaacagcaaagttaggccattctaaaacttctgttgtaatagttagccataatcttgtaaataccctattactttatataataatatctctttcaaagatatgtctaaacgtatgcaaagacgatccagattattgaacttgtatcaatctactgattcagggcttgatacagttttaatatgtcggttaccgaatcattagttttgggacccggcaccggggtggtacattaaactaagttcacggatctaaacgtgtaattttcaagttcacggacctaagtgacaccaccacacaagtttaagaaccggccatgtattttaatctattgggaagaacgagcccatttggtagttcggttttcccctggcttctcaagctatagctcaagcatgattcattaacaatttgctttttaaaaaaaattattttgcaaataaatgctccctcggtttcatattataagtcgtttgagtttgactaagtttatataataatttaacaacatctaaaatatgaaattagtttaattaaatctaacattgaatatagtttcataatatgtttgttttgtgtcgaaaataccactatatttttctatttttctataaagttggtcaaatttaaaaaaaattgactaaaaaagttaaacatacaatatgaaacagaaacggaaggagtgatgttcaatgtctcggtgccaacgacagagtcgaaacttgttatccttagcatacttcttttcttctaaagtgaccgatggtatcgatggggtgacaccaatatcatttgctatgaggttcgacgtcaactattattggtgttgactgttgagctcccgcacctatcatttaatctgagagaatgtgttctacctcgatctcacattttatccaaaagaacgaaacaaattataggaatgtaaagagggaagggagtagctatatttacggcactatatttttcaccaaaaaatagtcagcatgtatttacattgtaagtccctaaattacatatgtaaatttagtatatttataatgtaagttttaaaattacatatgtaagtcccaaaattacatagtaattacatgtttaagtagtgtataagtgagatgtaagtggagtgtaaatttgtataaagtatagtatgcatgcgtgtaaaaccttgaactaatgaagatgttaagctttaattaatcgtgttgcactactaaaaaaatacccattagtgccagttcttaatgcctaaaaggtgctggttttgcggccgacactttttggtcggcacctatgatcgaagtcattggcacctataatataatagctgccggatatacccctagaaccgagactcatatggtactataggtgcccggttctgtgaataaccggcacctattccgatgaacgaggcaaggaaaaaattccccagccaagccgatcaggagcaagcactgtagagcgtgataatatccatcaaaaattcattacatacaatccctaaatccatgaaagatccaccatccaactatattttagaatcaaaattgacaaaaaggaaaattcacagaacataagtatttggtccagaaaaatcgaccaaaaaaattcaaaggaaaatgtagtctgcaattagactttgtatcttaagtcccaattttttccaggaacatccaccaacctgctcgatgtaggggatgacgatgtcgtcgatgagcttgaaaattgcaacaggcagtccacctcccatccgacgagatgcacccgcaccatcgtcttcctctcgctgtccacctgcacacacgcatcatcacatgcccaaatcagtaaccatcacagcaagaacacgcaacagattgacaaggcctccgagctcagcacctcggcggcggaggcgcccaaccctgcagctgcggcgccatcagagggaggagctcgccgcctgcttcacgccgccggccgctggtgccggatccacagcggaaaccaccgctgccgccggatcccacgccgtcaccgccgaatgcgccgccgcaacccgtcgcccccgcctcccgcctcctgactcccgcctcccctcccgccggatccggcggaggggagggcgccgccgccgcccgcagcttcccatctcaccgccgcttacgtcgcctctgccgggatgccgcccgaccgccgccgcgcaagagacgagaagcagagaggaggcgagagaagacgagagagagaggcgagactcgagagagagataaggccgatagagagagagccgagactcggcgataagtttgactcgacggtctggatcggctcggctcggtttggaaaggtgccggtttttttaaaaaaccgacacctataatttattattggtgtcggttctacagaagacccggcacctatatataggtgtcggttttttatttagaaaaccggcacctatattatattaaagttgtttttttaataaaccggtacttatgttataggtgtcggttttttattagaaccggcccctataattgtttaaaggtgtcggttttatgtgttttcagtccacggaggagagaaaaatattataggtgccggttttaactgttccggcacctatagtgccgatctctatgagcttttttttagtagtgttggcagtcgcaacgttaggctgccatggcaatatgcacggccaagatcgcattggcacgggacaaacgaaatcggacgcttcaaaacgccgactgtgatggaggagaaaatgtgtttgcgattccaaagagggaatattgcttcggtcaattttcactatgaaatccaactctaatccctacttaaagcggactatataaggtgaaattattattatctacacctacatatatgcatgcatgcgatttaaatagtgatataaaatttaacaagatgaattatgatgatgaacaccagacaaacctaagtctaaattcgatcctacaccttgccgttatataaggcgatcgatcccctgcatcccataaaaacctactggggcttttgcctcagccctactcaacataatcgtgtagatgtaacacacttttgcgaaaacgctttgtgttgggcgtccgatctggagagaaaaatcagatgcccacacacccacaccactcttctctcaaccttatctcttccccaaccccccctccctctctctctcacatgtcactctccccctgtacttgagcgaggcggagacgaggtggagcgcggcggacgggtcgccggagtcgagggaggcagccgcggcgtggaggcggtggaggggagagcggcgcaaggccgcgcgtagggagcccggcaccgggtacgccgcgatggctgcgcggaggggcgaggctgagttcaccgacgcgcggggtcctcccagcggcgtggcggagaggaggatgagcagagtgagcaccgccgccacggaggctacggggaggaggcggcgccggcggagttcctagtcgtcgtggtggccgtggccgagggagcgtagctgttgatgcgaaaaacacacactggcttgggagatctgcttaactccagtgcatatccaaagattgatgagatgtgggcgtgccagtcagtttgatcctgcaactgacaagatatgtaaactgtagatcaaatagccgatcggctaaacagccgatagagcaatcccagccgatagcgatagggttttgagctatcggctatatgtccaatgtaaataatgatataaagtcaatcggctgataataatataatataacaatatcataatccaatagaaatcaatcggctagcaatgatatgatagaataagcacttatccgaaggttaaagcatacatcggctagaggtccgatgccataaaatccacagattagattaaacagtgaaacctttgttgtcatcggctaaatccaacttatatatatatatacgtaatccttataagccgatgcaacgtccagatatcttatcggctagcaccccgataaaacattagcatgaacctatcggcttaacaagacttatattatcaacaacaatctagtaggtcgaacctaaccgatacagcacgagattgtatatgataatctaatacccttaatgtgatggatataacaaatctatctagaacgacattgtgattgtagagatatatcggctatgatagaagatcagacttaaccgagacagttccagctaaaccgatgcatctctaaacacaatgtaattaaagatagaatcgagatatcaggtaggcaaatcaatcaaccaaaccagagcgatccaagagattgaagcgatgcagccttaaacgacgccaacgtagatgacagattcaccagagcccggcggaacgtaggacttaccctttcgccggagatcgaaagccgatgcagccccgcgtcaggtgcccaaatcccaccggttgataagtaaaaaccttaggaaagagggtggcgatgcaccgagagtagttgtattgatcgagattgatagattacagggacccctggtacacaatttatacccttgggcctatagagtccttgtcggacaagaaacaaactttctaaaagataaaacagaaacataaagtccttatcagacacactttcctaaagataaaaggaaactaataaactattcctaattaatagatacaattgccttcttcggactcaatccgcacgtggcaatcctcatgaagcactttaaacgaacccaacaatggttccaacatccccttgtcggaatcggctacatcggcttccttgtccaattcaatattagccgatgcacaccgtatccgatgcagttccgaagccgatttatactctgtttttgttgcccgatttccttccaaatccgcttcggtcttaactccaaatccaatgtatgatttaccaaatttggtcgttaacagcagcattccggcaccgttgaagatttggccaccggggtggaggaa

SEQ ID NO: 20996 - DNA, 15109 bp, Oryza sativa
caacatgtgcaggattaatatcatgtttttcaaccttgctaataagttgcgatggtttagtaactcaaaatatgatcaaaattttgtatgctattctcaacaaatacaccaagaataaagcttacaatcagcgtgagttgtaacatctcttattgcataaagaatggtattacaaagttacccatcttctcttttctctcaagctcttccttttcagcaatctgtttcagcgtagtccacccctttcttgcccgcttccttgaactaccagacatctgagcagaaccacttgctacagatttatttttcacacggtcctttggagctgacttggtaggcattgtaggggccttgccagtaactgaacttggcatctcccctttcttgttctgaatgcttcttgtcttgaccagttctgcagaatccttatggtccgtcacatccaccagtttgttctttcgaggagtaacaaaacttgatccgactggaaattctgcttttgaaggaaaatcgggttggcatattgcaattttgttagcagaaacaggctcagtttcatgcatacctttttcacttgtgattgttaccactattttctgtgagacattctcctgatcagtagctgatgctgactgattcagttccaccgatgaacacgctacctccttttccatagattcgtcaagaagattgggtactggactttcctcatactcattcttttcaagattttgttgtttcaacccagatgttgactctagttgtgagaccgctgcctgagaatattcaaagccctcttttatagttactaatctcttgttattactgtcccctttcaactttatgctggttacatccatgccaactggctttcttgatgataacaagcccttcataatattctttccgctgccccttattaggttttggtctccacagaaatggcacaggtaagaaatgctgttctggcaagtgtttaacttcttgcgtcgctttgcttttcttttgttgttctttatgcggattgtgcagttgaagcctggctgtaagactgtttcacacctgcaaaagtttggagaatgtttcttcagaagtcctatagagatattgctctcttctacagtagtaatgcttatgatccagacaaatggatacgcgcagtagaaaaaaaaaacataactaggaaactgaactacaaagtactcattataagatgttttgggttttgaatagattcatgcatggatccatgtatgtgattcatatgtgtccaaattgataaggatgttagtgaatctagatgaagaatggagaggccaaaacatcttatagtgtggaactgagggggtacatagtatgtcaaaatgttttgtagtcgctttaacatggctactttagtgctcacatcatactatagatgtattaatcataattatgggttgacttccaagatttagaacaaacacatggcaattactatgctgttatttgttcaagctttgcttcagccatacaacattatcaggatgactactcatttcaatttcttataggcaaaatttgctacaagacacttaaagtctgtggcctttactgtgagacactcaaagaatatgtatcttctcgtggacactgcaaaaatgtggtaattagctgttggacacccgagacattattttattattttcggtggagacggagagagaaacattggttaaagacaagtttgcctatgggcccacttgtcaatctcacatatcctctctttctcctttcctcttcttcctcatgctgctctgttgctgccactcatgcccctcgaactcgcatcatcatcgctgctctgcagaacaccatcttgtcgtcgttgcatggcatcccgacgccgctggcgatgcgtgacttcgggtgacgtcactgacatgtacctgtgggcgaacccatcgagagggcgggagttggaatttggaacgcgttatccatctgttgaggtggaggcggacatcgccgtgacgagttgccgggcgccgcgacgggtggtcgacttcccgctggtttggtgccgacttggcgcgtagcggcgtcgcggcacggccacaacgaggcactctactctatggcgatcatccagttcaaacagcattggcctccccaaggacagccgcaacctccaggccggcccaactctgcacacgcgctgcatcgtgcgggcagaacgacgtgctccgcgagctcggccactacgtctcggacggctacggcgtccgccactccctctcgggcgtacgacgcctcctcatctaggccaacctccgcgagctgtgcgccgcggtcgccacgggcgggacggggttcgtcgtggcgctcggccacaacggcgagtgcaagccaccgggcccgcacatgtgcctcctgagcgactacgggtgccatatcgccggcgtggcgaggcggctcgcgcacgcggcgaacacattcctggccgaattgttcgcgttgcggccgctagggttcggcgctagcgccggggcgctccgatgaagcaggaagaagaacagtactccgggggcatttcggtattttcaactctctttctctctgttttcaccggaaataataaaataatgtatcgggtgtccaacagctaattagcacatttttatagtgtccatgagaagatacacgttctttgagtgtctcacagcaaagaccacaaacaaactttgagtgtcctatagcaaaatttgcccttcttatatggtagcatcagtatacttaggggacaagatggaagaatagccacacacacatgcaagattgcaagaaatacttccttttagagtaaagagataattgtacatgcaactgtcagtgacacagtgttttgaatatgtgaccaatgaagtgctcattctcccaccaattctctgtacggatcaattttggactacaagattttctaaaaaagaaaaacacaatcatttgtttggacttagtgaacaaggttacagggtatgatgctctcatgaactagcagtttttaagccgtgtgaaacagtattgcaacaacagtggttgctgacagataacagaataaatataactgaaaaaaaaacaaaactacctagtgacttaatcagttcaagtcaatatgaactgttgttttgtgaatagaaggagatttacacaaatttggttagaacttgagtaatcaatcacaaagagagtttgagaatgatatgcacaatggatccaactaaataaatcatatgaataggttttgattttacaatatatctgtaaaataggtttcgattatttgctataaagaacttcaagacttggttatctgtatcccataaaactgatttatgaaatgtaccgatcgagtacattaaagctacagatcactctgtcattctcactgatagacaaatgattttaccaataaaaaaagcaagtgcaaaattatatgaatagctgaattaacacgacaacatagcatcaaaaggctgcttgatacttctatggtgcataggaaattaggaatataggataggacgatctgtttaacttttgggttctatagtatctagccggacaagtccttaaactggctaaaatgctgcttagcacaaaactactgcaatttcttagaggtatgaggaggattatgatactaataatatctgcaatggttggggggcagattggctccttcaatatcatgcaacaatttgaaagacgatgaaccacaaatgaggatctttcagtagaagaattgagcactttgccccacaacagacaggcaaattctgaaggacgcgagcatccgaccgaggtgtagtaagaagtaagcagtgaccctgacctctggcataggaaggtggaggcggccagaggtatcccggccgcctcggcgttggcggcgaggcgtcgccccagcagggcgccgagggggcccgccccggcctccccgcctgcccacgccgccagccgctgcaggtgctggaccctcagcagggaggccgcgtcagcgcgcgtcttcccggagctctcctcgcggagcgacaccgcctggttcccggccctgggcggcgccgccggggcatggccatggccgccgcgcttcttccccatgtagccgccaagccacaaccgcgaggaaggcaacggggcggggggcggggggcggagggcggcgggcggcggcgcgggagggagtaagcggaggcgaggaggcggcgacggcgagagtgtctgggtcgttgtgggccggttgggccacgccgccgcttaatttggactagcttcttttcgcctttcaggtttccagttcgagacttcgagggcatgttgatacataaaagaataagttcaccggaggtacctcaacttaattttttttaggtccttaaacacaaaaccagaaatcttcacccctaaactatacaaaaccatacactaaaggtcctatggcagtatatacagcgagatttttttaggtcccttaaatacaaaaccagaaatcttcaccctaaactatacaaaaccgtgcactaaaggtcctatggcagtatatatgggtggttctatggttcataaaagggtccataaaaggacatgggcagccaacagagcaaaagttggctctgtttcgtttgaatttatacttaaattcacgaattggtccataaaaggggagaaatcagaatcgcctgtcacctttgcagacgaggggacgccattgaagttagttgtcctctgttgtggctgggttttcttgttcagcatctactatgacatccgtgccctgttctggggtagatgagccagtaacttgggtggctggatcgacattttcattgactgcctctgctacttcacaattctccaacagcgcctgagctgacgtgctggatgagagcacattgttggaatcattgtgatccacatacataggttccaccattagttcaatctggcccatttagttaggattttccagatgtccatcttgatcaacactagtgctttgctgtgggattgcagagcctggagcaggagtggctgtatcacactcatcgatggctggtgtagctgagtgactgtgttcctccaactccagtgaaggacatgggcagatgacattgttgaaaccattatcctcctcatccataggctcgagggtcattgttgcatcatccaccatgtgaagctcttcctcttcctgatgctgagcttcttgatcggcatcaacaatgttctgttcagcttctagcaaaagtagaggcatgtcttgagcggcagctgattcaacatgtggactagtagcggaaccaccattttccttgatctcgccaaggtcatggagaacatcctgaaagccatgcagaaactcaaagaccaaggcttgtgtggttgtatcagctgtggatgtcatggccatcttggccttctttaccataccatgcagtttatcaacctacaacaatcagcagacccttcgagttaaatatattagttaaattatgcatggagtgattgtaaaactatttgaagtcttgcaaagacaacatatatctgacacaaatttaggtccaatcaactatagaaactgatcataggaactgaatagataatataggcttactgctttgcggatcataggagccttggcttgatactgaagatcaatggaatcatcaggctgtaatgaaggtcctgcttccacatcatcactgattgatggtacaagataccgccgtgtaactcctgagtaccaatgcaggtactcctcataagacgatgggtcatactgctctgactctggaaatatgcgctgccggcgggcttcccattcctgaatgtactcatgatgtgtctcttcccagttctcatgttctctgccacgtcgactaatacgatgcagcgcctgtagggtaggtcgaaaaggtggtggaatggattggcgaagcccaaattgccgcatcactcgctcaggcaaatacatctcgactatcggaaaatttattagtggagcttgtgtaagccacaaatctgcatcttttgtacaaagcaatggcaagcttgaagactcaatgtgcaagtagggttcccacttcacctgatcagctcgctgcaggttcagttcatccctgtactgcttaagacagcgtgtagcattctcactttgtgtgcgcgcacctacccaacgaaagccaacaggtggcacatcctgtggaatgtctgtctctgggcacaggggagaccggaccaatggtctgccaacatgggagcgctcccagctccaaagctgcaagagaagcaatgaaccaccaatattcttgatattgtgggaggaagcaacagaacaaagagaacggtataggaaggccagcactgcagatccccagctgtatgtcccaacacgagaaagatcagcaatcaatggaagatatatcagactcatccgtcctgttccatctggaaatagcaccccacataaaaggctcaggatatatgctcgaacatgcctctccacagtctgatcatctgctccttctggtaattcatagaaatgcttcttcagccatttgtagtgcagaaaagattttccaggcattgatggtcctcttggatcatgacctagacaatcaatgaccatctgcgcataatcatgatcagtggtagaacaaactggacggccatcgataggaagagctaacaacattgctacatcttgtagtgtaactgccatctccccagaagccaagtggaaactatgagtttctggtctccaacgctcaacaagggcagtgatcaatgccttgtccaattgaggcatcttctggcaaatttgtgagagcccaagaaggccagcatccctcaaataaggacggtatctctcatgaaattttaaaggtttgtgatgtcgcaacttcaactgctccacagcctgcaaaaaacatgacctcagtggcactgcgaagtttattctgcctacaataacttgtttacttatgcaactatgacaaaacttaattgctcttggattaacctgatcaccgaagattgcatccgatcggtggttgatcttagggttgagtaatgtgttggatacatgctctgctgctgggcttacaagacaaggttgctgcgaagtgaactcgatattgtcctctttatcagaagtagtgctcggggaagaaagtgcagaggtttcatgaaagtccatatcattttctgccaaagcacttctcccacggccacggccacgaccacggcggccaccacctcctctccttgaagacatggtcttgtactgttcctgttttgaaaaattcataagaccagtcagaggaaacagcacagacgttgacagtaaaaaaaacataaacatgtgttgagaagttagacaaggcttaagccctgaagtatgcaatgtgtgtgatcattttagtagcaggtccgaagttttaagaaatgcagaggggtctctccactaacctgatcgccaaaaaaaggagaaaaggggaaaaaaaaagaaaacatggctattcctctttatgactcgcttggaaaagagaaaattcacatgaatttgacaacaatcatttcaattcgagcgttccagacgagcctaatcgagtgaacttgctatattgatctaaacatttaatgatccacatacgcatgtgacaaaccaaaacacacagtggtttccatttttaacctaggattttccaggtgccaaccaatgaacagagatttgagatgagaatctatggaaaagatgacattatagaacggtacctgcacccgcgcccttgaggactaggcgcctggctctagcaaaatttgggttcgccaacggcgcgcccacggttacatcccccctgcccccctcccaccagtctggctcgccggcttgctacgcccgcggctcacccctccgccccgcgaccacggaaatccggcgggccggcggcggccgacggggagacaagctgtagatcttcgctttctgggaggggaagagtgagccctagaatctgctttcccggggaggaggcggcgaggcgtaagccgtaaccctagtcgtaacccatctgggattcactttgtgcttttgatacatcgatagcagcttcctcctgccagcacaacgacggcccatatagccataaccccagagacccatacaatgcgccgtacttgtagtcaaaacatttcttttgtattcattgaagttgagttgtggattcttagtgaaatatgtgaatattacagccgcactcaaaattccttttttggcttctagctcatactccctccgtcccataaaaaccaacctagtactggatgtgatatatcttaataaaatgaatctggacatacatctgtccagattcgttgtacttagaatatatcacgtcaagtcctagatttactttttttgggacggagggagtacgtatcttacggtgcctaggattacaaatggccagaaaagcgatgtgtagagcttcgttgtgttttttatggagattggacaaactcacataactgaagttgtgagggtgtgaggccaaacttcgatcgaggtaatattgatgcagtcgacaagaggcttcgatgcgattatgatcaaacttctgctcggagagttttggagcttgcaatgaggtgcactagccggtcctctatcaaaagaccaacaatagcagaagttgtatctgtttgagtgaaatattagccacggtgaaagagacatatacaagtagcagctatcagtacaatagtggcacgagggagacggaaaaaatggcccatagttattcatgaatgttcctgtataatcatgtgatgaataatcttgatgatgaacgattgtcaaaggtaaatgtttattgaaaacacggtgaacactatttaatgttggtgaacagtttgttggcaatgaccgtatgtattcatgcggtctaaccagggtagcccgatggtcagactagcagactctgagaaggagtcgatttcgggttgttttcgtggaatttttaaattgttttatgtttatggctctagatggtttctatttatatgtgatattatttgtgctgatatgagttaagttggtacgaacttgtacttgagttaagttggtacgaacttgtactcagatatggagtttctttgttattcatgtgcaggtgttgcttgaggacataggagtatagccagtgatggatcgggactaggcttaagaggagttaaggtcaagacggtcaaggatatcatacgggatacttaggctaaagaacaatgcacgtggagatgaaggtttccatatggcatacacgtggtgttgtgtccatatgaacagatgagataaatttggattgaagtctaagtttagaaagattggagtgtagagttgacaatgccatgaaaaagagaggacagcctactactattagtatttgggtcaagctgaaatgctagtgagtcatgcatgattaccaagctaaataaatactctcacatcacaacgaaatgttcagaaaaggaaggcacaacagttcaccatatatcacaagagaaacatgctaattacacaggagaaacatcactggatagaaggggcagagagatgtaccgttcttggtcagtttgtcctagattttggccttcacaaccttgccatcaagccagagggagtggtcctgccataccttcttgatgtcgtatgtttctcctatttccaagtacttagcttaaatgtgaaaaacctgcaattaatatataggagcaacctgaaatcagaatgcaaataactagcagtggtagtagtagtagcggcactccatcaatctcttttgtgagtgaacatggtaaattagaggtgattattaacaattggaaggtgacaggaattttgtttggaactgtactaagctatgagctttacatgtgagaactgtctgaaattacagcaactttcagtgagctatttgcttatgcaagcacaggttttcaggaagatcacaatttttttttattgttctacagaaactggacagctagcacttttgagtatcacatcaaggtattcttgtaagaaaaggatgacctcaatcttcaagtctttgatacagtgttaccattatgtatttccagtactaatacagcataagatcttgtcatgagctgtataccatctaagctatcaattttcaacagcctgtccattgttcagagaggacaaaaattttacaatagtagttcaaaattccaataaatgaatcctaaatagatgcagttaaatctgcacctctgctctgcaccttgttcattgaagcaaccaagcaagacaggggaaaacagagagagctctagacagatcaaagtatacaagtaaactggattttttttaaaaaactttctctacctctacctgatctacacgatatatatttctggtgtgtatgcatgatcaactttgcccaatcaaatgaagatatctaactctagtggacaattcaattgttattatgtgaggtagaggcaaagaaggcgccattttctctaattttcttgcaaataatacagaaaccagtccaaaaaatgattaaattgctggatgaagaactgcttttctggagaacagaaaaaaaaacaatgacgaacatgctatagaaaaactggcaagagaagctgtcctctgaaaccttgggtcatcatcaatgaggtcaattctaatgatagcacttaaattttagctgtccaacacactacaagaacaggagatactcgattgtcatataggggctttcccattgtcatactgcaagtctggtgaatgtttatttcaagcattgcacacacttgtctttctcgaatctctactgaaaatattacattctccttatgaatcttgctactcaaaagggctcgaattgatctgaaaaaacacaggttctttatggatggttgtatggcgtcatgcatgttaatattcagaatatgacaggctgaaactaactcggaagaaccccaagaatccccatcggcgacgacttgcagtgagtgcagatccaagaaagaaacacaagaaccccaagaatcacggacctggtggatgggcgggtacatggagttggtgcagacggggcactcgagcagctcgtggacactcgtcgccggcgggacgacaaggcccccaaccaccacccggacccctcctcctcctcctcctcctcctcctcctcctccccccgtgccccctgcccccctccgccgtcgacctagaggggcggacttggacgccgacgtggaaggcggcggtgtgggacgtcgacgggggaagagggataacgcaggggcgctggagaggccggcgacagagctcctaggcagcggccatggcgccgacgtgggtggtggcggcggcagcggctggagtctccgcctctcgcctctcctggggatttgccgatttgggggaatggccgaatggggctccactgggctcacccattttggatccaataatttttaaccaaaaccaaatcggtccaaaccaaaacttttaggtaccaaaccactccagcccatttgtggtggcagcccatttccccccatccggagttgctccaattaaggaaccgaatcgtttggcccatttggccccaaaccattagcaggcttacaggtacgttcttaatttggagctgagatttgtctctcgtgatagtattagcgaaggggatctgatttaatttacggtgtagtacaatcggcgggttttgattgacctgacaaacctgtcaccaccctaagtttaaagaattggaagtttctaaatggaacacaaatttgtcctgacgtacccgctcagtaactgagcaaaaccatcgccagccagaattggtttgccacaagaatagcagaatgcagctaaaaacagggtaaaaaaatactacagaagagtgttttcttaggaacgaaggaaacagggcttaggaaataatcaaatgatgacaagacagtcatcagcacccagctggtttgaattggaagtcaaacggggaatgggtaatgcgttcaaaccgtaccaaactctgtcttcaaaacttcaaccacgtcgttgatggtgaaatggtgaattgaatcaacaccagattccagattacacgggcaacagtttcattacatgaaagaagagaatgaatcaccacgttgaactgacagatattaaccatttttgaacttgcctctccctcatccggggctgttcatgtaacaaatgttaattacagattatgcacagccaagctcacatgtacaacaggggacaacgccgcatcaaaagccaagtcaaaacacaattacagagctcaattgcaaagctatggcaacaagctacaaaaactgtatggcgctggcgcgttttttgccaaaaagaatgatgtctagttatctactctcactgtgttgtactagtatgaatgaacctccccgcttgtttcagatcaccaccaagtcatgcaaagacaggttcagttcttgggcaagttgtgctgattgaccaccccgcctgcaccaacaaaatatgaaaccatcacagaatgtcaggaaagctagctccaacaaatgacgtgggtagcaaaaaaaaaatggtgcacacgaacaactgtcagcaagcttaagaaaacaacagtctgataaaggccgagtttagttccaaattatttcttcaaacttccaacttttccatcatatcgttccaatttcaaccaaacttctaattttggcgtgaactaaacacacccaaagtaaaggataaagcatctcatacagggaggggaggggaaggaaaggaattacataattaaggggtgtagaacttgctgaatcttttgcaaatggttaaaacaccgactgcaacgttgcaacctgtgtacaatacacaccagcgaagtcagcaacagtccagttcatcttgacatagacagagcaataggttataggatgctacaaacgctgcagttttttaaaacaatggttcctaactgaagtgcagggacaggacccacttgtcacctcacatccagtgtctctttgcaatttgcaggttttgcggcgtcctttaaatagcattcccttgaataaggttaatgcacgtacctctgctcagcctgaatatcaactccaactgctgaatgagctgacaatgttgaacgaataactggtccaaagatctttataagatccaacaacaattccaaagaaacaatggcatgcctacaaattgaaattaaaggcaaagtaaccataagacaaagttactactaaaccaaacattttctaatgtaggatgccaatatctccatggttttgtaaagaaaatagatccatgactttgcttgcaatagaatgaacatactaacaagaggatagacaattcaattcaacagcagcatcttgtgtctacatgtgtgcacagagcatgtgcgcttaagttactatgtatcacttggtccagtcagacaagaaccaacatgccaatatatcacctttcagccttgctggtcagtaaccccgcaagaacaggcagaaagcttaagaaaatgtctagactgaagagatcaagtttcctcttcagagtactaacaacatcagcttgaacctgtaaaaaaagagtcaaaccattagcagctaaagaatacgaagtacatgtacatccaagaataacgcacggcatcttgagaaatacttactgcattgtcgggcaactttgccactgcagcaattgctcctttgataccattttggtcaaagacatgccgcatcatctgaagacagttaacattaatatcatatgctgatggagtgatggctatgatatatgcaacttttactagttttcaaatgctttcctcactgactattccccactctccacttgtaggataattagtagatggtgggaaaagtgcatgtcaatgcataatttgcatacaggtgtagatcactctcatcttatatcaggctatcagaaataatggagctgattaattttagggtgttgctggattgatcaacaatcttcactagagctgacttcaccttcaatttagaggtgtgtacacaccaattgtctttaagaaaatgccaataaatcatttaacgcaagtatcaaagaaaaaggtaatgttcaattctaagttgtctaattgtactcaatagactaacaacaataggccattttccctgtactgaatagcctaaagaacacagaagagcttcttttttgggaatacgcaaggagcgcatctttgtattaagaaggaataaatgtatgcataaagcgggccaaaaagacaagcgaaggggacagggcacaggagaagaaccaagaaacaaaagcctaatctccaactaaattttgcgacccttctctactaacatgagctaccaaagcagggattgcagctctagctagccgccacagctccgcttcacccgtcataacccttacaacctccgcccaagatctgctcttctggttgaagactcgattgtttctttccttccagatcgtccatgcaaccaacgtcgcgatggtgtcgaaaccccggcgatgttccttgaccatcctcttgcgacagtcgcacaaccatgagaggaacgagtgttcattgatcggtaagcactccgaatgcccgatagctctgagcgcaacccaccacagttgccgcgactccgggcatgcgaccaagagatgatcaatcgtctcttcgcattgatcacacagaacacatcgatccgggtgcgacaaaccacgactccggaggcggtatgttgtccaacaacggttaagagctaccaaccaaaggaagtagcgacagcgagggggcgccaaagattgccaaattggcttgtgctggagacgagttcttccaaaaaagagaacacaataagccgagcgggaagagtattctcccgaggtctcccaccgccaagatagagagtccggctcttcggaaagctgcactgaccgaaggcaatcccaaagcttgaaatactctaggatcgcttgaatacc

SEQ ID NO: 20997 - DNA, 13579 bp, Oryza sativa
  unsure (1)..(13579): unsure at all n locations
actttaggatcgcttgaatacccaacgccgaactggatgtcctggatccatcttctggcagggattgcctcggccatcgtgcgatgattccggagacgagcaggggggcancatatacagccggtgctagcgacagaagagcttcttcatatgtataatctatcatgcaaaggtatgcaagattggttccctgtttattggatacaaaaggtcaaggaaggaattctatggtgcacatgagctggtaacaaacaggagtctgcaagtaaaagatcagagacaagacacacctctaactttgtcagccgagattttacggcatttataaattcatcatggctctgcatcaaatcgattggaatcattgcttcatcaattgttgacaagtccttctcatatgcctgacttggttctgcctgtccattacaaccattgcaaaatataatgatttgagtaatggaaaaattcgtaaatgctagagagcatgaacaaataaaaatggagcaaaggtaaagtcatatttttctatcccatattctgattttatttctgaaaatactccaatctcccagaagtacttaagtccacaaaacattacattatgatttatgacaatctggtttctaacaatactttatcccttctatttctatctccaaatagcatgtacttcgcagtaaggggaaaaacgaatacagaaatttacattgtataatatgcaagaataagtatgtatgacatgtggttttattccttgacagaatctgctcgttggtggatgagaggacgacggcggtggctaccctagagcagcgatggaagcaccaacccttcacaagagctcggacgtcgtgctatagggtcgaccaacgggcgcggagtccgtttctgcctctctagtcctcacgccgtcaacaacctaggccgacaagagcacgatttttcctgcctcctcaccgtcgccgccagccatctcgtcgtgtgtccccaagtcctactgctgcgcctactcaatgtcctctgctgcgatggtggcgtcgcacctgtcatcatcgttgtcgtgctcaggcatcctacgccttctccaccgcaaaggccaccgtgccgcttgcccacttggttgacctgctctagctcctgttccacacgtccgtcttcactattatcctctcctactgccttgtccttctgcccctatcatgtgcaccctctgtgctaccaaccggcccgccttctcccactgcccctttctgccattgctgccatcgggaaggatactcccctcccaataccatcagtaacttaggacgaggctgctaacttggatagagagggttgcttgttcgtcggcgctagaggggagaaggtggcaacgagcaacaatgaactgaggagctgggcagtgtatcggtaggggtaagaggagggagaagaaagagagatgccactgacatgtgggcaccacatactaactcaggcagtttgatcaggtcaaagagccctgccagcgaaaattgcccccaaatcgaccgagggaagcaaactacaccggttttaatatttaagggtcaagatatatgatataacgttgagggaaacgacttagattggagctatatttgagggagtcaaagtgcacttatttctaacgggaagatgagtacagtgtgttaaaactgaggccgatggttatggcccggatctagtatgggccagaacgggccgttcagcgtagggggtttaacgggaaaaagtatactttaactccctcaactatcgcccgagtatgattcatgtcctccaaccacaaaactgggtatatcaaccactccaactatcaaaaccggtgcaaacaatgtccctcagtggttttggctgacgtggcgcttacgtgtcattcttgaccgaacctttgtcctacgtgctgcttacgtggcattagaataaaaacagaaataaaagaaatatgtgggacccatatatcattcacacaaaaaaagtattgtgggatccaatgacatgtgggacccacatgtcatcctcccactcccttcttcctccccctctatctcccttcttcaattgcatacaccccttgcacctctcccacactcacttgagctttgtgttcatccgcttagtgtgtttgagggttgttctagccaagagtcaagtacattgcttccactgtagagctagtgtggcacttgatcatctccgagccgggtcatcgcttattactcttggaggttgccgtctactagacggcttgtggaggtgttgcccggtgacctctccgaggagattgtggaggaggcccagcgccggtttgtgagtggtttggagttcaccactttcggagtgaaggaagaactacccctagtgatcgaggcttagatagtcctctccttgggccagctcccaccttgcccaccccttgacgaaggaggcgtgcggtggcttcgtggttgagcggtggagttgggctcgcctcaacggggattaggaaaccggcgagtttccgaacctcggtgaaaaactccttgtctcttgtctcatttatttgttgcatttacatttgtgtaatttacattcatagagacatatttgagcacatatcaccctaggattgcaaaacttaacttaggtgtattttactttcctagagatatacttgagccactatcactctaggattgcaaaacataacttagttgctttgttagacttatccctcaccaagcctagcaacttatgttagttttgattaggtgtcatttagttttaaatcgtctattcaccctcctctagtcaacatctcgatcctacacgtgcgctgagggaggagctcccggccgtccccgcgcgggtgaggagctcgctgtcgtctgcgcgcgggggaggagctcgacgccgtccgcgcgcgtaggaggagctcaacaccatcttgccggtgcccatcggcatctcgagcagcgcgtggccgcgcgtgtcgagggcgcgctttagctcacccatgtatcgcggccgccgctgctcccgctccctaccgccgtccccaccgccactgccaccgctaccgcccccgcccgctgccgccgccgctccccaccgccatccccaccaaagagaaatgccgagggaaagagagagataagggagagagagaaagggaggaggaagaagggaaggagagggaggatgacatgtgggtcccacatgtcagtgggtctcacgatactttatttgtgtgagtgacatatgggtcccacatatttctttttattttttgtttttattctaatgtcacataagcgccacgtaggaaaaaggctcggtcaaaaccgccacataggcggcatgtcatccaaaaccacatcagttttaatagtggttggaggacatgaatcatactcggggatagttgagggagttaagtatactttttccgggtttaacatgatgtttcgccttctcggtccagcggcccagtttagaagaacgcgctccgacgggaaaacgagataccccactggggccgtttcgtcttgttctcgctccctcctcgcgccgctagtccggcaaatcgaccgatgtttgcaggcctgcagccgcctagcgttgccggaagagggcatcgcgatgagccatcctccccacctgacccagccccctctcctcgctaccttccctccctccgctggaagcgcgagatatcaaagtcggatttatcctttggccactagctaggtcctagtcctacgatttgggatctgatgcacgccaagcgttcggagctcagccaacaccgtccaaagctctcacgaggaggccccgggagcggcggattgatgaactctccacttctccaggctccaggtacaaaccaacacttttgtggctttctgcttgtacgcattgcctgatgaattctgtcaacacattccacgcgtacatgtctgaaacggcattcatcagactagaagacaatggagatcggatcaactcctgaaatttctaatatattgaagggatgatatttgaacattacaagctcttggcacactaaccaccaccaccacacacttcccacaatggcatgttactttctgaatcacaaaagaaagcaacagaaacagccatacatagcttcaggtagccttagcctaagctcacaatctcacattactcaacctcatagaaacttcaagcttactaccaaaactagtggcctcctcatacttacagaagaggtttatatatctttcgaccacaatcactaagagattcagaacaacatcagactgacaatgctaacaatgccaagcagcagcccaatacttgccttcaacccagcagctccattcaagccccagacgcgcacatcatcgatcactggcccacagagcgagctgtggtcgtcgcttctcgtgttgtaatacacgctgtagaacgccactcgcgtcctctcagctcgtgctgtgaatgtcacattcgcagcctggcttgtggcattacccatgggcgagtagtggaagttctgggcctggtcacctgcgaatgccatgacagccattggtggctggcatgaatcccctgctgagcccaatgtgaatgtcaggctgtactctttctgaggggttgtctcgaccatctgtgagatgatgccttccttccctgatagaagctcaatggcgcgcttcccttggggaatggtgtactggtcagagtcgacaaagcggacagctcgatttgactcaatcatccagccaggcaaggcagacgtctgctcatcgaggttggttgggagaagcaccccaaagctcgtgtttggaaacatccatggaccctcctcaaagtctccattcgacaccacattatctgttgaaagaagacaacaccaagtgatgacttacgaaccatacacatgagaaatgaactagagcacctctagctctcttaagacatcctgtaaggatatacactctactaggtatagagataagcagaactgtcataccctttggtttgtctggagtgaagagcttctttatggcaacgttgtcaaggataggcccacaagtcggatcatcctccataccagggttcctgaactcaaggctcgcctgctcatctgttgcctgaaaagccagtgcatatgcatcccagccttctatgttgtacaatgtctgcaggtccactgtctgtgatgcaccaccgagcacagacacattgagtgactctagctgtgcacacgttcaggcagcactgaacgtgatagcatacctgagcccttctcaacctgcaccacctgccctatacttgcatcgtttccaagacgtacagcatgatcccctgacatgaaaatccaaatattaaacacatcgaatacaaatcaatggtgcaatttgattgatcagaggacagaaggagaaaagctctgtaggataccctgtggaacaataagaatcatgccaccctggtgctggcctgctgagatgagctcgactgtcccattgatcgtccagccagggatcgatgatgcaccctcagcaactgaagcagatttgacaaaaccaccagctggtgctgtctcaaagtcaccattgctgagcaagcctgttgtgcaaagagatcacttgttcatgtaagtgccaaggtcaatttagtaacagatctccgaaagtaacacggctgcaatccaagatcaagaggcagaaaatatgtttctcaagaactctacttaatatctacccatgttatatgcgaaagtgttcccatgcaagtgaagccaagtacatctatgcaagtctgcaatgcaataaaaccataactattttaagttgtgtagctctagcctattgtaggataggacgaaccataaatctgatcccccactgaacctagtacactgtgcgctggactatctttgttatggcatatataaaataatgtacaactcagactgagggtgcgtttagttcacgccaaaattgaaagtttgattgaaattggaacgatgtgatggaaaagttggaagtttgaagaaaaagttgggaactaaaccaggcctcaattgaatggcactatacaactccaatcaaatgcataacagtgacaaaaaaaaacatttcagataaaaacttaaacctttctaatcaaacatgtgtaacaagtgaaatgaaccatcacagtagagtttgaggaagttcatttccaagactggtttttcttataagtgacttcccaagcttgtttttttatggctaccttcccagttgaaagcatggttgcacagataaactgtaccataattaaatctcctgtacaaaaaattaacagctaaaacctctaattcagtactataggagagaaaacatgtccatgtttttctattgtacatccaatgcatttcattggggcactgcgggtaggccactttactgtgcttcaatgtccttacaaggacagccatgtgactatgcacgacgatattatgtggtgaaagtgaaacatccaccaaccctaccctatccaccatcccaccatggagagccccatgcagtggtccagactccagagctgcccatgtccggaggaaatcaccacggcccgtagcgtaattctggggaggttaaggtacgaaaaattaaagagacaggcatggaccctcacggccatccttttaataagccatttgacctttttactggacggttcattgaacacgtttgcaggacactggctcactggtttctgctgctgtgctgttcggcctggatccaagtttactactacgccacatttcattttgactttcatgcaacttcgtccttgcatagaggttcatagtacctcctttggacaagataggaaactgaaactctttcagttacaagcctgaagattttctgaatctttcaagtggttttgttagcagcattctgcacccaacagaatgtctctctcatcatacaggacagctcacttgggggtttttagtcattttcaaacataaaattgcatgattcatagaaaaggaataattttataaagatatatacatgcagactactaaactcgaaggcaagtaaggaataggggggggggggggtattaagcaggtataaatatttttatccaattaatgtacttaaaagaagtggttagtggttacactggtcactgcaaaaaactacagtcgcaggaaagctttggaacaaattgcagtataactgatcagtttttggctgtccagacttcaataacaggacaggtttggataattggtatgaataaatgttatctcaacctccaagggccaaggctccttcctactttctaggacctttactttgcaggtatactgaaccatgctctacaaaaagagaaaaaaaaaagaagggggggactatcacactccttcctcacgagtgcaaccacatctcttgattcctagggcacaaagctaacttcttggcatgctttaccacaccattttcctaggggattatttttctcttctcctacccacccttcaaatttctcctcagtgctatgtatatgtgctaatgaactccgcatttgttatacaaatgtgggatgcggagaggtactaaatcgcatgatttctctatttgctgagatctgtgatgcagaaaactacccatccccacaaactccagccaaatattccacaaatatgtcaaaatactgccttggatcctccagcatcaaaagaacagcagcactactgatcctccagcaagggcaagaaacagaaacgatcgaagagacagcaaagcataccatcctccaccgcagcggccgaggccagatgggagggcgccagcagaagcaggcccaggcacagccccagcaatgcgagcctcctcgccgtatctccctccatctcctcctcctagccgcctcgagctctcgcctcctccttcccccctcgccgaggaagaagaacagtggagagagtgagccgaagtacagtgtgtgtgcagctgaccgagtgagcgagccgagccagccctactcactgggctggaggcagctctctgctcacgccctgctttttatgggactccgatggcgattcccttttcctttggcactttgctggccacccccattattctatttttctcgcaggcctggcctgtggggtctgaaaggaaaggaaggaggagcagtgaccactgaatggtgagaatgccgtcgatggtcaatactctagaggtcaccctgccttttgcttttttttcgcagcgttttggtagcactttttgtcgagcaccaaaaagaggcgccgctgccacttcacggaaacacgactgcagtatagtagaacttgcctgtgtagtgtagttgtgttctgcccccagtagggcagtagtggagcctgacccaaaatctcaagggttcctagagctcctctaattttttgccccatgtaatgatacctccgaatgatttcaattaagcaagttgaatctgtacagcacaggcttgctgtgttcagttcatgtctactccagctccagctgtcatatgtcagctaactactgactatgactacacatttcagcggagcaaattttggatgaaatctgaacagctgtgacgagttggtgttttaattctttaatttactgaagtactactacctagcagtagttcatttaccgaaaatgatatgcccgtcctttgtgttattgtgtatctctgagactctgacagcattgggctgcagagaatgtgtttttcaggaaaagaatgtggctggtaccgtaggagtatgtatttgtgccagttggcagcaggatttgttttctatcttcttttggaagaacttgttgtttttgggtctataacttgtgttaaattgtcattgccctttttgatgttacattaccatggctgtgtttagatccaaagtttggatccaaacttcagtcattttccatcacatcaacatgtcatatacatacaactgctccaatttcaatcaaaatccaaactttggatccaactaaacacagcccatgtgaagctgtcaacatttcatacatgaccatgatgtacaatgatgttccacagacaggccacctcattttttttaatttagaattgttttaattcatttaagtctttgagatttgagaccatgcataaggctagtggcccacaacttctcaaatttcccaacaatataatttctatacgctttaaaaaatcatattaatctatttttcaagtttttttagctaatacttaattaatcatgtgctagcccttgcttcattttacgtgttgggagggaaggggtctgaacacctagctaggttcgaacacaccaagtttgtatcagtgttcacctcttcgatttaatattagattccgaacacggtgatatgattttctttggccaaaatttgataaattttgattaatttcggttgaattttaccacttcaaattcaaattatcaaaaactattcaaaatttcacttataacctactttcatcctgcatcgaaacagcgtagttttcgaccagttttggttgaaaatagcctcggtgatcatttatcctgcttcgcccgtagagcgaacgctgaacttcccctctcagaatattgtccacacgtcgggcgtgggagcggtgaagcacgcacggaagcagccaggccaaggctacgtgacagcaacggggtgccgtgttgccgaggcaggccaccaaagccagtagggccctgatgattagcaacaaaagcgggtgcctgccgtgtgggctgccctgcatccatcggtcggtccatcgccctccgtccccatccccaccgtcaccgaagcgacgcgacgcgacgcgactgctgcttgggatttgattagttgtgttgagagatggccacaccgcaactgctgctacgccgcgccttctcctcctccttcctctcctccccattccgccgcccgccactccaccccgcccgctccttcgttcccccccgcgccgccatggcatcctccgccgcgccgttccacatggtccagatccagcgcgacgacacggtcagtcactctcactccactcacactacgctcgcccaatcagtccccccctccctagggttttgggttttcccgtttcccactgtttttatttaggaaatatatgttcggcccgcttcgttgcggtttagctcccgcttcttgtgattcccccccccccccccattttttagagaatcatccatgcttcttgtggtcgaggaggtgatctttgagacatgaatatattcgtttttagaactcactttgccgctttttccccgccttcccgcattggctttacctttaaccctttctccgctaattagatggcacataatgctattgagtcatgacaaatagttctggctgtcatgaatttggtggatactcggtatgcgttgagattgttgtgtcgttatgtggagtaatacaacgattaatccattcgtttccggttttcttttgcctaatacggaaaccgtttgcatccttttccttgtattaatttctatggtatatacatagaattgatcgaagtattgcagacgcgaacttgctagtacggttttacagtgccaacgatttcacctggactattccagatgtttcagcttatctgtgccttttcatatattcacttgattattctgtccatacagcttacctgaggttgttatttgttggtaagaatgtgcattagccttgtacgaagtaggtacccaatttctctccaaccagaaaattgtaaatgtgggacacttttaaaatttctcctaatctaagatcagttagctacttagctcaatgaactaaattggctggaaagacagcttgctataaatatgtggtgattggtgaaaataaaaaaagatgatgtcactgaggcattagtcaaatttatgtgagttttggaggcatatgccatcacttgatgctctgatgctcccactttcctctaatcaccgagtaagcattacttccttcgatatacaatgcatactgtattaaacttcattactgcagtatgacagcggacataacctactatagtagtaattgtaaataaactaccatctcaaaaaaatgtactttgtaaactagggcatatcacagccataactgaacaaaaagaagtgccaatattttttttcttgatttcttgcaagctaatattaagattctgcaaccttcactctacatcatgagaattgctctttatatcgtaacggtcgcagtgtgacactaagtcaatagtacttgtacatgatactatctttttctctgtagtaaactggtaatgtggtttactcataaattaatctaatgctaatctgcagacttttgatgcctatgttgttggaaaagagaatgctcctggaattgttgttttgcaagagtggtggggggttgactatgagatcaagaatcatgctgtccacatttcccaaattggtgaaggatacagagctctcattccagagtaagatcatatcttgtggttctttattttgcaagaatttcctcatttgtcacaaagttaaaatggcataatcacattttccagagagtttgtgtgctctttttctgttgagtttgatgcaaatcagttcatttgccacaatagagccacctctcctgcttctcccgagaatgaccattgtgggtgacacttcatcgtcttcaacgcatgcgctgactccagccatcatcacgccatgccagctactgttgcatccccccatgctggctccaatgtcgcctttggttaggagctaggagagagggaaggaaggtggaggaacaatatgggaaaggaggcagatggctgggcatgggagctcattctcgggagaagcaagagaggtggctggagcttacacataattgttgtgcatgtcattgtggcacatgagaaaattcccattcaactcttgtaaatttgagcatgccactcaacttctttgcacacagcaaattttcattcttcagcaataattagcatcacgtattcaaaaacaaagttctaggaatggatgcttcataaatcttaatacttagcatttcgtttctcagccaagaaacttgtttaccaacgtgcctttttcttcagtttgtatcgtggtaaggttgctcttgatgtagcggaagctcagcatctgatggaaggtctagactggccgggtgcggtcaaggatattcaggcttcagttaaatggctcaaggcaaatggatcacccaaggtagggctcgtatttgttcttgtttcattgttttctcatgttttctgtactactgaaattatatctccgtccaccatccaaatattttcagatgccatgacatatttacccaactaactcgtaactaattatttctgtttgctgactgaacttcactggtagattaaaaagaactagagagttaaaaatgcagcatttgtatcttgttacgtgcttactttagatagaggtacctcgggcagaaatttcagcaatagcaattgattggtttgagtaacagggagacagaagaagtaagagcattgttgcagtgataagttgtgctgatggggagggaaggagatttcttaactcttactttccataatggcaggtgtatagtctttaaaggaactggccctaacaaatgttatttagagatgactatagtaaccagaagataaacatcgtaactgtcagattcttggttacagaaaataaacctaggtatattccttgatttcctacatatgccttttcatgggaagtaactaatcatggggatagattactcagctgagttggttgcttgccatgtgcctaacttgctgcaccttttaggggtgtacacatgatgtattgacatattatcctaattgatggatgaaacctagcaaaaaaaaaaaattgtctacattctgatgaaaccatgcagaatgtaatgaattgcattatgataacttatattcctccatgtaggttggtgttactggatattgcatgggaggcgctttgtcaattgcaagtggagtttcagtcccagaggttgatgctgttgtggctttctatgggacaccaccttctgagcttgccgatgcttccaaggcccaggctcccatccaggctcattttggggagcttgacagttttgttggatttgcagatgtcacggtaagaccacctctcatatgttttgtctattttgctatgtattgacattatgcttggggcaacttgtttaaatttcacattcatatactagtatcggcattgttgaatagttaccttttttgttcaaggaagggcttgattccatacaatttatctgcctagaatgatgtacattggactagagaatgattagagtctacttatagatgctcaattgagcattttgacctgaaaaatctaatattattaataggggcacttattaatataatgtttcaggcagccaagtcgctggaggagaagctcaagtcatctggcgtgccacatgaagtccacatctaccct

SEQ ID NO: 20998 - DNA, 778 bp, Oryza sativa
attcctttcaaagtatcatcctccgtaacagcagtttcgaaatcctctagtgtccatgaagtcgtcataggaatctaaacaaaattaccttgtcagccagatggcaaactaatttctacaggtaaaacttacctatggagcaagcttgtaaaataaaaggtacctttccagacttcactgcttctttaattcgggctttgtcatcttgatactgagataaaaggatggtaggtacataagttcatgcataacaaaaaataacagatattccagaatttaaatggtgattgtgatgagatgaaaatattgtagactcgtgcttttttgtgacatgatggaaataaaatttgttattgtgttttacaaagcatgagaatggatagaattaacatctttcagcaggaccaagatgtaggtttttgccatagttgctggccacctctattcactacagattttacttgccatgataattgcaattccaaattcaggcatagaggcaactatagcacattgatgacttaatacattggataagcaagagtatactacgaattttaaaggccaacctgtttctcaagctcctccattacatcttcaaacagatcttttggcattgaaccacttatgttcgaggccacagccaagtacacagaggaatctttaacctgtaaatcgataattttatgaatcaagaaaaaaaatgttgtcattttaatcgtatttataaaaagtcgatttcaatgacctgggcacagtaatcacgccaacgagtttt

SEQ ID NO: 20999 - DNA, 702 bp, Oryza sativa
attaccgcggggccgatgttgacattaggcacttcctttaagagttttaagtggttcgggcactcttaccgtggtggatatcgaggtcaggttcaccccgggtcatcaggtcaatgcaatataagatagtcggattctctatacttcatcaaggtagcttaggttcagggtaaagcttgagagcgtgttggggccagtgagtccagagaactctattagtgcccgttgaaagttgccaataggtgtcggtattctgtctgacaacaattggtcggcacatatgggggttttccgtcagacaccaattgggcggcacttatgcctggggctggcccctataggttacatagtcccggcacttttatgtctgctcgagccaaaaaaaattcccccggctctatccgagctgaatccagaaccatacacatccttacatccaaaagtaggatcctgacgtccaaaatcaagatcctagtcacacatcaataccgttcaccaatgcatggaggagctcccgatttcacccaagaatatcaagatctctatgagcatcaagagctcaagaacatgagcatcatcaaggcatccacacagcctcatacaggtacacgttgacacgctgtggccgccgccgcacgccgctgcctccccgtcccgctgccgcatgccgggcacccgtatctggcagagggtaggtctcga

SEQ ID NO: 21000 - DNA, 18371 bp, Oryza sativa
  unsure (1)..(18371): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagatagttttgaagtgtcttgactactttgatcaaacctgatgattcaagagttccaagctatcaatacatcaagcagattgatggacaaattatagcaccgtatataatatagcccgataaaaatatttccaattctttctaattcaataggcagctagcattgtactttgactccttgtggctcttcattgattcattcatggatagagggaagacacgtcgcattctttggaagtgagtagcacataacagaggcacacttgtatggttgtatgtttcttccaagctgctcaaagactacgagatcaaataatgcaacaatgctaatcagaattcacaacgaaatttgaccatatacgtgcactttgcctattgtatccttatctgtttttcgaaaagtaatcctatcaaacaattcataatttggttgtttgattaattcgcctaaatacattgggttctccagaaagccatgctactgagtattccctctgttccaaaataaataaacttcgtacagtacgtgacacatcctagtatgatgaatctagacagtatactcccttcgtcttaaaataaatcaaccatatgatgtgtctagatttgttgtaatatatgtcacatcctgtggttgatttattttgtgacggaggaagtagcatattagtactatattagttacggagcttggaatccctgtaaaagcccaatacatgtccaaattacaggcccgtaattcttttccgaactaggctaaaaatggtgcttggatggactgtgtcagactaaaattacagctgtattcagcccattccattagattataagtgtggcctggtagaaaattaagtgctcgctaattctatcttctacatagttggtaaccaaaaaagaatttatttctataaagtaaaatatgcaagaagccacatcatcaacaattttaagccatcggatcgcattagtatagagttatcatctgttggatcaagaaactactcatccatttttaggttgcttgctgggccggacgtttgcttgcgggttgaggcagaggggaggagaagagaggacagcgggctggcttggttgtgggctgaagaagaaaatggactggcaatagcccagagagaaatgatgatttttatttaaataaatgttgaaatgatgtttattttatcaaaattagcaattaagctctggaaattccaacaaattttcaaagagtgttattaattatggttaatttaataaaaattaaatccaaccatagcattttatttcttacacttactttacttgtaaattaatttaattatacacctacctacttaaaaaatacttcctccgtttcatattataagactttctagcattgtccatatttatatagatgttaatgaatctagatatatatgtgtatagatttattaacatctatatgaatatggacaatgctagaaagtcttataatatgaaacggaaggagtacccaaatacttcagaaaatttatatttcaatgaattatataatgtaaatctttcttaacttttcctcaaatttatcgtcttttcttcccgttgcaacgcacgggcactttttctagtaaaacaaaaatacagatagtgttggcatgggccagaatggagaaatgtgaacaccttggacctaggcgatggtggtggcctgatgccactgcctgctaggagagatcaatgcagaagaaatggagaggccggtgacagggcgatgattctcccgtggacaggctgcaatctgcaaaggcaccggaaacaaacggccggccacttgagtggaggcagagatttcccttaaatatccaaacatttctgaaaataatgattttttttgtaagttacattagttgatcccagcttagtagatttctgcctctaccctgccatatttgtgttgcatcgcaagcaagcggtttttttcctttgcttgttccacttctaatttattttttcttcgaaaatttatactagcatgtgaaaaataaattagaagacaggtttttatacagttcgtgggattgctcacacttttttttaaggaattagcggcaagagatctgctgattatattaggagaaaaagttctgatagttctgacacatatagtagctgataattcacctccagtcatgaggtgagattaggaagaatacaaaaagtagattacatattgctcacacttttttagataatgatattcctcacacttgtatccctatctaaatccaacatatgttggacagtgatgcaagagcagaaacagtttggtggcttgcaagaataatctgactggcttgaatgtcagttcccttggcctccccttcctagttctcattgctcttcaccatgaattgagaagacaatcgtcactccttactactcctagcagctaggatattctcattcttcggcggcatttccgacatatatgtggccggatacgaagatgttcttatcatttatcagtgaagcacaaacagggtgatggtaaatatgaactagctaaagaaatatataagctgagctctcaaaatttacagtagctcagattaatctcgtcatgcatagtcaaaaattaattggcttccatctttgacgtgataaagcatcaagccaattgccgtatcatgatttggaacatagagttaattagtcactacatgttaatgtaaacccagaatgaatgcatggacgtaaaggggtcagtttaattgatttatgaacaatatcaactgatcaaaccacaaaccacggatgtctttggtatggccaaagcattgctagatcccaaggctgaattttgcagaagagctggtatcctgagacgatgttggacttcttttttttttttttggaaccaccaacttttcatggtcatggacgttaacagtatggttggtaataaaccaaaacaacagctgatttggtttgtaaaggtggcaaactagtgcttccaaattaaagtcacaagacggtggttttatgaagttcataaatatatagtagctattcacacattattaatttggtaattgacaaacagttgctagctctcagtggatgtttcttgtggtaactgcaattaatctagtatgtacctgttcgaatacactgaatttataattagctaatggttattgatcaaggtgcaggatccaattccaatctgatgcaggcttcgcaagtaggtttgcaactatatcaacctcccattgtattgtatcggctatacttcaacgaccatagtctctcctcgaacgctatcatagatcgtcaaatacagcaaaacggtactgctctactggaataagttgcacttgcttttttgctccttacgcagcttgtcgtcttgttgtaaatgatatagcaacttgaacatgaattcctgaggcctccatttcctagtggatcaaatatctgaaacgactaatatatatataactgattactaatcttttttcatgtaatatatgtaaaatgaaaatgtatttgattattttataatgaacaattggcatatatatgatattattggttttgatatttgcaaattattggtgatatggttttggagatgtgtgattttcagatgatgaaaaagattgagttgctctgacggtcatggtcagacaagcaggactggactgatcagaccggcgttatgcgagcggtcaaaccggccagcccgactgatcagaccggcgttatgcgagcggtcaaaccggccagcccgacggtgaccagctgaattctaatacaaagacacacaaacaaacatgaacacaagtgacctagagaaggccagaattctaatacaaagacgcacaaaccgtttgtatacccccaacagacaccatggaacttagacgtgcattctcggtgtctccctttcctattggatcctattgaacatcaccatattactgaacgaacaatctctcgagaaattgctacacatacaactggcatgtacgacttgtgaccaactagtacttagttgtttcttgtcctggcccacatgtagagatgctgctcgtatggagagaattgattggcagacatgaggccggaccggataggggtcagacgatgtggtcggatgtatagcagtactcaatctctcgcatgctgctgtggatcacactgtacttgatgagtgctagtgaattttaacaagactgtttagctatccaactctatagcaaggaagcaaagatagtgactattattctatcaagtatgcaatggcttgtaacaattaatattgtaggtgaacggtacatgagcaattaatagaggtatcatgcagtttcaaggcttcatatgaaaagtaattacctcatccttgttggaacacacaacgatgtggttcatgtaaaacgaaggtgcttgcaatgctgcgaaatcctctttggctggtgtacttttccaccaagcatagaagtttaaggagaactgtaggtcggtggctacctaaggaaactccgattcgatccgccccccgttagaacagtgacaccatggatcactggctgcaatagccatcatgggaaggaagctggatttgcgcagcaaaaggttatagcacaaggtaatgcagtgctgggtttaacatatcctagagagagatgcatgcgcatcttgcaggaatgtgctatattactcgagtttcagttccctttgcctccctttcccattgcactttgctgtgaagacaagacaatggttagtaattaacagccacaattctcattcggttactatatatatgcgggcaagtatatactagctatagtataaatatatatgctgagatctccaagctttatgctagctcggattagtttggtcatgtgcagtcaaagtcggacttgtttgagacgttccacacatacacttgactgactgcaaatgtgtacacttttagttactgctagctagttgtagactcatggttactgaaagacatatataatgccaatattggaggagataacaaactgtaccaaagttgtagcctttagaatttagacatgtttgattgcaatacttgattggatataaaaggttgtttgactatgcacacctaactcacttatgttgcagtctcctctttttttttgtaaaaaatatatttctgaagtacacctctctgatcttataatggaaaaaaagtagtcttccactcgtcatggtggaaaaattcttaagctcttgctatttaaaagtgatttaaaaatggtgctttgcagataatcaataattgaaaagcactactagaaaaattatttttgcaggtggccaaatgctttgcctgctatttaaggcccgtgaaaatcatcaatttttgtagatggattttcatctatgtgtaaaaatcgattttcgcaagtgtccaccctaagagccccacgaaaatctccttttttaggctgcacagttaagtgcccacgaagacgaggtattgctttccaaggccttgtggtgacggatccatgctcccaaggcccagtggcagcagatccgccgccctcgacaccactgccaatgatgcacgagggagagatgaagattgtgtcgatagaaccaccattattgccccttcatcgccgttgccgacccaccgccactgaggtctaccagcaccacgcaacccacgaccttaccggatcctagcccgtaagcctcgctgtccgcgtgccaagccaccacctgggccccgttgctgccctaggtccgccgctagatcttgctactgcagctcgatctccacctccagatctgtccattgtagccttggctgtgccatttcctgagttctgccacttgggccccgtagctcctccttgttgttgctgagccgccaccactcctttgtcttgtcgttgagacatcgtcgccaccacgcatgggttctttaccacaagaagagcggtgggagtgttgagagaggagtgggggactaagagggaggacagtgatgaatgcgtgatacaggacataggagaggaatgagggagagggataatgttgaatcgatggggacagagattttaatcggtgtaggcaataggtcgtggatttttgcagcagcctttggttcttcatcctttcgcatattctttgtgctaatgttttttcatcttggcaagagatggagaagcttattttgatatttggagataaaaaaatataaaagatatttcccccgtttcaaaatatacgacgctattgactttttaagcataatgtttgatcatttgttttattaaaaaaatagtataaatatgtaagagtataagttaagattatattttttatttgatgataaaacaaatcagaatgaaataaatgaaatttatataaattttttaaataagacgaatggtcaaacattattcgaaaagtcaatagcgtcatatattttgaaatagagggaataaatctatggcccctgcacggatgcacccaggcaaaattgtagaacaaatgaaaccaaaagggaaaaaaagagaaattaaaggacctggattcattcccaatatgactgcccacctacctgtatatgctagtcccttatgccatccccaacactgcatgtcatctagtgtccatagcattaactatattgcaacagaagcaaaaatctaatgtggcaagagagttaatcaggagaaagctaaaaagatcacgaaatcatttctcatgcaagaaaccatctctacaccaaaaccaagaatataggtgaataaaaggaaagagaagagagatgattggatgggaatttaatttaaaggccatcctcaacccagaatatatatatatatatatatatatatatatatatatatattctgggttgaggatggccttagatcaatgtaactataggatcgcagatcgttacttgggttgttgaaggttggcttatgaaaattttacttaatacacgccaattttgatcaacatgtttagtcatccgattccctctttttttcagcacttttttattgcagaaattacaaaaagtccacattaccaccccttataggatggaatggagttgacgtatgtgcacaagtgcagcccatgctacaatgggctggaacactacatcaataatgatgttgccgacatcaaatagtcagccggtgacttgggcgtaggatcctggtgcctcctgttcccaattatatagttggcaatgaatattgaccctatctgccacttgtcttttatatccctcatctgtttaatttcttgaaaaaatacagtcaagcaatgaactttgtaattgatgaattggccttgatacatttgggtttgggttttcctttgcgaagaccatgtctagcgagtcggcatattagtatgtataattatttacctgaatcaaagcgtatagtaggtgatggtaggggcgcaaaaatatgtagtagtgggagggacacggattttctacacctaggtgtaacatcacctatatatgcttggcacataagtagtcgtagaaaaatgtggaaaatgtggttagattggttgtgatgctagaagtataaataccaatattcatggttaaatatgatctgcctttcaataaaggaaaagaacaaagtttgacactagagtgtgtggacaaaaattgctatgttttgacgacatctcttgttcatggtcagatcaaagacgtacttgtcccagagtatttgtactggtatgcacacatggcagtgatggaagcccagatttaagccgttgatttgcattgaagactttgtttcagaccacttagctttggcaaatgacaaatataatcttgaacaaccgagacatacaagtatattcatcttctactttaactacaaagattatcaggagagagtatatttagcacaggacacagcatatatgcgcagttgaacattcagccagctcaatgaatgcaatagtggcttggtcactacaagaactaatgctatgaagcattgagccaatgcattcgatcattggacgtgccattttacctacaagaactaatgctatgaagcattgagccaatgcacgaactcgaacagcagctatagcagagatcgttgatgagctggctaaaatcgcactggaagcgcacacggcgggccaaatttgctgaggcccgcatgctgaacgaacggctagataattcgttaaaatggtgggaacaatgcaggttggactgctagcaagctatgaccagagtagatgaagatatttcattatatgccacaactaatatttgtaaagctagctccggtactctttacttatagtattatactataagtagaaataatctagaccatccgtttctaagggcatattagtactttattagttcagtgattagtgataagtttgacatttaattagtcttattttaccatgggtcgctgacagattgctctttcagggcttgttcactttaatgtcattttcaaacatacaatttttttttgataaaattgctaaaattttggctacgtttagtttgttgccaaattttagtaagtactccctccgtttcataatgtaaaactttctagcattgctagaaagattgcggcaaaatttgctacaggacaccgaaaaattgcggcctttgctatgagacacccgaagatcgtgaatcttttcgtggacactgtaaaaaagtggtaattagctactgaatactcctcccattattttattatttctagtcaaagtggtaagtaccaaaatgcccctgctctctttcttttcttttccccttcttcttcctcgcgcttgctgctgagctgagcagaggcacaacgcgcgcggcaaacgcgacggcggggcggcggcggtggcgcatcaccggggttcaccaccgacggcgatgacgcacggcagcattccggcgcacggtgcccgggaagaactcgcctttgccgcccagcgaccggtgtccagcggcacgttcacgctgtagtgcttgccaacgccctcacggatttcgttgatggtgccggtgcccgggagcggaggcgcgagtagctgagcatgcagtggagcatggtggcgcgtaccactgcctgtcgacgaccgcgcacgccacctcgctccaccccccggtctggccgccgcgccgccgcaccacccaccggagcgcctcgcagaacggcacaggcggcgttgagtgccagcatctgctcgaccaggtcggcgcggggtcagtgactgcatcggggaggagctcgtgcatgggcggcgcgtggcgtcggtataaaaaagggaagcgagcaggaaaacgtcacggtggacgcgggtttcgtgttaattgagatgcgccaaaatgcgttgtttacaaatatatcacaaaatctaaaccgagagggctctcgatttagtgttaaagagcgacgtaattatttgtgagagaaggtccaatgcgctactaatacatgagagaaggtcctgtgctactagtacaactacgtgacaaagggtccagttgttactagtgcacacaatgcatgtctatttttttttctttttatacaattttctctcaaattacttatccaatctgcaatctgattacactattacgttcgttgcaattaaatatttacaacaagattttacatgattatattacgatgaaaaaatatttatatttataaattacttttattatatacgtaagttacttttatcatatatatatatatgttacttttagatttgactaaattacttctatacattcataatgatctaagttgattatttttattattgtttttagttaattctatattttgtgaactttataaatttctctacacttaacttacgaatttactctacatagtttcttatttcagctcactcacaatataattatttctactaaagagagttactcccccgtttcataatataagttattttagcattgcccatatttatatagatgttaatgaatctagatatagttctaaattaaagttactttcctttttattataagttacttctgtaatatatatgtaaattacttttaacctttactaaatttacttttatatgtctaagaagtaacttagtgaaatctaaaagtaatttagacatatcataaaagtaaattgtgatttttcattaaaatataatcatgtgagatcttgttgtaaagatttaattgttacgaacacaacggtgtaatcggattataaatcggattagtaatttaaaagaaacttctctaagaagaaaaaaaacatagatattgagtgtactactagctattttttggaaataagggtgtctctctttagcactatcagctagcactctcgctgtagttgtgtcccaaatatatatgcatgcgggcgctggttcaggatcctaattacaagggattagattaatcatatcttctatctatctgaaccaacaaaccatccgtgcatatatccatatatgagatgacaagataattctagtttatctaacagtcggggggagttgaaggtggtgtggacgacgttgacggcgaggccgcgcgcggtcgtggaggagctcggcgagctggagcatcagggcgatgtggctgcggaacgggaacgagaacatcacgacgcggcggcggcgagctccggaggcgctgtcaacgagcgcgagcgacgcgggcgggcaccatgacatgagagaaagaagaagaacagataaaaagagattgacaagtgagcccatgggtaaacttgtctttaactaaagtttctctctccgtttccatcggaaataataaaataatacagccgctgtccgccagctaattaccatattttttgagtgttcatgagcaaatacacgatcttcgggtgtctcacagcaaatgccgcaatcttttggtgtcctttagcgcaaattttgcctattcatatagatgttaatggattcagacacacatatatgtctatattcattaacatctatatgaatataggcaatggtaaaaagatttacattataaaacagaggaagtacatatgaaatcttgctaaaatttggcaaccttaccaaaattttagtaaccttactaaaatttagtaatgacagaacttggtaaggttgaaaatggtagcaaagtgaacaacccctcagatttcctaaaagaaggaaaaaaaacttactcgcttagatacgaggagggttacttgattctttaggttgtgtttgggaaggagggactttagtccctctcacaaattttagttcttatggaggaactaaaatttttatgagagggactccttcctaaacaccaccttagttgagcaacggtggcagagaagaacaacaaaacgttacttgtttttactggatttactcacagaaaaggcagaaacattggcaagaaaaggcagagaagtaaataaaatcagagaagttcataatgcgctgtaatttgttatttgttttgtaccaagattaacctgaatctactgtaaaaatataaaactaagagaagtgcggttctacatagaccaagcaggagttcagtcaggataaatcaaaaaaggatgaacacgtgagtggtgcggctatgagttcagtcattgacgacgacgccagcggctctggcgccaaaaaaaaatcatttctgggataagttttttcagtagtctaaattttataaaatgatcaaattgtaaaaaatccagttgtaggaggtcggtccaggtcaccggagctctccccgacgccgccagatcctgccgccggagctcggtccgccgcatcctagatcgatcctgcactgcgaatggcatccgcagcaatggttgatgtctctgcacctggcacacagtctcgatatgccgtgtacctcagcgccgctgacaccacgccttgttctcccgcgtatccaccgtcgctggcttcaccagcttgcaagctagcgaggagaatgtgttttactaggtaaatgtcgggacagcacatagcatgaacctcctctgttccagcagctaagcgtgctgagcctgtcataccgaagaggttagcaggtatcaatctcccaatgcttcccaagcttatatgtatattcaccacaagggcaaagaatatgaaagaaaatttgattcttggctcatgagagcttggtggagggagaagcatgggattttgttccagataaagaagtggaaagcagagtaaaataagcagatggtgatatatatatatatatatatatatatatatatatatatatatatatatacatatcctcgtatctctcttggtgtgttcgtatatctggaaaaaaaaccattcagatacagtttagaaagtgagcacgtgcaagtatttaaattttacttggttgtattctacaactctgctttctctcttggagtgggaaaagaaatgaaaaacataacaggaaaaaacatggtcaagctcattgactgaaagtctgaaatttgattgtataatgttgcattaaattgcatgagatactctctgtatatgccgattgctgaaacttgccagattagtcaactacctcaagcctgattagtcaggagctccaagttatatatatcgagcagatcaataacaacatcatatatataacctgctaaaaaaaattccatttcattctttccaataaaaatattacatttccttgcaattaaatctggttgttcttgacttgtgggtcttcattaatattcgtgcaggaaaaggaaatgccaactccaattgctgataactcctactgtacagtataaatattatactgtagttctcactaattaatcctagtatatatacttatgagttcaaaaagaaaatcctaatatacatatcaattccttaatctcaaaacatcctcgccgccagctaccccgctataaaccatatgtgcttccctttttcaaaaaataaatgaaatatttttgcctgcctcaattgaaatcaatttggggccaacaccttcacagattgctacaacttttttggagagagagtagccacatccaagagccgtcattgtctttgcctgtttctaacttgctaacttccagatcggctaatccaaatgcagctcggacccaatatcctggtgcctcctcttcctaatcagagtttacaatcgccttttttttaatgttctcgtatggttttttttcaagaattaattatgtcgagcaattcatgacttggttatcaatgaaatcaatgaattggcctaaatacaagatggtttgttttcttcccaaaaagccatggctgccgagtagcatgccggtactatataggagtatttatctaggacacaagagcacgagtggcgagcgagtgcaaataattgtgagatgagttttgtgccttcatggtcatgcatgactcacaagcatcaattgtccaatgtccaccaaccatctgagcaccttgctgttaactcacctgttggcattatgttttaacagtgcaggtgcatcaattcattcagggtaattctaaatttactacgggactaggcgactaactatacatttgtcgtcaaattttaacttaaaattttttatagatataaatatagtacaattctgatgtagttaaattgtaacttccatataactagagtgtataacttgtacgtagctttccaaaaccccttgatgacatgctatttccatgagaatggagataatggtaccgaatctcctcacatgtgtttgggttttaatttttttactacctcctttacataaattttaaagcaaatcgaatgattcaaaattatattatagttacatacgagttatcatataattacatagcgattgtactatatttacgtctcaacaaatatatagcaaaatcgtttactattgacaagtactcggttttacaaagcctttttcttccctttttgccatctccatgagccttcctttagtgcgccaagttaaccccattcaaaaggtactatttagcctaggaagtgcttcctatagactaggggtaaagtagattgatcatttttcaatagtaaaactggaattttcacatacactactagaaaaagcatttttgcagacatgggattttttttccaggtgaacatgactctcggagctaaatggccgcctacaaaatataaaccgggttgaaactcactgtccgcctgcaaaaatctatagacacgatggaaatggtatttttatatcctgcgaaaataccgtgcggaaatttatatccacacaggcggaaaaatatccttgaaaaaaaaccctttgttaatcttatgtgatccacctgcggaaattggcgtgaatataaatagacacgacatggaagcaagaatttttctaagtctcagctctcagctctcctctccctctaccctctcttccttagctccatcagcgaccggtggtggcggggtcggcagcggcaacggcgaggcatggggtcggcgacggcgacgctcggggacggtggcatccacacccggcacggctcccttctcctccctcctagatccggccgaaggggggagggggaggaggggtggcggtggctacccctgaaggtggcgacggtggcggttcccgtttctcctagatccgacctaaggaaggccaggggagggcgatggcggcggcggcagtacccctccctcccagatccggacggagggaggccgggggaggacggtgacggtggtggtggtggcggcggtagcagtacccctccctcccagatccggacagagggagagagagggtggtggcggtggcggcgctcctgcatatttcccgtaaccctagatcggtcggaggtgggtaggtttgctggtggggtggcgcctttgtcgagtaacttcagttacatgcatgaacttcagtgaaccaacttgtatcgatacccatggtatagctatccaagcttgcaataatgataggcctacaacctacttcgtgcagcgatgattattgtctccaaggatcatcctaaaatttaatgggccgcaaggtgttaagtttcaacctatttatgaaaaaaggagttacaccctgatgatagcaagaaacagtggagcacgagtggcgacaacataatatgcacaggtggcatggcagttatagtgatagcggggtggtgtgactgcggtaggttggactagctcctacctttttatgatacagttagctgagtcatattgggccgatagatggatggatgggccatttcaggccttattcagtgggatttgttagtattaatcttgactagtaggcgtcatatactcttgcacgtgttgtgtatgggcagcaacgtgatgtgtttgcatggtagactagctaatttgttagtacataattagttagtgtgtgtgtgttttgtatggattagttggagcgatttctcagggttgttagctgcaacaaaggatagcgggcgtctcatgcggaccgtggagcacgacatgcagtagttagtggctgtgcatgtatggatcgtgcgagcgtatatgtgcgtgagactcggccagcaggacgttgctcggccttgggccttataagctccatgtaattctgtgtttgtgtgagttgggaagaaacagaaaaaaggcgcacatcgctgaaactgcttgcgtgtgtccactacagcgcgtgtctttgttttgtatgtttagtgcgagtgtgattcttgtgtgtgtgcgctcgcgtgagtttgctgctccgtgagttcttcgcatccttggccaaaagctaacaggattcactcaggggctggaagagtttgagctccttctcaagactgtcttagtacggtcttctctgcgcctgtactgcaagcaacttgagcacatcgcctctgattcggagtaggactgccaccgcatcttttgcaaggagggtagcgcatctgtgagccgctgttatctggtctgttccaactttgttgttgacatcacgatcagattgtatgacactaacttggacacatgttcccggccggtgcccccttttcctgatcagagtttgcaaatgaaacttggccatcgtattgcatttggcacttcctatcctcatctgtttttcaaacaggagctaatgctagctgccatacaattgacttggttgtccataaattggcctaaatacaagatggtatttatataaaacaacatcctgtgtgaatgcaaatacaatgtgccggagtttgtaaccatgcatgacgcacaggaataatctgtgcaccaaccatctgaggaagatgccatttacttacttctgggttttttttagaactcatgcattctttttataacaagaaactaaggtttagaaacgagggcttttatggtgcttgaaaggtatttcaagtacctcctctggtataaactttctaccgttcatccttgaagggtaatttaggaatagaaaaacataagcatggatagtttggtaattatttttagctgtgacctttagaactctactaggttttctgtgcactactagagaaagagaaaggggctttactcccggttgggaaccccctatacttccggttatataatcgggaccacgaatccgggacaaaagatacccatctttattcccaggtaaaataaccggagtaaaaatccataccaccgagacttaaaatggagccaggctagatccggttgctgtttttttttctttttctcattgtttttaacattgaatattgatttcattccattcccaaatcatctccaaattgatcatcacatcacagatcaaaatgatcctctccaaatcctcaaattgatcatctccaaatacatcacaaattcttaaaaaaattacatcacaaatacatcatatattcacatcacacataagtcaaatacatctcagatccgaatcacaaattctcaaaaaaaatctaacatgcgttgcccgcctgctgcgcccccctccacgccacgcggttgcctctgcgccaggccaccaccaccctcgtgccgcgctaggccgccgccgccttcgcccgtgtcatgccggctccgccgcttcgctattgcctctgcaaggaaagtggggataagagcaagaaaagaggagaggataagagagagaggagagggagagaggaggaggatggggagaaaaactttgcgatagagcatttgaggataagtcatagggattatatacgacgggttgaattttagtcccagtaggtattactaaccgggattaaagatctaaataatctttacttccggttggtactaccaaccgggactaaagttgtgatctttactccctgttggtagtaccaaccaggactaaagattcttggccccctgacaggtctctgacatgtgataaaccgggactaaagatgattttttgtcctagttggtaacaccaactgggactaaagataattttttttaaccgggactaaaaataaaatttagtctgggtctattggggaaaacagccgacccagtaaagatcacttctccagtagtggtccgtccctgtaatttgttccatatccataggtagtacttgtcgctaactgaataatacataactaatctcttgtttcctttactgattctcatctaaaattggattattgaaaatatcatactattatcttcgattaatctatagacataagaagcagtggccttcccttcaaccattcgttggaaccattcattatttacgacagtttttttttgacttggcattatttacgacagttgatcgaggagcaattgttgccttcaaccaaatttactgaacatcctgatcaacagccgccatgacagataattaccttcccattgagccatccaaggttcatatcgataatgtctgctctctcgatctgtctgtgtatcggctctcacaacggcatcagatgattacgcatccaaaaattactgatata

SEQ ID NO: 21001 - DNA, 20183 bp, Oryza sativa
ttgtatgtaatcaatggctgccatgccttccaagcaccctagaagatctctttagaaacatagggcatgagttatgcttacatctctcttgggaaaaagttcttttttttttacaggatagcctgacagttggtagatgtgagaaatatctgaacagtcaaaatccatttgattttggctagaggattgcctagcaactttagccaaagtgtctgccaccttgttcatttccctagaaatccgttgtattttgatctcccttccctgcaaaatagcatgaattttggacagagttgggtctcaaagaccagtgccttggagtaaatgcatggagtatctgcttctttgttgctgcagcaagaacatctattcagccagtggctctgcagctagtcaccattcccaattcgcacctcgcaagacaggggccaaggaagaaatccactccaggaaggagaagcagtgcggttgccggcagagccttccagttggcttgtggctgtggcaaagcaatgccctatcgctccgtatgtataacttgaatttcagttccctttgcctccaattcctgttgcacttcaccggttcaaaccatgaatacaagacaatagtgatattttgagaaagggcatggttaattactagcagctaaaatttttatcataccgctggctttgctacatatgtgtagcctagatggtcaggaacacacatttgtatcatttgtcactggagcacagacaagtcatcaactatatactgtatacctagctagatgtcctctccaagctttatagggggggggggggggggtttcaaattaatctcgtcatacttggtcatagactctgagactcataattcaatattcagttattttttcattatagaaaaccaaaattattgcacttggcagtctgaccaaaccaaaaatattattttcccttggcagtctgacttgtattactctgtcatgacattcactttactgattgcaaaaaataattaagcggtttatttatttttagacaatgaaataaattccaacctttgctcgagtagctacagccaattattaaaaaaatatgttcaacgacgagcacaaaccactaagtccaaactagcataataaaaagaagcgatgcacaaactaatgaccattaacactagacaaagatcccgtaattacggtatcctacttgtaaatcttaatccgtagttggcaaaattttacacaactgttgcctctaggtaacaacatgcagtatacataagtttgttgtcctcatcacacatttatggttgtgctgcttaaaactagagccaacacgttgccctgaaaagtactacctttgtcctataaaatttgaaattctagctaatttaggacaaattaggaggatagataaatgaccgcaataaccttatttaatgaacctcatatatgcatacattccatatcgaaaattgattaaaaggaattttgagataattaaccccacataattagcattcttaaattacttgttggatcccacgtgattagaaatacattttttttggacaaagcctcaaagctagaatttcaatttttatgggacggaggtagtacctgcgagatttatatggtgatttgttaaaaaccaaatcatttctactaaatcatagagcccaacattagcagatgctactacaaggataagtttcttagtttttacatcaatacccacaagccaatttccaaagatatgaaatatactatgtggagtatttagaccaaaagaaatttgtatcgatctccagagattcacatgcttgttgtggccaatttgaaacttaaatacttaatacttttgttactctaatatgtttatgtcacttcagaatagatgctgaagccacagagttgttggaaaaactaaatgagaaggagacctgtagagttcatgctcaagaccatgcaaaaattatagaaaggacttctgctgcaaaccgttgaggtgttacttctattgaattgtattcaaattgagtaattgatttgttttgctcattaattttaccaatgagatgttcacatagactttctcgacttagctcagtcatttacatacagtctcatgcacatataagattgttcaggcttaatttcaattattttatttgcagctttgttgatcctagtcttattaagcaaatgctgagttgctgaccatgatagttcacgaatctgaacacaacattttagtacgaaggaagtagatatcctaaaaagaaaaaaaattctttcacacatcctaacaacaacaagattagtgcaataccatctaatcctcctgccatgtcttcctttacaatctgctcaggaattggaaacatgttcatctttcgtgctgcttcaaactcaaatgaggattccaggctcaaatgttcaatccgtcacagctactaacccagctccatgggtagccttggacgacaacgccaccaaggttagatcattcatgctgcgagagaaaacacacatttttcactactgcatcaacatgattgcgtgtacgtacagaatcggatcgaggtgttactgcgtgtgtctcgattgatttctcatgtctcccaatagctcgtgttccttgcatttgattcggtccatgtattaaaaaagaaaaaataataagaaaaaattgttctttttggtcgcattttgatctatacgtgaaaataaactaaaattattatttccggtcacgttttgatctgtacgtggaaaaaaaagttgaccgttttcttaatgattttaatacggtatcgattaattgttctctcacgtgtgagcctggcctgccgcgtgcaactactatggaaggccatttgagacattttttatcactgtttgtttttctatagaattcacgtcgtcctttttctgtttttatgttctcgagaaatatacacacgcttagatttttctgtttctcgcgtatgttctttatcgtgaaaataatgtttacttttataaaaaaataaactgtacacgttaaaaggtgaaacggttgattttcgacctatagtgtttgggacttttttcccccagatcatagttttcataaaatattttagaaagaaaattatgaaccactattttagttttgacaaatggacacatatgatattaaaaaacatttatatatgtatgtataaatgatttatttattatgtagaaaaacatatttgtttaaaaaatataaaacctttatgccatgttaagtaaaagtataaaatttaatgtgtcattttatacataattttttaaaaaatccaaacaagtaaagtaaattttgagatttatcaaaattaattagtttaaatatattttcttttggatttgaatatttgaaagatcaattatttagtatatttagagttgtttttaacatatcatgtgtaacaaaaatataattttggctcaggaggtattaatgatcctattccatgacataagaaagcaaggtttctttctttatttctttgttttggattttctttgtataatagtttcagatttactgtatattctagagttataggagtagtactgagtagcgtggtatatttaaagaaggaaaataaatgcaaattcgttgttttagatttattttttgcttaacaattttgggtttactatatactctagttataaaagtagtaccgagtaggcgtggtatatttatagaaggcaaatgagtagaagttcgtgtgattggaaaaggaagatagttttggaaacctctagaatccatatgtgatatttttctctagatttttcctcacatatgattgttaggttttttttctctagtataaatttatgatttccttcaaaataagaggtaccacgtgtaccaattgaaagctagcaaaagagccagttttagattattagataggacgtgctaatgagcgttattgggctaggtcgctaggaggacagatcttgggttttctttcttttggctcttttttttcgccacgtggccacttctagtcacctctactaagccacatattttctctaccattataaaagttgaagtttatctcactttggaacgttcgactcctacatggtgttcgcctcttcccattcctatatacgtgcatcgtcttccatcacctccgttcgttgtcgccctttgcgattctgaaaccggacggtattgtaacgttatgatggcaatgtctccgcgaagtttcccatgtcccattgcatgtccgacgtcttctccagtactcccacttccccaacaaccaccctcactcctatccaatcgatcgaacccacgagcttagtatagggagatcactaccatagtagagctgatttcatgtcgaacccggtaaacataaacacggggtaccgcatcttgacaaaggggaaggtggcgtgcacacaaccctgccgggtgggggcaatgatgaccatccctctttcctttcacattgtcttcccactcagtcatttactggtcatactttctcttcctctttaccttttttacagccagagaaagtgcatgtgcgttgcaacggaaagaaaaactaatttgaaattgtaccaccatgcataaataaataatattcggtcacaacgaattgtgacgccgacttgtgtagctggctattacatcacccatcacccgatcatagaaattgttagtttcacgcttcatgattgaaaaaaaatcctaaattagaatcacatcactttatgatagggaaaataatgacacgaaatcataacccactttggtccaagcaaggatattaggattttacttttcctccttgatttcagcccgacactaagcctggcagacactccggccggtgagagatgacacgctcctccctcgtcggcggctccatcgtcgtgtggccaggaaccatggctccgcacatccccttgcggctgtcgcgaccgagaaaatttgcattttcctgaacgctagtatattaatctccgtcctagaaaaagctagggtacaccacacaaacatgatataaaagacacatctttattatatcgataatacttacattattacaaaggcgcttcaggcctgacaataaaaaaaaataaaaaaataaacagcagcggactagcgggcctacggctccatcttcacaggcgctcaactggggtataagccagggctccacctaagacttcttctccaaagcttctcttactgaaggggggaaagatagagcaagaatgagtacaaccacagtactcagcaagccacaccggcagatgcatgattaatgcaagagggtacaaggggaaataatataggggttaagctttgtagaaaacagcatttaaaagtcacttagttgcccaaagctattttataaagacgatcctagagctacacaatattattaatcaaggccgtgaacccacacgaacctgccttaacccaaggcctacgatgattcagaccgaacttgcaacccgacctgggccccagctcgtcccaagccaatcaggccaaccattccacattttagttgttaaacaagttttaagaattaaaccactaacttaggtacattgctaggcttgcccaaatccgagggcgcggctattcgaatagattgtactctgatcagaggtgtacatctttacccacaagacacatctttactccgcattccatggccgtggaacccgtcgtaaaggatgtgacataacccctttacccatcctagccgtgacaaaagcaccgacccaacctcgcctacggccggaatcccgagacaggtaggtaagattgagcccctagcagcaggacaccggccctgtgccatgacatctcgactaccgagccgcagcccgtgtagccttcatttgccctagagatgtccatctagccccgacttcgtccatctccatctgtgtactcttgccaggactagactgagcaccgggttaagccttacccattagacatgtggttagtacggtagtgctttgcaacagaggcccgaagactggtccttatagtggccgaggtgctactagcagaacaatgcacctcgagcccagcctaaaaccattttgagagttttgaatagagggggggaggtgtgtgttcaattccatcacaagccaaccattccacagtgtccaaatgatatgagaactcccacagtctaaagttataaaaccacctagtgttgcctaattaatcagcgaagcatctatctaaattcatactagtggaaccattaatagagtacccactagttggggttttgtttatcctagggtggagaaggtaataataacaatagcaataataataaggtcataacaaaggtaaataggcatagctaaataaaacaatgataacgcgggaatttaagtaaagcggtaatgcaataatttaaattaaaataattttataaactaggattcaatatgctcaagagtgatgcgacttgcctttctcagagagaacggccttccgaaccttcggcgatcaccgcgaaccacgcttcgagaacctccagaacgacagaagctacgcgaagtacacaagcaaagttacaagcctataaagaagcaataaaaatacataaaaaaataagcacatggttctttagattataacaaacattaagagacttgaacgggtcgattcgggattcgtatgaccaagacatggtcattcgaagtttaatgctgtcacgtggagatttacggattattgtaattaggttttgcaattataaaacatgtgtaagcgcttgcctggaaaagacaggaaggctgcgcttgttgacatgcggaccccacatgtcaacctaagggaccacggtacaccgagtacacagagacggtccacgggtcgacggaagcggaccccgtgtgtcaaccgaggcgagtggccgacaaacggactccactagacaccacgcggactacacacgtggacaccacgtggctaccgagcgggcacacaaacacggtcaccacacgcacccacgaacgactaccgacaccggtacacgggcaccggggtcgacaaccgcacaacgggcgcggggcgacaccgaaaggacgaggacgggggcagcgagaggaggcacccttaccaccacgcaacgaggcgtgggaacaacgacgacgaacgggcgcggcggagacggcttggggacgacggaggcgaacggcgagggaacgacttcggcggcgatccttggacgaaggcgagacgcggccagcacaacgcttgacgacgcggagccaaggacgaagacgacgacggggctgcagcaaccttgacgaaaggcgggcgacgaacagcacggcttgacggagggacgaacaccacgactaccgggaatgacgggaggacgacgatgggaaccggcgaggaggcgacgatgaacgccggcgggttcagctgaaggggaggcgaagccaaagacgacatcgccggctcgccgctgtgatgccggaggtggtggtggcgcggccgacggcgcacgggtggaggaagggccgaccggggaaattccgacgaggcggatggagaggccagcgcggcacggcggtgttccggcgaaattcgggcaacgtggtggcctggccggggaagaggatggcgctgttgtgccgggagaggaggcgacgacgacagccgacgcactggcgaggtggcacaggcggctggggcggtacagtgccggcaacgccaccaaacgtcgacgaggacaccgatccggcgagtttccggcgaggatacggggaggccggggaggaggatggcgtcgcagtgccggggaaggcgatggcgacatcagacgccgcacgggcgaggcggcacaggcggctggagggtggctggcaccgaggaaagagaaggaggaggcggggagaggtggtgtggccacgggggagctcgggaaggggctaaaacgatagaacggagcgagggggttccattttataggatggtggagggagccgggcatgggagaggtgggaacggcggcagaaaagttggccggcggccatggaaagcggccaagattggcgcgggcgttccgggtgattaaaagcacgaatcaagaggtaattaagggggaaagagaggggagggaaaggggattaattccccctaatcaattttggaattagtcatttgaatcgagcggatttgagggagaagaaactagggttcacgggagagagagaggagctgtgcgggaggaggacgacgacccgggtggtggggcccacgcaggcgcgccgtcagcgcgcgtgcgacgcgcgtgcgcacggctggctcggctcggcctggtttgggccgggcggctgggccgagagggaaggagggaggggaggggcaacccacaaagaggaggagaggaaggaatgggccgggaggggaagggtaagcccaagagaaggagggagagaaagagagggagagaaagagagggaaaaagggaggacttttggccgcggcccggagagagtgggaggacttcggactcggcccaaaggaggaaggaggatttatttttatgttttctttttagtaaactctgataattgtttttgttgcttaataatattttcggtgctctgaaaattcaagtaaaatttgagggctctttttagaccacgggaatttaacaaaaaatctccggacaacattcgaatttttcttgtacgtattttagtgtttgccaatttcttttcgaattttaattaattctattatttcttttagagaatgatttttatttcaggatgaatttatcacgggcatgacagcggcttctgtctgctgaaaaaaatttagaaatatacattttttccgtggaatttgtaagaaagtactgaacatgagaagatttgtgaaaatataccaccgtcgcggtttggtttagcgagagcgcggcgtcgcacgcgggatgcgtgagaacgagagcggtatcgctgtttagataagcgaggacgaagtgccggccgtctcgcggcttggagtaacgagagcgtcagcactctcgcagtatgcgttagcgagtgcgatggggcccagcgttgctaccagtttcctggcgccgaaacgtgagagcggcggcggtctcgcgcctgggaagtgcgagagcgagcgggtgccgcgggtctaggaaagcagcgacgggacgcgcagtcttgcacgaaggtaatgcgagagcgccgggcggtctcgcgcggtgggaatgcgatagcgccacacggcggtctcgcggagtgggaatgcgatagtgcacagcacaggctcgccactgcgccgaacacgagcgatgtgacagcgctgtcgcttgtctgatttgcgagaccgcgctttgctttccaaattagccagacggaaacagtaatgtactgattattaagttaattacttgtatatttgcatgaattaacaacatgtgataatagcattagtttttaaggctcattagtaaatatatatgagaaaccttctgtatatgtactacaaatagaacttccattatttaaactttgttatatcaaataaaaaatcacattagctacaaattaattgtaacatacaattagtacaaattaattgtaacttaaaattactacaaattaattgtaactttaatttaattttttaccgtataaaataattatgtctatctaatttttaaacccgaactgactctaagtcatataacagaaactacctccattatcattatcctacttaataataatatactatacattattaatattttatatttattaacttcatatttttatatttattgtttgccctaaggaccatgtagctttgcttcacggaagaggctgttgtcttgttcgaaatataaaatttaccggtctcgcaattctaacaaacgagatcgccggtcccatgcacgctgtcgcattgctaatgtgcgataccgtgtcggactaagcgccaaccagaaaatcaccatgggacccactccacagttgctcttgctctatgaaagcgcggtaccgagtccactctcgcgcttcaggtgtgcgagaccgcgggtcccacgcacatctcccgctcgccagtaatgccacaccacgggccccacaacactacggctctcgcgcgttgaaaaagcgataccgattccggtctcgcgagggcaatcagtgagaccgatgggcccattcctgctctgtctcccaaatcgcaagaccggattgggtcatctctacgtggcgctctcgctcaacggaaaaacgataccgatgcggtatcgcttacccaataagtgataccggagctgacgtcacgcttttgcttattgatattgcgataccgtgtcgatttcgctcagtcccgttgcgaacctcggtatcgcgctttcctcccgcgatttcgatagtatatttgtgcaaatcgatcggcatcaggtatatttatgaaaaaaatattcatgaacagtatattttcaaaattttttctctgtctgccgtccacttcccgaggtgtgcatcggagggccggcgcactggctgacggcgaaggcatcccacctccctaagacagccaccgcagtggcgtcccgagtcgacgacaacgacgtcactgaggtcatcttaacaagaccatgatcgattggtgctgtaacttaatttgttcctccatgcaggtatactcccttcgtactcatattaaaagtgagtcggttagaataatatttaagtcaaatcttgggaaaatgtaaaattatatgaacagatttgtcttgaaaaatactttcataaaagtatacatatataactttttaataaatatttttatagaaacaagaagtcaaagttatgttttagagaccgtgttgctgtccaaaacgacttcctttactagtacggagggagtatacatctgtatgaaaacttgctctctttttgtttggatatataaattccatgttatacccagttttagctgacatgacactgtgttagggtgaacccacatgtgagcagccggtctacctactcctctctcctcttgctctctattcgccatccctcccaggcttctcactaggtgacggtgggtggtgagcaacagggagaagagtgatagctgacaggacaggagctaggtggtagcacgtcaccgagttggaccagtcgccgaactggaaggtgacggatggcaaacaagaatgggcggcaggcttttggggtggaccatctcaccctcctcccccttcccctcccacggcaccttcggttccccatctctcttaggaaacaagcggcggccaaaaagagaggagcaaagcgcccctctttgccatgactcatcatctttgccgcctttgggtggatcattagtgcaaagacaaatggtggttcgtcgacatggtgagcggtgccatccgcgcgaaccaacgctcttctatgcccaacaaccactagttcacctcctctatgtccacatgccgacaggcaacgtagccaccggtgcctcctcggcgcaaagggtagagatggctgtctgccacctaggtggaagccgacgactagggtaaggatcactgcaacgggagctcgccttcgacgcctcttcccatgggaactacgtctccattgctgcttcaagacaacggtgggcgtcacaccggcttatgccgcaccctcgccttcctctgtgctcgagcccacgcttcggcctcgttggctccccgtctagacaatctttcctgatgtctagggatgggtaattcaatggttttgacatcctttaagtaacctatacaacattcgaattctttagtagtgtattcctctattatcgatctctataggtgagcacgattccgtacatagccattcataatagacatgtagcgctcgtatcccatatttgatgtaagtataaaggaccaagttcaataatctgagagacaatctaaacaattagatgcactatcatattgaaaaataatggagcaaaatacatctcaagctggcatacggtctctttcacaaatttctacaatggccccaactccaaagtatcaaataatttctgtgaaattcaatttaaaaagtaacatatatttgtgatcaccaccttaatctaaggtggtttgattgcccttatagtattagggagaaagacctgttagcatcacatgacagtcatgaaagttgtatctggatatggtcaaatctttcatcaagactagcttcctaatgtttgatgagaaaccagtagacaatatcaccgcatgtaaccatttgcataatgcattcttctcttctgatgttgtaaatggcaggaggagctcaatctttgcatcaggtagttcattaggttgaagttctattcttatagccaatttcgtcacagtctatctttcgtcttaccatgttaatctttactactataattcatgaacctgtttccgcagaattttggacagtcatacatgttcgtcttaccatgttaatctctactactataattctgcatgggtccaaactttcctgaataagacaatattttccaaccttttcttcactattgttgtttgagcctcctcgattctactaactgagctgactaagcttgatgcattgatcactgtagcacgtaccatcctcctgatgctttccaagctcaaatccaccatcatgagaaacaaaatcaattctaggtaattctttgttttggagaattgtgatgcatgcctactatgactgtaatagaatggaaaaggcacaaatggcgagacatatatatatatatatatatatatatatatatatatatatatatatatatatatatatatatatatatatatatatatatatatatatatatatatacacatatatatgtatgtatatatatatatataatatatgtatacatatatgtgtatatacatatacatatatatatacatatacatatacatacatatacatatacatatacatatatatacatatattcgcaggcggacgttggctagtccggtccgcctacgaaaataggaatcggccgcctgcaaaaaaaaatatccgcctgcgaagataggtagaaatttttgaaatttaataataatttgcccgtaaatttaataataatttgcccgttaatagaaattcttgcaggtagattattatgtacatatattggaagattatcaagcattaggtactgagaaatctacatatattgcataactcaaaagtgttgccaatatatatatatatatatatatatatatatatatatatatatatatatatatatatatatatatatatatattactatatttttttatattgtcacttcaaatacgccatctagttacattatggcatagaagtgttccactcccgaagatccttgaattcgtcacttgtcactagggcaccctctgggtcaaagaaatctcctttcacatgacagcactcatggtggatgaagtggcacagatcacgctggacatttgtgatgcctgtatcgtcaaagcttgttcgacgttttaatcttggcaactgcatgcattgaagataaacaatatattagtatcataaatatgtgaagctgtctagtacatagtacagggacttacatcctctgcgttaaccctgtacctcttattaaccctaaggaattcgcacgggtaatacccgcaaaggaccgttcctcgcggttgcttgtgacacttcaggacatatcatacaaaaaaatagttaaaatttgcaattagtgaaacaattggaatacattaagtgagtggagtattaccggccaataggtacgtactagtagcttctcccttgttcgggtctgttctccacccttgaacttgtagtattggtacgcactgtacggatgtcgtacgtttcacattaagaaggatatttatttataatacattcatataaaaatgcaagagtcataatcacttactactgtaagattgttagaaattctttgtatgactggtgtctgttatcgagagggtccaagactaccacagttccgtctttaaggtagatgagtaaacagatataatgatcgctacatattaacaatatcatagttagttagtaccagctaaaataagacatatgtgtagaagataaatgtaccgaacttacttaaaattataagtggctatgactactctcttatttggaaagtgcaagaaggcttgtccaatatactgtgcgacaataatcaatttctccttgtgcaagcccttcttgtattcagctatctcttttggagtcttgcccttcagctggtctgaccctggtgctagcctcacggtatgctgtggttgacagatccgagttggatccaagaagccgataggttcttttttcttcttagcatccatgtattgcatcctacagaagaagtttgttagtaacaatcacatggatttgtattgtacatatttttcatataattaattaaaactcatactcacatgcacaaaacaccgacatagttgacgtccatcttatcccgacgatatatggcgtggagatctgagaaatctagccatacgtaaccttcggcgccgaagcaatctaccggtgatcgagctgttatatttcccaaccctttcttgctgacctccatgtagaaggtatgtaaccttctcatctcccatggtccttcatttagtgcccaatccggtaagagtgctttcccatgttcgtacttttccgggcaatcatcagttgccaagtttgttggcccggctagttcagtggccttctggggggtcatcatctctgagtttggcacgttccttaccacctctgaagacggttaccatgaacttctctttgttctcatctttggacttgaagtcgtggctcctaagcactctaggcacctcagaactggtagtggccttctcagggacaatggtctcttgcacctcggcgtcttttgtaggaaaagggtcttcaaatatttctggctctgtagtttgtccctcaggtaagtataggtctcgcaaccaatctatgaagagatgcttgtgttctttcattatccactcggtggtgtgacccttattgttagctcgtagtagttcgatatgttgatcgatgtagggctcaacgatagcaaactgatgaagtacgctgaagtgagcttcttgaaatgatttgtgatcatgggcgatgaatctcttctttcctatcgttcccctgccactctatctgccctcgtgtcggggcacaggtactccaattgcatatccatctttgagctaatcgatacagcactcgacaacctcttcagtactataaccctcaaccattgatccctctggatgtgtacgatttcggacgtaacccttcaaaaccgccatgtaacgctcgtatgaccacatttgatggaggtacaatgggccaagcacaaccatttgcggcactatgtgaacaatgaggtgctccatcatatcaaaaaatgacggagggaaacacatctcaagttggcactgtgtctcatgtgcgaatgtatggagatttcctaactcttcgagactaatgaccttctgtgacactgcgttgaaaaagtagcacaaccttgtgataacaacctttaaatgctccggttttatggcccttattgcaattgcaagaaacacggtgagcaagacatgacagtcgtgtgaattataaccagataccgagaaatctttcatggaaactagtcgactgttgtttgatgagaaacctatgggcactctgacatcacggagtgacttgcaaaatgacttcttctcctcagatgtcagtgtgaaacaggctggtggaagatatactttgccattcttctctccttcttgagggtgtaactcttccctgattcccatctcgactaggttcatccttgattgcagaccatctttagtcttcttcggcatgtccaacaatgtttcaactatattgtcaaacacattcttctccagatgcatgatgtctatggcatgccgaacctccagatctttccagtacgggaggtacttaaagaatatagaatgcttcttgaatgggggagggagtttatcatctggcttcgaactatcatcttgcttcttactatcctctggtttcgtagtcttctcgggtttcttgcactttgtcccctttgatagtttcttagtcacttttccaaactcgcaaacaattttctgtcattgcacacactttttcccccgatgtaggttttggtgtaggatcagtctcttcagttccatcgaactctgccttcatcttgtggtacttgtgatttgtgcgtaggaaccgccggtgccgcatgtacacaagcttgttggaacccgggagatacctatagtacgttccattcgagcagatcacacatcctgttttacctttaatttgatctaaaactgaaaacattgctggataatcgttaatggtcacgaagatgatggccttcactgtgaagtattctcttaagtactcgtcccacactttcaatccctctttccataaatcagccatatcttccaacaatggttcaagaaatacgtcaatatcaataccagactgacggggtccctgtatgaggatacagagtagtacgtattttcacttttgacaaagccaggtaggaagattatatatggtgagaagcactggccaagtaatatgtgagctgctcatgtctctaaaaggattaactccatcagtactcagggcaaatctaatgttccgtgggtctttagcaaactctctatactgagcatcaaagtttatccactgacgagcatctgtcgggtgtcgaatcatcccatccttcttgcgcccttcttcatgccagcgcattagttccgcatctcgcggatttgagtatatccgtttaatgcggtctttgacaggaaggtaccacatcacaagtgtcagacggttctaggcccgtattgctattcgatttgtaccagctagcatcgcatgttggacattcatctaaacaagcatactctttcctgtacagtatgcagtgattaacgcacgcatgaatcttttccacaccaagtgaaaggggacatatgagtttcttcgcttgatatgtgctggatggtagtgagttaggcatcgggagcattttctgcagaagttctaacagacagtcgaaactggtatcagactatcaatgtctcgcctttaacctcataagttcaagaactgaccgtagtgttgtgaactcactgtcacagcccttcgactcatcatacaaaacttccttagctgcctttagtaaagcttcaaagttatttaaacctctagccgaccccatcagcacctcgggttctgcatgacgtaacatttcctctagatcgattttgtcctcaacagaaccatcgtcgtgcaccaggtcttcaacttgtgtcggaactacatttttaggcccgtccacttgttcttcgccatgacgtgtccatatttcgtacttgtccataaatccacgagttactaagtgctccttcactttagaagcatcttcctaggctatttcattcttacagtcagcacatggacaaattatcttcctcatattgttcttctcagcgtgtgccttcgcaataccaataaatttagacacttcatttctacatggagacaaaaacctcggccaatgatacatccattcccgactttccatatctctaaaaaaaatgaacataaaatatttgcactattaatactaaaattgtagggtttattgaaaaaaaacatatcgccattaaagcaaagtttattttaatttttttacacagacatgccaaattaatatattaggaaaatctaacaaaatcatatcatcggcatattacaaactaatataattattttttgattgcaccaaataaatagacattaaaaattttattctctctctatatgtatgacaagatctagatctagatctagaactaggaggtgaatatgatagcaaaataaaaaaaattgagaatttatgttaccacactaaatcactacaacaagagtcatcaaatattacacatacatctagcatcaacatatcaaaagaaagtaaattaaaaaacatggagcttttccttcacaattttgcatgcataaatacatcacaaattgaggtctaaaagcttaaaaaatgtatacctagggtggaaatgagtagatctaagcaccgtagaaaacctcccccctatatttaagacactttaggagagagaaacttctgggagaatgaacggggctcaggaaggaataagactacataggggcatctttgcagacgggccatataagcgacgcctgcgaagatcgcctgcaaagatcgatcttcataggcggaccaccccctccaccccgggtatcgtcttcgccggtggggttttggctccgaagaccatacccgcctgtgaaaatggaacccctacgacatcgaaaatgtgttttctagaagtgcattctactaccaagaaatgatcctactcaccaatttaaaagggggaaatagtattttccttatattttacgtgccgcatttttatcattaatttacatgtttgtagcatctgcttgtccccaccattgtcgtgcacacgtccctgccaacgcagtccttcaacggccgccgcgtttcaattaaacttttactccctctgtctcaggttaagatattctgattttcgtcaatgtcaaactgttttaagtttgaataagtttgtagaaaaaagtaataatattttcaacccaatgcaaaattattatgaaaatatattcaattattaatttgatgaaagtaatttagtattataaatattattatatttataatctataaacatagtcaaatttgaaacagtttgactttaaccaaagataaaacgtcttgtaacatgaaacagagggagtaatatatttcctttgaatgtatagcacagtccgacgacgaccatattagtaaaacaaaagatgagggaaattttttttgtttctaatagttgcgtaaattataattttaccgcttcatgtcatcacttccttgtatgattataccctcctattttcagattttttttaaatatactttacttttgaacattttacaattatccacatatttttaaaagatttgcggaaatatacacgtacagtgggtaggcgcgcgcgatcgatttgtcagcgcggcgttgacgcgtgggaccgacgactgggataaccccgtgccacgatagcccgccaccgtatcgctcccgcggcccatttgcgtccaccaccgcgtggtcgtgcggtctggctgcacgccacagcgtgctgcgcgccttcataccttctaggtgcatgcgtgcatgcggatgccaccggtggctcgctgcagggccgcgggaccggaacggtggcgcgggattgttccggtcatcggtcccacgtgtccgcgctgcgtgaatgaatcggtcgcgcgccctcacaccacagtatatgtatatttttaaaaatctttcaaaaacaagtgtatagaaaaatgaatattatatgatcatttttgctattctactataccattacagattatagtaaaaggtctctaacaaaatgaatattatacgatcattttcacaatattttaatatatttatccataatttttataatacttaaaacatatacctgtcattatattacgcatcaaagtacatatatcatttgtttattccatcattagttccactgccaataaaccatgatttttttcgatctccttcttgagatgcaaatcttgtccaacaatctaatatttcatatactttcttctataaaatttactgaacttatttccctctaagcatggattggtaaaccagtttaatatgttattaataactaatatcatttttactccgagctagattgttgaaaacaatattgaagattgatttataattcctacagcaaagcgcggagaatcacctagtctataaagttcatccctactaagtataattaatgctaattctctctcctctcattaagccacattatcttaattgtttttagcacttggataatttatcaa

SEQ ID NO: 21002 - DNA, 13668 bp, Oryza sativa
  unsure (1)..(13668): unsure at all n locations
gctaacatgtgccatgtgtgctgttctagatgggtgggacgacgaacggtattgcaacgtacaaaacgtgcaagccttgtggctcatctcatctcgcgcgcgatggctcaatatgcatatttcaacgtcgtcagtttttattctcgtgcaactggcgaaggttcgccttccaaaatttacaatgcatcatacgtcagattaaaaataatcttgtctcccgaaattcgtggctaattctcttttaacctcattcatttttccaatatgagaacttaactttgagtcttggacgtgaattaaagcagatagcacaaactgaaattaactacatcttgtcttgtacatgttgtatgagttagtctgagccggtgcaaccaccattcttctttgttgttcgctgtctatgttctttgcaagctcgtagctaattggggttttttaaggagattaataagattttaatgaactactggttggtaccgacttttaagaatttaaaaaagctgtattttcagcttctaatttctctttcattttctaaattctacaactagattgaacttgaagaagctgcaactgatagaagctcctccaaacaaaccttaagaattagcccaaacttgatcgccgttgagccaacacgtcttcagtcttacctgctatggatgcatgagacgccttcactctcgatgctggtgccacgatgtactgtttgctttgtttcgtgcctttgcttctgttgtcttggtcatcctgggagcttcctcagagcctcagagtagggggaacctgccggctccagtagatagggcagccacaatatgtgttgctggtttcatcttccattctacgggcttgggggttcgtactcgacttaccagaaaatacagcacttaccactctcctgatgcttcccaatcttgcattcaacttaagagaaaaaaatgttggtttcacatcaagggcaagtagaatgagcgctgattgggaagcatcaggagagtaaaaaatgtatagtcccaatgcatttatggtctctgtgacaaaacgatccagttctttttttctgaaaaataataagtctagcaagtgtgaaaaaggtggtaaataaattgagtgatttaaatcacatctagcttgcgtattagagcatgaaaaggaaaaaaatgtggtaaatagattaagtgacttaaatcacgtgtaaaatctattggattgttgaactaatagctagtgctggttccacaactggcactaaacttcgtacactaggagtgggggttatcattattagtgctggtttcaagtcgaatacttcctccgtcccaaaataagtgcaatcatggttttctgcgtctaactttgactgttcgtcttatttgaattttttttaaaaaaaatcaaaaacataagtcacgagtaaagtactattcatgttttatcatctcataaaaataaaaatgctaattataaaaaaatttgaaataagacggacgatcaaagttaggtgcgaaaactcatggctgtacttattttaggacggaggtagtacatataacttgttatggccaaggattcaaactggagacctctccttagctagcatcaccttaaactagctcacctacaaatcagtttactataaaaaaacgattttcctgtacagggacccatttatattgcagatgaaccatgactagtcgcgtttgggaaaataagcttattttcgcgtgcggtccatttaagaggaccgcacggaaactgagcctattttcacgggcggacctattaaaagtgccgcacgcaaaaataccgactccctctttccctcttacccactttaaattttcccctctttctctcctttcctcgctatgtctttttcttctctcctctcctctttcctcttcccagtcatcagtcaagcggcctcacccatctgcaccctcttctctcctcccgacggcagcggtgggcgtaggcgatggcggcggtggaggagcaggatccggcgggcggtggccaacccctgcacggatccggcggtggtgaccgtccctgcatggatccggcggccggccggccaccctcccccgcgggatccggctccctcccctcctcttcattctctccccagatccggcgaaggggaggggtgtcggcaacggtggcactcggcagcagcggcggcgtggcggcggtggaggcgtaggatccggcgggcggcggccaacccctgcacggatccggcagcggcggccgtccccgcacggatccggcggttggccatccccacacggatccgacgcccagctgccctctcccctgtgggatctgactcccctcccttcacctcccttccctccccagatcaggctgaggggaggggcgtcggcggcggtgcggccggagcccggaggggagcatggaggccggcgagagggcagatccagcggaggccggcacggaggccaccgctgccgccgacaagggcgggagcggtgtcctcggccgatgacgacgacgacgaggaggcagcagcgccgccgccggattctaggtttttcatttgttttgaaatttttttttccggatttttgtttttacgtacggatgatataagcatctgcacgcggaaatcgtgatttttgcatacccctgggtgcgtgcgggtcgctcacccgcacgcgaaaatctttctcgtagtagtggttctgatagcaaatagatatttttccttttgagttttgcccaacagatatttgaattgtggagtattatgtttgaaagatctcaaatgaaaaggttgtcaacaacaaaatcatcatgtcgatagctataattttcatataaaatttgtctcaatccaagtttgtttgaaaatattaagtttacattcaaaatcggtactaatatagccagggtcatcattgctaatttgtagctagaaccgacacatgcgagacactcattcattagtgctagtttatagctagaactggcactgataattaacacggactcgaattcgaaaatttttacaaccaaaaattcttattagtaccggttctataaactaataggcactaatgtgtgggatactagttgtggcttgttatacatattgacgttgattacccccccataatcagtgccaattaagcactagaactacttacgtcgtcatcggtgccggttcttccttggagaagtttcacttggataacctgaaaagtgatgctccggaataggggaaataggaaaagtttcacggcaaacgaatcttccctatcaaattttatttattacacgatcaagccactatgaatggcatccctagcaatcaaaagcgaattctgatatagcacgattaaatttgttcatttttatgatataatcgtttccacaccgttcaaattccagtgctggttactggcttgactaccaactcaagtgttctatccgttctcatcatggatcaatgaatggctcttaacactggattttcggtgcctcccttccctactatgccgtgtactatgtccaccctagtactattgatattctagtgtttgctcgtaacaaaattggatctttggtattgatgctgacgattaatttttttaagacagatagttctgaccattaggtgatctttggagcccagccctgattctcctgctgtggagcgttggaagggccttttgcactcaagctcctggatttgcatagaattttttagctagtcagacatgtctcactgggattcaccctggacagctctagtgctctactgcactcgaagaacatagctccctttctcgccgtcttgctgtaactgaccagataccttcaacatgtgttcctgatacctccatttcctagcagatcgatataatcccttaaatgtttcacgtaacatagctcgttagtcccgctcaccttaaaatacttcgagtaataattccttaatagaatatttgattattggtcgtgttgatgtactcgattttttttatattggcatggacagaaaagccctccattatagatgctgaccgctttaggctgcgttccccggcacgtaaaacgaagcatgtattattgcataattaatctgagggctctagcccaagggatacggttgcaacagaatattttaagttactctcccttttcctttcctctgtccacgtgtgctttctctcccttttcctttcctctgtccacgtgtgctttcctagtacctggtacctgatacatggtaccggtcggtatctggtacctggtacctttgataccaactaggtatcgaccgatacctgatgcccggtacccaagataccgggtggtacctaggtatcagaccttggtaccaaggtatcaagcctgatacttgtgcggtatcagagggtaccgtcaaaaagaggaggatacgtgggggagggagcgccgcaacggcggaggatggcatcgaggaggcacggcgaggtgagggacgtgtgctcccctagtacctggtaccttaggtaccggttggtacctgctacctggtacctttggtaccgactaggtatcgaccgatacctgatgcccggtacctaaggtaccgggtggtaccaaggtatcaagcctgatacttgtggggtatcagagggcactgtcaaaaagaggaggagacgtgggggatggagggctgcaacggtggaggatggcgttgaggaggcacgacgaggtgaggggcgaggcccgagccagagagcgcgagaagtctcgaggaggagccgaggtggatgttgacggccatacctgttgcaggtcgatgtgggctgccggcgtccatcccggaggcgcaaaagtggcaggctgcagcggggacgacggtgacgccgaggctgaggacgaggacgaggacgaggggagctcctgcttctgccctcccggggcgacgacctcccggcacacacccgaccgacgagggtggcgagccagcgcaacgaggggaggcgagctcgagggcgaccccgccgtgggttggctgacctcgccaacgcagtgccgtcatcgtcctcctcggcagccggagatgacgacgatgaccccttcctcccggccggcttcgtctccgctcggccttcttcagagagagagagagagagggggggggagagggagagggagggctgcaattctgtgtgatttgggggaggagagtgaggtaggaggagaggattcggatgattttggggagaggagtgaggtaggaggagaggatcctgtcttcatgggataccgtggtgtaggttttctgttaattaaatattaactattttttgaaaaaagattaatatgtttttttaaaatagttttgtacagaaatttttttttaaaaaaaacactgtttagaagtttgaaaagcatgcgcacggaaaacgagaaaggtgaattgtgaaaactgggggaagaacacagcgtccatggtgtgtggggtgcggttaaagcccatcacggatgaccgtcctccatggtgtgctccatcatcggcagccggcaatttgcatagagtgccacaatctccaagtctgagaaaatggattatatttgttgcttttttttcttttgtttcatgattttgaatgaaattttggtccaattcaaaatttagtttgaaaccctttgacaaatttctccaagatttcactatctcggacctggacgttttgtttttagaacaatagtgttatctagggttaaaaattccaaaatttcggttctatcagaccacccccccgtatggtattattgcagccggttttctttttttacgaatttggcaatatttttgttcaaatttaaccaaattttgttcaaaattcaaataatttcggtatatcggcgccaccaatacaaatgccgaaaaaaaaatattgaacccggtgttatccacggtgaacagaatgatctttttaatttcagcaaataaccagcttgtgcaaccgcaattctctcttggcagccgtcgtgggatcagacctcacacagtcacattgtcgcacacatggaacgacacctcttctgctcaaattggtgcttgggacatcccgaaacacatgaaaactctgatgcagtgtctcgtttttcgcctctcactgtcactgggttggccagcagcctgcgcgctgctacgggtcatggaaatctgatggctccgacaggtaagattggtgccatccctcgacagattcgtgagctcatcttgggcatggcactcgagaccccgccttgagtccccactctgaccaaattctgttgacaaatgggaagggagagcacatagcaatctcccaatgcttcccatgcttacattcagcacgaccaaaagagaagaaaaaaaaggaatacttggtttatgagaattgtgagatgtgaataaagtattgtaatctagaacgaatggcaggaatggtgagatgcctataggtatcatattcgcatacatatgtgtatatataactcaatgtgtttatgatatctaacccaaaatattcggtccagtaaatgaccaccttgaaagctgcaaatattcaaccacttgtactttctgcactttataactatattttgtgtattggagtgtggaaaagaaaaggcataagagacatgggcccattaactgagacactcaaactaagcgtttgtgtaagtcacaaaagagcatagggtactactctgtttacatggagaatgaattactgaagattttgtcaaacagttatgcatatcaaattgattgacaacaacagaaccaaacacatcctgagaacaaatatttccagttccatctaatccagatcttggcttcttgttgtgtcttatttcgtggaggaagggaaagaccccaaatccaagtgctgagacctctcatgtactgctatcatgtagggagtagcatacaatttacagatactgttgtgttccaagaaggaaaaatttattgtaccttcctcttcctgtcatactatatactgtactgtagttaccactaattaatcctaatatgtttagtcaatgttactctctccgtttcacaatataagtcattctaacatttcccacattcatattgatgttaatgaatctagacatatatatatatatatctagattaattaacgttaatatgaatgtgaaaaatgctagaatgacttacgttatgaaacggaggaagtataaaatttctccaaacatgcttgccaccacaccagcctgcttgctacaaactatctgtaatccttttgttttttctttttttttactaatggatattgccttgcttcaatataaagcaaatttgagggaccgcctattgatcatgtcaaacaattaattcataccttggtcgttgatgaattggccaaacaacctaagttcttccggaaagacatggctatatccagagtggtactattttccaaattaaaactggaacaggagttcatgcctattcaccatgatatatacacaagcataaactatccaccaaccatccgaggacagtatggaaagtataatccgaacatattaataggtgaaattcgaatcaaatatttaacattcctagcgtcaaatcgtgtaccagatctcatccaaacattacatcctgaatgcctcaaatgcatatagtttcctagacatagaattttagactatataagtccatgtttggcacaggtccagatctcagatccacaatagatttgaaatttgtgcgttgaattatagtggttcaaaatttcaaatttcatccaaaataagaacaaaacgatttatccaaatgttatcaccgtaaccgtagatctagattcttggatttgtggagttaggaatacattggattcagagctgtgtcagaggggtctaagaattcaggaaaagcaacctcagtggtgactgcaggtgacatgcatccaccatgcaagatggagttgaagttctctgttattcttcgagacactgaaagcacgcttagtcgaagcgaaataagccaatgcgggctagccacagcttggtgctgcgagtgtcgaaagatcggtgttgcgccctgttagcacatgaaaccttgactctcgctcagagttctcggtgcctcccttttctagctactgtgtgacttcgcgcgcgtgtactgtctacctacattagatgcatgatggtattaggtgtcctcatcttcacattctttgctgatttttcatgcaccttctactggagagatagagaaacttgttattccgaagccttagctagatgagaggaatgtggtggtttattgatcgcgcgaggaataatgagtacatctatggcatgtgctatatcgatatgaccttccgcatgtatatacatttggctcgtagtttggtcgttgtgctaatgttaaaatcagaactagaccagctgggcggtgaggtacaaattaaaacgttatattgatactgttttgatgacggcacatggcgattgatagcaacgggatgcccgatattccgttaggtaaagataactctcgatttggtggaaacttgaaacatatgatctgaaccctacaatcgtagaatcacgtttcctctggttattaactatgccgaaacttgattgacctcgccgagaaggctaatccctacgtgcgaatcgaaaaacacaagaaaaacaagatggattgcaactcaatttgcagataaatgattgagttatcaaagatagggttccacataccgaacttgtggccaaactgcaatgatagaaataagggataagtccattttgcaccctccaactcttcgcttagtctaaaatacaccctcaaacttcaaaaccaggtatttagcatccttgaactttttttttcttgacttaaggcatacctgaactttcaacacccattcattttaccccctcgagtggttttcagctggtattcacctgtgtggcgctgatgtggtggtctaatcagcaaataaaaacaaaaataagggatagacatctcttcttcttcctccatcttccatcccctttctctccttcctctttctctctctatccttcttcctcctacgctagaagagcagcagtggtggcgtccctgttaacatccctgagctcgacgaggagagcagtggcggtggaccaaggggttcattgcgaaggtgggaggtttttccttgtacgccattaagaaaaatggtgtctgcctctgtgccactaaaaaattcgagcccccctctataccattcgctcaaacnntnttatcgttttctcctcnnncacaccccattcnncngtcgctatnntnctgtttcggttttaaccatttggcagctctgacatgtgggcctgggaaggaaaaatatcaatcttgccctttcactctctcttctccctcgattccctttttctccctcaggccgccaccacgcagggcctaccggcggccggccaccgcccagccctcggtctggtcgtcgtcgtcgtcgtgatcctcgtcgtcggtgcgctgttccccatcctcggcccgaccggctcctccagcttcgccatgccgcggatccggtggagttcaacgaacccatccacgttgcggtggcggctccacctcagccaccgacgcagatgcaagctggcgtcaacatgagcagcaaggaggacagtggcctcccgccgacaacctccgccttcgccctgacggcgcgcttgtcgtgctccacgtcccgccgccgcagagcatcgccgcggggctcaaccctggacccatccccttcggcggcccgagtaagcaatctctcgcactcgtcttcacggaaataggacggacacttggtcctgtggctcctggatggcttcctggatgtgccgcatggctgatcaggcgaggtcggtggcatcactagtagcaagcatcaatagtcctcgccaccgtcgttgtgctggtcctggcatcactagtagcaagcatcaacagtcatcaacaccactagcaagcatcaatagtcctcgccgtcgtcgttgtgctggtcgtcgtcgtcgtcgtcgtcgcggcgctgccgcccccccatcgcgcagcactgccgccgccgccgttgtcgcagcgccgcccccctcttcgtcgtcgtcgtcatcgcaacgttgttgccgccgtcttcgtcgcgcagcaatgccaccaccatcgtcgtcgcagcgccgccctgtcatcgtcgtcgcagcgccgccctgtcatcgtcgtcgcagcgccccgtcgctgtcacagcgccgccgtcatctcccctcccgctcctttgctgctgctgctgcatctaaggggagagaggagagtgctaccagagagcatattggaccaaagggcaactaagtcatttggctgcgccgttacccaccgttataaccaaaaacgaacggaatggtatggagtgcgcgataaagatcgacgatggtagagagggaggctcgaactatttagtttcatagaggcagacaccatctttcttaatggtatacaggaaaaaacctccgacaatggagccggagctcaagctcctccccgacctgagttcccacgtgcgtggctctggcgatgtacacctctttggcgtggtcgacgcattaggacccctctgtcattggctggtgcccccaatgcagtggaaggacttagctcgagcggggcagtcgggtagtggcacaactcgcggacgccaacctcattctagatctggcaatggaagtggtgtgggcgacgacgagctcacggatgccaatgccaaatttgttggcgagctccatccatggagccactctccccctcccccccaaccctgaatgcccgaagctccacacccttccgttgccggtaacaccgctcaacaagctcgagttgaaggcggggacgatgcagcccgctccaagcgagctcacggtggggtcgatccacatccatcaaccctcgtcggagcttgccagcgaccccatcttctttgtaatcggcaacccctcttctccaacctcggcaaagggggcgggctccgatacgcattgagctcgccatcaacctccctcttctccacatcaatctcaccgccgacctccctcttctctcaagcacagcgagatctccatggccgcctcaagctcggtgagagagggagtcgaaagagcaagggaggtgaaaaaaacattatgataggtagggcctgctaacattgcatcctggagtataaccgaggtaaaaacaactctagggtgtacagtgaacgatattgaaagttggagggcgtaaaatatccggttttagagttttaggtgtattttagataaaatgaagagttggagggtgtaaaatggacttatccctagaaataatctaagtgaaacccgactctaaatgatgacggctatggaataaatatgattagggacgtccaaaggttagccctagggtgctacccccttgggttttgtccatgacacgattacaagtccaaagacccaaatcagactcggactggattaggtatgtgacttgttttacataattccgatagctaaggaggaattttaacgtgggaccaaaagcatatgaaagtagactcaataagctttccaacaaatacttatggtcccaaaagttcttctggattagcagctatgtccgtttaagggtaatgctgtcaggagtacataatcctaatccagtatatgcataacttaatctcttaccttctatggacaaaaaaatcacttaatctcttaccttctatggataaaaaatgacgtggtaatattggagtagacttgggcaagatcttggtttagccctaatcaacttctttgactatccatatatattccttgtgttcagtctctatcccttaaccaaacaagtctggaaatgagaacacacaaaacttacagtacaataatgcttattcaaatatactagccatattagtcgcgctttgcgcgactttttacatacccgtataaatgctctgtacatataaactgttacatacgctgatggtatggagcaaagcagttagaagcttccccatggttaagcagcctaagaacatattagtctcaattttttttgtactgttcgatgcacgagatgtcatgctttttaaatatttggtttgcagatctcattggatagtgaaataacagggtgattacaacgggtaaagtctctgtgtatctccggtttttatccaatctggtattgttttgtgctgacgaaattcctgtccggttcttcagagtgctgaactgcagtaaaatgtctctattgtgacttgtattgatgtctactactcttctatacaaaaatagcaataccaacattgtaaaagaagtaccttctctattttgtcatcgtgaatagatatcatgtaggcaattgtcaggaaaaataattgagctgcacctatttaatgcccaatgatctgaatgatcaattttgagttagtgagaaaattttcgatgattcaatgaaatattattgttagaaatatcaagaaaggatggcatataatctgccctcgttgtctctgtcacatccgtgctaattcaatgttgagtagtgcagtaagcacgtccacggaggttcagaaaaggttgattaccttattatgtagtttgaaaattgctttattgctctgctgcaaccatcctgcaatttgtatgcccaacaattacattggaaacactgacttttaacaatacatggtgagatggaacctctgcagcttatagcgcctgaaataaaaaggtgaagtatttagtacttctatcacaaacaacttgaatgagggattcataacctgcatgatagctctggatttccactaagatgcatgtctccattcacaacatgagttagaaaagaaaattggacaattcgactcactgtgatacacaccatgtctttgattttcttaaaagaatatcactttgcctatatccaccaaactccaggaacacttcacatggcttctctgcaaaaacatgcaatctgaggtggatatataagaagtgtaatcagctattaccttggcccaggaccaggtatatacgtacaactgctaccagtgtgttcatgctgtagattgccctgaaaaggattatgcatgagagagaaattatgtaaacaaaattaggtggttaacaccatgattttataagtaataaaccaattgcagaaacactaaaagacaataggagaagatgcttagtagattcgaactaaaagaccatttatgctctggaagggaaggggcataggaaataaagaataatggcatatcaagcaaagtagcaaactatcctgttaagtataaataatgtcatactctcaatatagaggcttcaactatccatgatccgccaaaaaaaaaacaaaccttctcctaatgcattgtatccattggttaattctggatatggcttcagctttgttcaaaagatctacaaatgacagccattactggctacaatgaatttgctgcttcctaatgaaattattgatacaaaaaattacatacatcaaatatattgcaatcattttgacccatgctcaagctttgcagagaaactcacgaattacataagtaggggtta

SEQ ID NO: 21003 - DNA, 4138 bp, Oryza sativa
ggtggctccaaggtcgacaacgacgatgagtgcgagacggcgccgcgagtgcgagaagacagagcgtcagggtgggtgcctcacggtgtgggaggaggaagggtgaaaatgaaaaacaaaagagttataaggatgtgtaaggactagaaatagataggagtttcctcaagggcctagaatatactatgccaattataggatccaacgaccaccaacgtctagagtaagaatcgaacggcccttattactttgatgacgtggcgcaatatggtgacaaaaaactttacttttttcactactttagataacacgtaagtctcacgtagaacatatacatttttatttttgatatgtaagctagccatgttctcatcagcgattttattttgtttaactataaatgaggtatgatgggtctgaacgtgttggtcacccacaaccttgtccctcgccctacacatacatgtgtttttatttacctagatgtgtttttatgtttgtctagatttgaatttcttaaatatttttatggatcgaccgaaccacatttctttactataaattggaacatgtttttggcacaaggggaaaactaaatacttggatgttgatctatcggttaaaaaaatgtaactgaactgcagaagaacttgccactcgtgctgtgagttgttcctcttgctaatgtagaaatgatcgctaatgttcctgtggtattctataaaatatatttttcgtcctgctcatggaggacagagatcacaaaacattttaaggagaatcaattgttatcctaatatgatgattacacagtcttgagtagattgtgttatgtttctgagaactttcaatattagtatatatacatggcaaattggcaagacaaaaaagtttctccaagcacagtccttgtggttagaaaatttctcatagcatctgttttgccgctacgtactcatctgctgttacaaccattcagttcttggctgatgtagcattgaacttatttcttccaatttggttgacagaaagacacatgttggacaacggtgtattcatagctacattgccgtgccattgtaacgtgtactctgaacataactagtgcacggcaatgtagtcctggaacaatcaaatctctcgttgggccaactaaggctgacatatgactaatcaaaattaacaaatgcagtatgaatgaccgcaaatttcccatgattgtaattgttcgagttgcatgatgcagttttgtcggctaatccggttaactgatatcatattaaataaaaatgacgctccttaattagtgatctactatcctgtccctactggcaagacttaattaattatcacgcaccatgaatcatgtagttttagcttctgttgtgttttggaacctctatgtatatagaggcatcgcctgaacacgaaagggcatgtagcttagtggttgtagtgtcctgagtagtattctaaggttttaagtttaaatcttcatagtagcaaatttcagatggggctaagttcccaattttgaatgactgcatatatatatatatatatatatatatatatatatatatatatatatatatatatatatatatgtagaggccgtgtaggcatatattctctaaaaaaaataaaaataaaaaggtaaaaaaccctctaaaaattaaaaaaaggcatcggtcctgagtttaaatggctgcatatattcggttcgatgtagagaccaggtaaaaaatacccttctctaaaaataataaaaaaaaggcaaaatggctttctctaaaaataataaaaaaagaggcatcggtcatgagttcaaatctgtatagtagttgcatttatccggttggatacggagaccggctaaaaaatattcttctctaaaaaaataaataaataaaaggcatcggtcctaaattagccttcactaaaaacaagcacgggacttgagttcaaatctccatagtaatgaatatacacagccaaattatgtaccacttacttgtggtcaggtcttggaagtcagttgttgcgctttttttttcctccattgttagggtgaaattttttgcatgtttcacatatgcacgtgctgtgtccttttcataaccagaataggtttctaataagaataaccatgggctaactgaacacaaattctcaagcttgaatatccttatttttatgtgaatccctagtgcctccatttcctattgaaatactctagaaaacgtcacttttaatttcttgttcaaaagataaatagtatttcctcatagtgtatagcgtgactggcttaggatgctctatatcgtgcgagatatcggatgcctctggtatttatcacggctctcaaattcagacataactactccatgatgatagtacatgcttttcagaggtcaaatttctagtcaaccaagagtggagtgtctaagtaaatggactgagaatgactgcaaattttttctactattgtaatgcatttgcatgaggcagaccaacccagtactgaacttatgtgtgctaacagatcttgaacggtttcgttacaaatcattttcatgaaaaatccacaaagctctcctcaaagcccagtaccaaaatgtacctataactactacctctgtcccaaattagtagtcacttctgtcccaaattagtagtcgctttgacttttttctggtaacgtttgaccattcatcttatttgaaagtttagtgtaaatataaaaacagagaagttatatttaagtatttttgacaataaagcaaatcaaaaaataataattccataattttttgaataagacgaaagatcacaagttacaagcaaaaactcaaagcgacaagtattctaggacggaggtagtacctcacattaattccattttcgtagtgcttcttcttacatactactagtacctttgttctagaatacttgtctctttaggatttaaattttgtcgtactacttgtcccatcaatcattttctactcaaaaattttcttattttaccctcaataaccatttcacttctcatacattatttaacaaggggtattatagacttttgtattaaaccttaatctatcctaaacaaactagaatgacaattattatgggacgtagggagtaattgtaaagttgtagaaaaaccatatcacaaatgtcaacaatatgtgatgtcacaacaataggtttttttttagagaagggtaaatttacatggtctctacatttaaccggatatatacagcctatatttattttaagagaaagctaatttttacctggtctctatctaactgtttatatacatcattctttaattgggaatttagcacatcaaacagggaacttagccctcaaataacccaatttgaaaatcgctcctacttaggaccttgggtgctactcaggtcactacaactattagactatatgccctttcacggagtaggtattactgatggacctaatcactgtctaattcatagcatttctggacccagtcttctctcctcctatgaatatgtttttcatgttcctcttccactcagatttctctcacaattgtcgctctaaccacccatcgcaatgccattaccatactctcaaccaaaacttgggaggccatgtctgtgggattgccaccaaacattcgagccttgtagcaagggtctaagtttttagcctataacatgtaagtgctgactttacaacggattgggcagaaatgtagtagtttttttttaaaaataaaaatatttaagagttgatgtgggttatgaaaaaaaaatccatgggccttggcccattactaccctactggccttcctagatcagctggattaattggatgaaagggtttgcgaacggaaaagtacgaattacccctcccccaccccgaactattgcggtcatccgaattacccccaaaccacaaaaccggacattcttcacccccaactatacaaaccggacgaattacccccctcgacccaatccgtggtggttttgtcctacgtggcgtacgcgtggcagtctaatcagcattctatttattaaaaaatgagggacccacctgtcatacactcatactctctctctctcaggaggggcg

SEQ ID NO: 21004 - DNA, 1729 bp, Oryza sativa
ccgcggattgggtcaaggggtataatttgtccggtttgcttagttgggggtgaagaatacccggttttatggttcgggggggtggtaatttggacagccgcgatagttccaggggggattcgtactttttcctttgcgaatttgcgatgattatgaggcccgggctattgctgctgactttgtgccgatggatcgaatgtaagtaccattttttaaagataatggaagtaaatccagtctttgctcaaaagagctataaccacttattacacaaactcgctcaacagtgatcacacaccataatgtaagtacctaaccaacaacaccgtgcttatatgttatttccataattagtgattttatgacgaagttgtttggtccgtggatcttcagtttcgcttacagcttcatgatttctttaagggagttcatcttataccaccataggtgggcaatagtcttcctgccccgctggatgatagcagtttcaaccggtagcatgaaggctttgttcgcactaatgcgtgccaaaactacatagggcatcagggtctatgtatgggctttccatgggccttgccttatggcccaatgcccatggcatgtaaatatgtaacatctccattcctgtggtccaagccccttcgacatgacaatactcgatgtgataagatgggaggtatagtttttcaggaccctcatgcatgtgtactctcctatcattttcctgcagtacctgatcttatccccgttgggcaatgaggagcttgaaattgtgttcctggcgcctccctttccctatgtatggatggacggtttaagagcttgtttgtttgggtaaatggggatttcttcaatccctacataatggcatgaaaactcgactaaagaagacatcaatctgcaaagggtttgggctcctatgtgcgtcgtacatccagatcggagtctgttgaagacgtcgtctctgacattgtttcttaagagttctatatatatcatagaagagccagctactagatgcacctatggtatttatcatggaaggcaatatcacaacgtaattaactactccaccaatgcaaccatgcttttggagacacatggatgtatagatggctatatggcccgatggcccgcccaaggcccggtgattttggcccggccaggcacctctggtcgtgcctgtgctggcccggcccaacagccgtgccgtgcctaggtcactacctcaacacgctgggccggcacggtccggcctgaagttcagggatgcgaaacagacttattctcaaccatatgtaaggcacgtcacaaagaatagggaggaaaaatatatttattttagctatatatatgtcacggccgaaagaggagggaggggaaatagagttattttaaagaaaacacgatgggccgtctgtgccttcgggctagcacggcacggcccgactattggtgggccgtgtctgggcttgaggtgcagcctgtgggggggcacaccacggcccaatgtgttggtcaggccatgccggtccggtagaatctagcccgagcacggccatgcttgggccgtgccgcgcagatgaccatctatatacatggatgtatttacttaaacatttttttaggtgatcttgcaaaaaaaaaaaaaccatgtctcaagtgcgagctagcttcatggactcagaattaacctcatatagaggtgagcatgtacatctccgta

SEQ ID NO: 21005 - DNA, 45507 bp, Oryza sativa
  unsure (1)..(45507): unsure at all n locations
aatgcaatatacagccaatggagtttgaatggtttcaatattaaagatcattttcatagctctcccagtcccaaatgtacagcctgatattccaatcgtcgtattagttaatttattgcatcaatttgaatttgttaaaaccggtatcacaaacgccaatgatgtcatgataagcatagacctccaatctgtttgcttgatcgactaggcattgctcacagtcacggaccttatcacttacacactgattaattcaatattagcaaacgagttttttctttttttgaaacgaaatttgaggcaacgcccaccgtccgtgctcacttttgacggaatttgaggaccaaaccgtgtcaagattttgctgcgttacaacttgctttcgacgagtaatggatgtccaaaaaccaacatactcactgggactcctttattggcaaatgaaaaacacttacataagctcttcagcttggtttcaattgactgggattttagttcaattttgcttttattatgaatggatcctagatactctcaccaatttacaacaagctctctgagatttcatcgatctgtaatagacctatttagtccattatatccaagaaggttactgtgatatagtcatgtttatttttactagaatcgacagatcaaaagtaatggaaaattataaactcccaagattatgattgtgatagaccaactgagtggcagccaaaacaagctctgatgactcacagccttgtcctgcatttctccttaatcaccatcaggagatggatgttttcagttccttgcgctgcttgagatttcttctaggctagttcatcataattgcacagtgggatatcctcattaacactatacattctgccaccacagtagagcaactctctcccacaggcaatggcttttctctgatctccaactatgagcatcgagcatcacagtttcgtgatcttgcacagacaaagtatgggtgggcagatcattgaaaatgcttgctgattgaaactaacttctcggtgcctccatttccaactaggatgtaaaactatgatccacaatattcctctaccatatccagcagtggtcttcaaaccattacagaagggagcgcctctgctatttatctttggttgattattctttgtacaattttcacagatcggattaaataaagtcatgaacgaaatgaacctcgaatgacgacacatgtgctgcacaactatacatggccataaggcccgaggcccgacaacccagcccaaagtgcggccatttggcccggtccaaacacgacatggcacgattggtgtcagacccaagccagctcgggccgacagttgggtaaaatagacttattttatagagaaacacgatgggcgcctgtcatgtctttgggctggcccaattcctagggccatgggtgtagcccgtggacaggcacgacacagcacgacgtgtaggttgggccatgccgggcttggtccgggtggcctatttggctatctatatgcacaacaacttacatggaataaaacacccagcaaattatttaacttgacgacaacattatttgcacattgcaggcacactataaaagttacacatttaaagagagtttctcgtgtgtgtgtgtgggggggggggggctaaaatctcaaaaattttgcgatgaaaaaaaataaatttaaataaaagtaaaatagtgaactttctatcctgccattattcagctcacagtagttcggatgaatacgaactaatggcatttgttttgacatatttggtatgatgagatacgttttgaacattcataaaagttgaaagcaggtcttctgaggtaaaaaaatgactacatttaataaattgtaattattagatttggtcgtattgtgtattatacaattatacaaggaaagtaaaatacaggtgccttgatcacaatttggtgccaactgctaacactgtcgggttacaaatgtgctccgttttttttggtttgttttggcaggaacagctctgacgagagtgttgcatcaggcccccgtcatgtcggattggacactaattagaagtattaaacgtagactaatgacaaaactcattccataacactggacttattcgcgagacgaatctattgagcctaattaatctatgattagcctatatgatgctatagtaaacatgtgctaattatagattagttagtcttaaaaaatttatctcacgaattagctctcatttatataattagttttattattagtttacatttaatacttctaattagtgtccaaacatccaatgttacaggatccaaaaaccacctgatgaagtaaaacttctccttttatgtttggcactccatttacattttatatcctctctgatgtcttaattatggcaaaagatattcctgtttagacagaagttatcctgaagcattcatccaattcttagaactatttctgttgtcattagtgacattagtgagtaatgacatctgttgtgcatagcattttccatggagcagaacagggatcatacacatcataaagataacttcataattatctcggtaacaacattgttaccgccaaataaaaaaataacaaatttatttcatgttccatgggaagataccagaaggcaccaattattttttgtgtaaataggtatcaggaggcaccataattaattaacactaaaaagtatggtactatctgatgtcttccgagactagtttttaggaaaaacctttaacttcttcatgtagaagagatcaactccataaagaagttaaaagtttttcctaaaaaaaagttagagctaatgcttcaggtttagagaccaaagaattacacaattgaatcaaatcggaacgctttctattattgtcgttaagcaaatcctgacaaaagttgaaacaatagcgacttaaaaaaaatgactatgcagcaaaggagtacatctcaatacaacacccataaagctgctaaaatatttagatttaaaccttccttataatatatacttccatttcagttggttgttttagtatgagaaattttgaaagagtatattagatcatttcaaattcatgaatttctaataatccctgtgtactcagctagtctggtctgatcttggtcttgctgttcaagctacccactgctttgcgaccggccatccattaccaaggctgtctgctaccaccaagcatccaaaggtgaggccagtgcaaccgtagggcttgcaaggacatatcttactgtcttgtatagttgtaaggtgggcagtatcaatccccttatggctcaagcagtctagaacagccggaagcacaaccctgtcggttgaggatcttgtagctaaatataatcaagtcctacctttatacctcgtcccaatgaacccaataggttgaaactgtattcccaatgcctccttttcccttgtatatgcgatagttagaatgttgttttagtgtgagtacggaaacctaatatcgatgtcttgggaatatgatgaaaaattgaactaacaagacctagatagcatgctgattttgcgtatctacactagagctagcttgttgccattctcactttgttatcctaagagagttctggtgttctacatcagagcacagggccagttgcaagcaggttctagtatacatttctatatatatggaagtcaataaaagtaggcaatgagacgacacatgcatgcaaatatggtatttatcatgaagaaaagatcgcaatgtaattaagtaactcaaccgaccatatatgcttctgaacgcatcgatgtattattgcattttgtactttgtagaaaaacaatgggttgtgtccatgtgtgagctacctacatgtatgcactcgaagctgtaaaattatttgtatattggacataggatctcggtgcctccttttccaaaccggagtttgcaattaaaattgacgatagcatttgcttcccatctattatctacaagaataaatgttatatatataccccaaatggcttcacctatctgcaagagatcaaagaggcttcttgttaatttgcatgaccatcatgatatatctgttgtttaattttgacaagaaagaaaacgagtcaagttgcatatttcaggttcttcaatttgaagtctcaaattcgacggagaaattaaaagtcatcaggttcatgaagaaattaacattcctcatcttgcatttgatcctaaacttattgaactttgccactgaacgagagcctgctagagctatacagatcgcgggaccatttgatatatttgatgagcaaccgaggacacacgtcattgccggtcggcaaatactaccgcagtgttccattcacgttgtttgtgcccaatggagtttcttcacaagagcgctgtgtagtgatgccgaggttttagcagcgtccaagaaaattttacgggacgactctagcataagatcttatacctcactctccggttcacggactgctctttttgttcaaacctcacgattaaaccgattgccttgatcattgaaattgaaggtagcttgaaactttgttccgggtgcctccatttcctatggcatgttcgacgatgagacccattatcattttgtaagcacctccatggccgcaccaaaatgtgtattcaagcatcagggtcttcttctatttatcatgggttcacacaactctcaacataatttctgcaccaattctcagcacaattttgtgcgtaagtaagattaaataaagtgttattaattagtgagtaacgacatctgttgtgcatagtattttccacggagcagaacactcaaaggggatcatacaccacttcacaattttcttggtaaaaaatattgctaccgccaaataaaaaatcacaaatttatctcatgttccatgggaagataccagaaggcatcaatatttcttttgtgtaaataggtatcaggaggtaccataataaattaacactaaaaaatatggtaccatataatgtcttttcaaaaacaataaaaaaggctaaataaatgtgaaggaacgatactaatgagttaccaactcaatccaaaagcagagctcatgccattttgcttctgagaggaaaacaaaatactaaaaactgaataaattaaaacagcgcagtgcatagcaattaatcaaaaaaaaaaaaaaacagcagtgcatagccggccattctcagctgaaagacagtttcaatgaatatgatctaaccatcgagtgccatttggttagactgtgttgtttcttgataatggttagacctaaaaccaagatagagctaaactccataaaataagttagagcttttcctatagaaaaaaggttagagctaatgctttaggtttggagtgtggaaaaatctaattggtgtattctattgttttctaatctattacattgactctcttatagggatagaaacttagagtgcaatacaagtaagagtagatttatctctaagattctatctctatgatatatcttatctctatgtttgtatttgaatcttatctctaactaacatatttgtacttctaacaaagagaccatagaattaaacaattgaatcaaatctaagctttctattattctcgtatgcaaatcctgacaatagttgtaacaatagcaagttaaatatgcttgctgctaactgtagagaaagtggaatagatgcctcaccaatgtggggaggtgaactctcatatatatatagcagaattacaatcaatgctagtgctgagttacaatcaatactagggagttacataagaccaaaggtctaggagagtaactatctaggagtgtaaaagtttaggagataaacagcctatagattaataaataatcctaatacccgcccgcagtcgtagcgggaggagcatgaacgcacagactggaccgaaaatcagtaaataactgaaccggcaaacctttggtcatgatgtccgcgaactggtgcgatgaagggacatgaagtacccggacttgtcccaaagccaccttttcacggacaaagtggatgtcgatctcgatatacttcgtccatcgatgatgcacgggattcgctgtcacgtaaacagcactgacattgtcacaatagacaatagtagccgaagcaattgggacatgaagttctagtagcaattgccgcaaccagcagcactcggcgacggcatgagcaacggcacggtactccgcctcagcactggaacgagagacagtagtctggcgcttggaggaccaagaaaccagataatctccaaggaagacacagtagccggacgtggaacgaggagaatcgggacaacccgcccaatccgcatcggagtatgccgtgagggactgaatcgggccggagccgatgtggaggccggtggagaggctgcccttcacataccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacgggcaggccgtcggtggcggagagcttggcacgagtgtccactggtgtcgatgtagagtggcactcggccatgctggcccggtgaagaagatccacagcgtactggcgctgtgagaggaagaggccggcggaggagcgcgtcacagagatgccgaggaagaagtggaggtcaccaaggtctgtcatggtcgaagcagtgaggatgatgtcatcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttaataccatacagggacttctgcaatagacagacagcatcaggggcagcggggtcaacaaacccagagggttgctgacaatagacggtctcctgtaggtgaccatgacgaaacacattcttcacatccagttgatgaattggccaagcacgggatgcagcgatgctgagaacaaaccgtatggtggccggcttgacaaccgagctaaatgtctcgtcgtagtcgatgccatgctgctgcgagtaaccacagaccacccaacgagccttgtgacgagcaagagtgccgtcagagtggaacttatgcttgaatatccacttgcccgtcacaatgttgtccccaggggggcgaggaacgagacaccaagtgccgttgtcaaccaacaccttgtactcatcagccatggcagtgcgccagttgggatcagccaacgcactgcgataattggccggaacaggagaagcagcggtggcgtgggtagccgtgtaggtcagcctgtcaaccggccgtaaggagctagtctgggagcgcgtcaccatggaatgcggctgaggagcagcagccgtgacaaccacattgggtgaagatgatggcgggaccgtcacggtgggccgacgggtgtagacatggcggaatggtgacacggtgccggctcgggtggcaccgaccgacggggcagcgccgatcgaggaggcgctgaccaagggcgtgccagctgatcgggcgtcacgtgccgcagggacggtgttgttcggcaagcgtcggccgaagaggggaacgtacggttgctcaacctccatggagggagccaccgtaaggcgtcgcggttgctcaacctctgtggagggagccaccgtgagaggtcgcggttgctcaacctccaaggagggagccaccgtgagaggtcgcggttgctcaacctctgatgagggagcgaccgctggagggagtccctgcagcaaaaaatcaaaagacgagggagcagggggagttgctgcgaagggaaatcgtgattcgtcaaacacgacgtggcgcgaaatgatgatgcggcgagtggagagatccagacatcggtatcccttgtgggaggccgggtacccaagaaaaaagcaagttgtcgagcgaggggcaagcttatgtggagtcgtggcactcaagtttgggtaacaaagacagccaaagacgcgaaggtgggagtagtctagggtggtgcgatgtaggagctgaaaaggtagtgagtggtgaacagaggaggagggtctccggttgagaaggtaggtggcggtggcgagagcctcagcccagtaggacggaggcatagaggcctgtataagaagggtgcgtatggagttgttcatggtgcggagcatccgttcggctttaccattttggggggaggtgtaagggcaagagagtcgtagctgggtgccacgactagtaagaaatgaagtggtggcggtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagtggaagtgcgagacaaagacctatcgaaaggtaatcgggtatgtttgcctaactgatacgcatgacataaagaggtgtctattttattacaggaaatagaggacatatttcgaagactgtggatggcggctggaccagggtgaccgagacgacggtgccaaagcgtggaagaagtggcgagggagcaggacgcggtgttggagggagtagcagctggaagggtgtagagttccccgtgactattgcagcgaagaatcacgcgctgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgtgccggtgtccaaaacttagttgtttgggctttggaaggccatctggttcagtgctgcaatgaggccagcttgctcccaattgggctggcctgtaggagcaaatgtgggcgacacaaatggcctagcatatgtggtattggcctgggagtagtcggccgtcggagccggcccaagaaggccggctgaagaggggcgccaggcctgttgctgggccggccaggggttaaaacaaacccaaggcccggccggcctccagctagggttggccacccagccggtcgaactccctccagcagagaaaccgccgccaccagaggaaacgccgctgccaccgccgccagagaaggcctggcgagtgccaccaccacccccactgccgccgccgttccctcctccatttccgccgccgcgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccaccgggagggcaggaaccggagccgaagccgccgccggccaccagcgccgtggctgccgccaccttggcttcgttggcgatgcgcaactccttcagcaggagggtgttgcgcgctaaggtgaagcttgggaggacggctgcgccagcgatgttatctccggtgttggagaagcgctcgttcaggccttggaggaggttaagcacgagttgggattcggtgacggcgtggctgatgtcgcgaagagcgtcggcagcggtcttcatcttctggcagtaatcgttgatggaggagtcgccttgaatcatggagtgaaactggtggctgaggaagatcgctcgaggctctttgttggcgtggaacatgtcctcgatggcgaccgagagctcccgcgcggtctgatcgggctccatggcgaggtcaaggacgttgtcggcgactgacccgaagatccagctgcagatgcagcagtcggcctgttcccaggccgggtcattggggcgtggaagagcggaaccgtcgatgtgagccattaacccgaacttgccgcacaaagatgtgaagaaggccctccatttgttgtaattcgggtgggtgttttctagggtgatggggacgtgggatttgatggcgaccgtggcgtaggggtggaggaattcgctggtggtactggaagaagaaaaaccactcgaggccgaggaggtggaggactgagttgattcagtcgacatggctgggatgcagctgcgatggcagcgtgctagagcagcggaaaagaaggtaagagcctaggctctgataccatgtagagaaagtggaatagatgcctcaccaatgtggggaggtgaactctcatatatatatagcagaattacaatcaatgctagtgctgagttacaatcaatactagggagttacataagaccaaaggtctagtagagtaactatctaggagtgtaaaagtttaggagataaacagcctatagattaataaataatcctaatactaacaaagtacatcataaaacacaacactcgtgaagctactaaaatatttaggctaaaccttccacaaaatacttttgcatttcagtggatttggtctagtatgcatgagaaaagagaatattataacatttctaattcgtgaatttctactgatcgccaagtcctgcatgctggatcctttcctagaccttgtagtcagctagcatagtctgatatgatctaagtttggtcgtccaatctgctcaagtagctatcattgtgaccggccatccatttctaaggctgcccgttgccaccaagcatccaagggtgaggccagtgcaactacagggataggtgtaggaacttgtcttactgtgttgtatagttgtaaggtgtgcaatatcgatccccttagctgtctcaaacagccgaaggcgcaaccatgtcggcttaggatcttgccgccgaatccattctaagtcctacttatatgtacgtcgtcgcaagagtgtatccgatgggttgaaacttgattcccaacgcctccttttcccaggatcttggttttagtgagtggggaaaaaccggatgttgatcgatatgccttgggaatatgatgaaaaattgaactagcaagacctatatatatagcatgaagattttgtgtgtacccatcgacactagagctatagcttgttaccattctcgcattgttttcgtaagagagttgtggtgttctacatcactgctgggccagcttggaagcaggttctagctagtgttctacatatatatatgggactcgataaaagtaggcaatgagatgccacatgcacatatggtacgttatttaatttatcatgaagaaaagatcacaccgtaattaaacaactcagccaaccatatctgcttctggacgtacgcatccatgcatcattgtattttatttgtatactcgtactcgatcttggaaaaaaagatgggatgtgtccatgcatgtatgcaccccgagccttggaagcttgaacgtttccgtatattagctagtgtgttagaaagttgggctcagtctgataaaaaaaaggttggactcagtagttaggaaaaacaaagtaattaagaagaactcactactacaaaaacacccataggtgtcggtcacaaaggtgccggttagctaacaaccggcacctataagtcatttcccgtcaatatagcaaaaaaacagcacctataacgatttattggtgtcggtttttgttgggaaggtcattggtgccaaaaatactcccgccaacggtccgaaaatcgcataggtggcggctgtggataaaaaaccggcacctgtatgaaaggtggcggttatttaaccaaaacgacacctaatcctaggtttttttttggatgaagggagtacttgattgtaaaggtcaaggtagactaattgtatctaggtccttagcaacaatgtattccatatactaggctgttcaaacatgagaccaagatgagtttgactaagaagatattagtgctaattttgcttcagtgtcacacatcatagatacaatagagtcactagaacggataccctcatctcaatcgggcggtaagccccatctcaatcgggcacagcgtccgtcacagactagaagtcactgatgtgaagagttatctcaatcgggcaaacagccgtcacgaatgaatatatctcaatcgggccctaagtaaagcccgtcaccgatagctttgacccagataaccagtcaaactatagcccgtcacacatgacctatctctatcgggccacaactagcgcccgtcacagatgactactaacctttatcgggcctaaactagagcccgtcacagatgacactcatctcaatcgggcctaaactatagcccatcatagatgactgatgacctcaatcgggactaaaatagagcccgtcacagatgactgctgacctcaatcgggcctaaactagagcccgtcacagatgacctcatctcaatcgggcatttagttatggcccgtcacagatgactataatccacaaaaaaaataaattttgttttttggctagcctcaggcctttgctagccatgcccgctgcaaaaatgacagaaacaaacacagatatccaatatccccagctccccagcatcacccattcatatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcatcacaattacataataagtgttcatcattgcctaaacatagaagttcaacattgttcatcattttagtttaagcctaaacattcctttggggttaattatttcgcggaagatgaagctggctatctcctcgcgaacctcctcaaagctggtaggcagagacttggttattgtgccctacattgtcataattccagattagtttatcgatcatatataattactaaatcacgtgttccataatcagtgtctactttctgttgttcccattacacaaaccacgatattaatagtgctaataagaaatattactacagttaatgaaacatcatttcatgaaaatcgatcatatattcatataaaaaaacttcctataatattgtcctacaagtaattttgcagttattaagaaggtatcagaaggtatgacacatgttctagtataaaatttggtatccctcgatatctctaatactataagatatcaaatcttacactaaaaatattggtacctcctggtacatatattaaaaactgtaaaattaccattgttacatacttcgtatagctcagcaccatcctggtacctccttcatatgcccatgatgtccaaacacacacccaatctcaaaactatttacgtacaccacccgccactagggtttacgttactgctggtaaccgcgcggttaccgcggttaccggccttaccacgggggtacggtaatagaaataccgcggtaagccggtaacctccttaaattcaaataaatttaaaatataatttgaatttttgataaattttgcacggttttgtatggtttttcatggttaccgcggtaaccgtgcttaccgccggggcatggggttaccgtgctccggcggtttgggaaaccctgcccgccaccactgaggttggaaactgctatgaggtcgtggatggtagcggtgaggccagtgtagccatgggactaaaagaaggcggctgcctcctgtacagcagcattgcaaccatcaggcggccggcatccatcctctaggcgcttgagtccagccggatgcacaatcctgacagttcaggaccctcatgcatgtgtactctcctatcgttttacttcagcagaccatagcgctttcagaaacttgaaaatctgctgctggcacctccctttccctatgtatggacggacggtttaagagcttgtttgttcgggtaaatttggatttctacaatccctttagagtggcatgaaaactcaactaaagaaaacatcaatctgcggagggtttgggtgttcttttttttttctttatgggttcaccaaacaacacctatgtgcgtcgtgacatccagatctcagagcttgtaagagctcgtctttggcattgttttcttaagagttctatatatcatagaagagccagctactagatgtctagatgcaggtttcatctatagaactggatgagccgtggtatttatcatgcatatgggacgcaatgtcacaacgtaattaactactccaccaaccatgcttttgtgtagacacatggattatttacttaaacattttctgtagtcgatcttgcaaaaaaaaaagccatgtctcatgtgcgagctagcttcagggactcagaattaaccacacagaggtaagcatgtacatctccgtaacactattgtgttattagagcaattttacggtacttgaggagataccatgaggtaccacttttttattgtacatttggtaagatttgctacagtctagcaaaaagtacctcgaggtactgctacctcatggtaacaaatcgtttccgaccattcgatctagctgggcaggatcggcattgttagattcaatgcttggaaacgatttggtaccgtgaggtaatgctacctcgagatactttttgttggatcggagcaaatctcaaatttggtatctcttggtacttacgtaccatgaagtacctgtaaaatcaaagtgtgtttgattcttattctctgatgaacaattggcatatgagtattggttttgatatttggagattattggcgaagtggttttggagatgattggatttgcaggtgatgaacaggtgctgctgaagatttggtccgatcagaccgggcaaggcttgccggtcagaccggcatgtatcgagcggtcagactgtctagcccgcggtctgaccggctgactctgtgtcggttttgttttcgggttgtttcgttggatattcatggatagttcatatttatggcttctagatggatactatgcgtatgtaaaactgttgtttgctaacaatgagtcaagttggagatagcttggtctcggaatatggtttttttgtttgattcatgtgtaggtgtcttgatgcctcaggagagtattactggtgatggatcgggagtcaacttggagataaggtgatgtccagacggtcagatatatatcatgcggaatacttaggctaaaagatcaatgcacttggttggtgaagattccatatagcataggatggagatattgtgtgcgcatggaatgcggagtcgaatttagaaggagtctaaatttggtatgattggagtttgtaaagttagtttcttgtaccggaaggtttcctaggtggattaggactttttatatgagtttggttcgtggctttaggctacctacctcatatataaatagagagggaatgtgaggcctcccgggatcgctttagagagcattgagttgagagaatagttagggtttcgaatttagtcgagatttttgtgaggagtgctgttattgcactttgtaaacacagagagaagtaataaagttgtcatctactctgagagttctttgatttgtgttttctcgagttcggtggtccaaccgactgttgatgcaaaaaaacacacattggcctgggagatctgcttaactccagtgcaagtccaaatcttgatgagatgtgggcgtgccagtcagtttgatcctgcaactgacaaaatatgcaaatagtagatcaatgagccaatcggctgacaagccgatggagtagttccagccgatgccgataccagccgatggcgatagggttttgagctatcgacaatatgtccaatctagataatgatataaaggcaatcggctgatgatgatgcaatataacaataatataattcaatagacaccaatcagctagcagtatgatataatagaataagcactgatccgaaggttaaagcatacatttactggagatccgatgtcataaaatccacaatattagataaacaataaagtctttgttgtcatcggctaaatccaacttatatgtatatgcaatccttataagccgatgcaacgtctagataacttatcggctagcaacccgataaaacattagcatgaacctatcggcttaacaagatttatattatcaacaacaatctagtaggtcgaacctaaccgatgcagcacgagattgcatatgataatataatactcgatgagccgatagatctgtctagcatgatggatataacaaatctatttacaacaacgttgtgattgtagagaaatatcggctaagacagaagatcagacctaaccgagacagttccaactaaaccgatgcttctctaaacacaatgcaattagagatagaattgagatatcaggtaggaaaatatatcaaccaaaccagagcgatccaaaagatcaaaacgatgcagccttgaacaacaccaacatagccgatagattctccagggccggcggaacataggacttaccccttcgccggagatcgaactgaaccgatgcagccccgcgaaaagtgccaaattccgccagatgataagtaaaatcctcaggaaagagggtggcgatgcaccgagattagttgtattgatcgagagatatattacatagaccccgggtgtatatatttatacccgtgggtagatactagtccttgtcggacaagaaacaaaccttcctaaagataaaacagaaacataaagtcattattagacactaaacacacttttctaaagataaaaggaaactaacaaaccattcctataaagtcattattagacactaaacacactttcctatagataaaaggaaactaacaaaccattcctaattaataaatacaattgccttcttcggactcaatccgcacgtggcaatatctcatgaagcacgctaactcaatctggcaatgattccaatctcaccttgccggaatcagctacatcggcttaccttgtccgattcagtatccgccgatgcacaccgtagccaatgcagtcccgaagctgatttatactctggttctgttatcaatttccttccaaatccgcttcggccataactcgaaatccgttgcatgatttatcaaatttggtcgttaacaccgacgagacaccggcggtcagatcgatggcatcgcggcggtcagaccggcgggtttactgcggtcaaactggcggcagcaataggcgacgatgataggtttcggcggttagaccgggagatcaacaccagtcagaccggcggaataggaacggtcagacctgtagatcaaccccgatcagaccacaattcatcgatttgagagtaacttttaattgcactaaatgttttggtttttgggcactacaaccatctggtcgaattagttcttgctgttcgatcctacagtaccaaattttacactaattttttggttccttttggcacctccttaagaacagtaaaattgctcgtgttataaagtaggactcagtagtaagcacgaccgattggtttaagacatcaaacaatggaatatactgccaatggagtttgaatggttccattatattgaagatcattttcatagctctcccagtcccaaatgtacagcctcatattccaatcgtcgattagttaatttattgcatcaatttgaatttgttaaaaccggtatcacaaacgccaatagtgtcatgatgagcatagagctccaatctgtttgcttgatcgactaggcatattgctcacggtcacggaccttatcacttacacactgatcaatccgatattgcaaacgagtttttttaaaacgaaattcgaggcaactgcacctcacttgctgtcaagattttgctgcggtactacttgctttcgacgagtaatggatgtccaaaactaacatacttaaaaaaatatctttaaaaaatgtgaacgacactaatgagataccaactcaatccaaagcagagctcctgccattctgcttcagagaggaaaagaaaatactccctccgtccctaaatatttgacgctgttgactttttcaaatatgtttgactgttcgtcttattcaaaaacttttgtaaaatatgtaaaattatatgtatacataaaagtatatttaacaatgaatcaaatgataggaaaagaattaataattactttttttaaataagacgaacggtcaaacatgtttaaaaatgtcaacggcgtcaaatatttagggacggagggagtactaaagagagaataaaaagagcagagagtaccaattattcgggaaaaaaaataatagtgcatagccagccattcttccgctgaagacaggttcaatgaatatgatttaagcatctagtgccattttggtagacatatgttgttgttaggtaatggttagacctaaaaccaggataaagatcaactacataaagaagttaaaggtttttcctaaaaaaaagttagagctaatgattcaggtttagagaccatagaattacacaattgaatcaaatcagtacgctttctattattgtcgttaagcaaatcctgacaatagttgaaacaatagcgacttaaaaaactgactatacagcaaaggagtacatcacaatacaacattcatagagctgctaaaatatttagatttaaaccttccttataatatatacttccctttcagtgggttgttctggtatgagaaatttcggcaaagagtatattagatcatttctaattcatgaatttctaatgattcctgtgtactcagctagcctggtctgatcttggtcttgatgttcaagctacccactgctttgcgaccagccatccatttccaaggttgtctgctaccaccaagcatccaaaggtgaggccagtgcaaccgaagggctacgtgcaaggacatgtcttactgtcttgtatagttgtaaggtgggcagtatcaatccacttatggctcaagctgtctagaacagccggaagcacaaccctgtcggttgaggatcttgcagctaaatcaaaccaagtcctgccttgacgttcctcattccaaggatggacccaataggttgagactgtattcccaatgcttccttttcccttgtatataggatagttagagtgttgttttagtgtgagcggggaaactgatattgatgtcttgggattatgatgaaaaattgaactaacaagacctagatagcatgctgattttgtgtatctacactagagctagcttgttgccgttctcactttgttatcctaagagagttctgttctacatcagagcatagggccagctgcaagcaggttctagtgtacatttctacatatatggaggtcaataaaagtaggcaatgagacgacacatgcatgcacgtatggtatttatcatgaagaaaagattaaacagctcaaccgaccatatatgcttctgaacgcattgatgtattattgcattttgtactttgtagaaaaacaatgggttgtgtccatgtgtgatctacctacatgtatgcactcgaagctgtaaaattgtttgtatattggacataggatcccggtacctccttttccaaaccggactttgcaattaaaattgacgatagcatttgcttcccatctattatctaccagaagtaatgatatatatacccaaatggcttcacctatctgcaagagatcaaagaggctttttgtttgcacgaccatcatgatatatctattgttcaattttgacaagaaagaaaattagtcaagttgcatatttcaggttcttctatttgaagtctcaaattcgacggagaaattaaaagtcatcaggttcatgaagaaattaacatgcctcatctttcatttgatcccaaacttattgaactttgccactgaaccagagcctgctagagctatacagatcacgggaccattcgacttatttgatgagcagccgaggacacatggcattacgatcggcaaatactaccgcttcactgatcaatggccatcacctgcaaccatgaaagcttgggattgccgtcatggcagtgttccattcacgtcgtttgtgcccaatagagtttcttcacaagagcgctgtgtagcgatgcggaggttttagcaacgtcaatccatgaccgcagcaaactgtgtattcaagcatcacaggaagaggggcttcttctatttatcatgggttcacacaactctcaaaagaatttctgcaccaattctcagcacaattttgtgcataagtaagattaaataaagtgttattaattagtgagtaacgacatctgttatgcatagtattttctatgtagcagaaccctcaaacagctggaggcacaaccatgtcggttgaggatcttgccgacgaatccattcgagtcctgcttatatgtacgtcgttgcaagagtgtatcagatgggttgaaacttgattcccaacgcctccttttcccaggatcttggttttagtgagtgggaaaaaactggatatcgatcgatctttcttgggaatatgatgaaaaattgaactagcaagacctagatatataacatgatgattttgtgtgattcgatcaacactagagctatagcttgttgccattctcgcattgttttcctaattaagagagttgtggtgttctacgtcacagctggccagcttggaagcaggttctagtgttctacatgtatggaactcgacaaaagtaggcaatgagacgccacatgcatgtacatatggtatttattaatttgtcatgaagagaagatcgcaacataattaaacaactcagccaaccatatatgcttctggacacatcaatgcatcattgtattttgtatactttgtagtagatcttggaaaaaaaaatatgggatgtgtccatgcatgttcgcactccgagccttggaagcatgtacatttccgtatattagtgtgttagaaattaaaagttgggctaagtccgataaaaaaatgttggactcagtagttagggaaaacaaagtaattaagaacaactatcgataaatcttgttctgtcgatcgaacataatctaagaaagcaaataggttctgaaggtttaggttataatattccatgttaattaggggctgtttgtggatggggctaaattttttttaagtccctgtcatatcggatatttgacactaattagaagtattaaatatagactaatgataaaacacatttcataattctggactaattcatgagacaaatctatatattgagcctgattaattcatgattagcctatgtgatgctatagtaaatatatgctaattatggattaattaggcttaaaaaattgtctcgcgaattagctctgatttatgtaattagttttgtaagtagtctatgtttaatacttcaaattagtgttcaaatatccgatatgatagggactttagtctctagatccaaacacccccttagaatattattagtcatattgtaaattttgatctcgattctctctcttccacctaggaatgtgatgatgtggcatttgtttggagcctgctgactgagtttattgtacctgttctaaagaacttactagtactactactttgtttgttgtgccaaggataactttttaacctatagatgtattcattactcctccttgatttatactattttgggcataatcccctatatttattgtgggtataatcctctatattccggagggtgtatgatctagcctcgatcatgtcgattggagtcaaaatgatgctaccatacataccatacagtgtactcgatgatcagccacccttgagaatggggctctctctaccttcctacatgctagtatgaagcacgctagtcttctcttcgatgtcagcatcatgtatgccgaatgtggaactctacaagtacgaagaccctatgttctttcactaggatgtactaatacactaccaaagccatgccacccacactagcataaccttgtcaactcttgaaactagtcactctttccatagtagtagctgtctattgatttcatgggacactccaaggttatgccgatcgaaaagtggaccgagagctgtgcgatgaattcctgatacctccatttcctactagggtagttcttcacttttgttcagagttttgctacaagagcttagattttgatctacgtaataacttgcacaacaaaatgactagaaaagacatttcttttatatgtcttccaacccaactacctccaccaaccatgcatgtgcggactgagctcgtagagttaaatcatttaagaattcttttcaacaccattatatatcttttattcttcctagtaacgaaaagcaggtgaacagattctgctagctagggagcaattatttttgggggtttttacacattagagtaaattaccgtgctatggagaaacgctcaggttcttccggctagctctataaggtgatgggctagacgacttggactcgaagcatcaccccttctaattatttgatattaggtccttccctaatattcgcgtttttaattaccgtgctatctcattcagacagtcaggtagataaatacagtggcgtgtatatgaacaccatcaggtttcccctaacattgagtttttctttgcttgattatattgaattattggcatcaatgtctttgcgctcagtccacacatggttatatatatcaccgatagtggtcggaaaggctaatgggtgggtgatcgctcccccaccagcccagcgatcgccgcccaccctctccccgatactactagatgtatgtcacaccccaatccagcaccgccgtacaacgacacctgacactggcgtgtcgtaggaaaaacggcgcgaaccgcttcctacgaaaccgcgatcacagtaccagtcccaggacatagtgctggtacccacggtgacaaatatgattcattgcaaatccttaaaataaatagaggacttatttaccttaacttaggttgcagctcaggacagcctgagaatacaaccaaagacacagacgaggaaacaccagcaacagcagcagcagcggaaccaacggtctaacaccccacaccacaggcgacggctgggaaccaggacgaaaccctaatcttcactttacttcatcttcaacttccgggtggaggaactatatatatttatatagagcaagggtgagtactttcgtactcagcaagtcacaggaatttaggtgtttaatgcaagcttgaaagagaggcaaagtagttttgcaaaatcctttgtttgaaatcattttttgaaatctctaagtgatttatttctttttaagtttggatcaaaaaggagacttgcgtctcgattcgacttaagagatgcttttcaacaactcaaatggtaatgtactgacccccgggtcagatcattacttatcggctcccatagccatttcacttgattaagcggctcctagagcctttttcatttttgcggactcccagagtccagctgcccagcagcaaagcaatccgcttccactcgggaagcctagtctatgatgcccacagacatcccgaatcacacagattcgtttctgaccactcaggtcatccatctgccacttaggctgattctggttacgattcccaatccacaacaactgttcacaaagcacaggcaaacaaatctacgcaacgggaaccacctcacatccgcccatgaccgggggcacggctgtttgaacagttagttaacctctgcagaggggtgcactttacccacaagacacgaacttactccagacactggccggtgtcagaggtttgcgacaaagcctttccaaagctaaatttgggtcacctcatgccacatagagggtctccctgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgaatttcccaaaggaatcggtccttatatgcgaatacgggacagtgccaccaaggcacagcacccgcatcgcgagctttcacaattcattttattttcaaacacgccgacaccacatgtcgggttttaaaggcttctcaaacccatttcccagattatcgacaaacaacggtgtatgtggaatagttggtatacgcgctcagagagcacggataccgaagtaccacaaaggtggagcgacaaggaatcagggtagtacagcctacaggaattagtgcgactactaggtaggtccgtcggtttggcacgcaaaccgaaaccaagcatgctataaatgtgtgttgctaataatgcgagttgcaaacaaattaataatgattttccaattataggagcaattggtcaaagggtgcttgccttgctcaaggtcttcacgaagcttcacgaatcttcgagaaaacccgcgatcgacgaaaatccggtaactgcaactatacgcaaacaattaaaaacctacacaagacccaaaataaagatcctatttagactacataatagtaccattagatagatctcaattttacggaattattggaagttgaacggagtcaatcggatgagcggttgagaagatatggattttctaaggattaaggaatttctgtctaaaggaaaaaggatttaataatttattaaaccctttttggaaagaaattgaaagagggatatgatttagacttcctcgggcggcttgggtgcggcccaagaggagaggcatggctcggccgaactaatgggccggccggcccggagaggcggcccaagggggcgcggggagagtgagggagagagagggccggcgggccgagtccaccttgcggggtcccgagtggggcccgcttgtcggtggcgcggctcaccgtgggagcggcgcatgagggtggcgctagggtttcgggtgagcgcggttcacgcgcgtgcaccggatggaccagggatgcggcgggcccacgcgcagccggttggcgcaccgtgggccgcgcgcgcgaggggggggagggaggaggcagctgaccggctcggctcggtcaatgccgaggtggcgccgacgtggcgcctacgtggcagccacgcaggccggcgggtggaggaagaaggggaggccgagatggacggcggacggcggccgtgttcaccggagcaagcgcgacgggtttggtcttcgaggagcacaccggagtgacgagggcgtcgagaaggagcgagccaacggctcggattcgccggagggtgttcaacggcggtggaattcgacagcggcggccggcggcgagagaaaggggaaatcaccgaggggcgacaaggactcaattaaaggcggcgggagcatctccggggctcaagggtttcgttcctgtaatcggatagggtggggaggcgccgtggaggtccggcgacgagaggcggcctccgggagcaggcgctgacggtggcaaggccatgccgagcggcggcagagctcggggcggcgtctacgcgcgttcgaggggctaaccgagctatcatgcaagctagagagggcgagggagaacgaggaaggagaccggagggaggtactaccgagccgggcgtagtgatgggcggcgacggtgcggggcgagctctctggcctcggcccggggaaggggaaggatagggtgcccggagtcccgcgtcacgcatccacgcacgcaccggtctccctggtgcttcggcgacggacagcgagggcgactgcagggcggggtggcaacaatggcgcggtggaggttgggcaaggaaacgaggaggaaagggaggggctcaggttgggttttatgggtgcgggaagtcggttttgggggaggaaaccgacttaggcggtcaaggggaggagctggcggtcgcgcccgtggtccaggcggtggcaagcggtgacgccgatggtggtcgggcaaaaggaaaaaggagagggagaaagggagctctgctccttgctgtttcgggaaaagttgaaggagggagagggagtgagagaggggctgcctctctcggctttggaagctagcggcgtggagcggcagagcggcagcgcacgacgcaagcgatgctagggcttgacgcggcggcaaccgggcggctgcgcggcgcaggcgcggcagggctgacggcggcaacgaccggccggtcggccactcgtgagcgccggaaagagcgaaggcggtggcgggttttgggcggcgtcggcacgcgagagagaaaacgagagagagagcgagaaacagagagagcgagagagctctctctcggctcagctcggcacgtgcaacgcacgtgcgaggctgagggagcagaaacggctgagggagggaggtgggctaagggggaaaacggcccacaacacccgagggaagtaaaatagacttttgcagagaagactgatttggagtgtattcgaattggggttttggattcgaattcaaatttgacattcgaactcgatggtttagggaggaatcaagggagactcgaggagaagtcaaggaagagattcaaaacagaaacttggatatttttttagtagtcggagcgaatattcggcaaggattcaaaggaagggattgacttttggaatttgatttcggagacttgaattttggataggaattcttgaggtggaggatttttgatttcgatgagagggaacaacgggattgagttgagatccatggcacgacttagactctcactcaaagaacaaaaattttcgcaattagtattttgccgaattagtgtttaatgtctcacgaaaagcggagcgttacaatgtactcctccctcttctcccccttcctcctctccttctcctctttctactgcaatagaccacacaaaattttttgaaaaacaaaagttagaaaaatttatgtatagaaatactatatataaaaaatttgaattcaaattcaaatttgaatcgggtatgtaaacttttgacttataaattttgggtctataaactttaggtgtataaactttagatgtatagaaatactatatatagaaaatatttgaattagaaaatatttgaattcaaattcaaatttgaatcgggtatataaactttaggtctataaactttaggtgtataaactttagatgtatagaaatactatatatgaaaaatatttcaattcaaattcaaatttgaatcggatattcaaattcaagatcaaatttgaaacgggtatatataaactttaggtgtataaactttagatgtacagaaatactatatataaaaaaatatttgaattcaaattcacatttgaatcggatatataaacttttgacttataaacttttggtctctaaactttagatgtgtaaactttaggtgtataaactttaggtgtataaatttactaaaataggaaaataatacggtgacaaaaaaggaaaccaggtggagggagggaggggggaggtggtgagcgaatctgatcgctaccccatccccacggcgatcgatcgcccattaggggtacccgatagtggttgctttcatcgttaaaatgaataatcaaacaattgcatcacttgtttcttatcaaaataaagatatgacgaattgttaaacatgttgacatatcttacacaccaaattccatgtgagactccaaagtcaaaacccaactactaggcctaagaaatcatcagcacaagaagtaagcacacggctgctctgctcccagctatcttcttgcttcaagaggtcagcgtaggtgggcacggttttcctggctagctttagctactggtgcaaaggaaaaaacaaactccttgcctactggcaagctccaaaacacggacttcgactgtgcaatcgttggccttgccatgttgccatccgcatattatattggctagtttacacattatgtactctcagcagctggttgagagtatagtagattgcaactttgcaccgaattcctgatgcctcccttttctattggacttgattgtccatcgtctcaagtgagacttgtaaacattggaacacttgcatccacctctacagcatgccctacaagaatctagctagagtgatggatgatgcaggctgtgttttgaaggactatgtgcactgatacttttttaaaaggacaccactaggcatcagacatgattttttacagatcataaggcctgtgtttcaccacttgtaaggaaatgcgttttagattatatattcatcactcagtgaaaatgtttctacaataatttgtttatgatgtttaatcacttagtgaaataaatattccacatgtagtaaaaaaaatgtttcgattagatgcaacatcagaaagtttgggttgcaaccccaaaactttacgcaaggtcggaaaaaaaagtgcgtgtcgtcatttggaacatctgaccaaagagggataaatactggaatacaataacatgcaacaagataaacaatagtgcaacaaacctatcgctctagtatgctgagtttgtgtatctacatagtagagctagctaagtccgcgtggtacttggacaccatggacttaatgccaagcgcagacattaatacaacatagtgaattaatttcacattagaattcatcagattatctgacttcaaataattcttggcatctcttccactagaactacactggtactctcctaaagcgatgggaataggctttgaaatgatatttttcttagataggcttgaaacgatatgtacagtaagatcgatgttgccactgctatgtgtggactgagctttgccaagtgaagtcaatacatatcaaggaaaacggcataattgcactgagctacggcttcattgcatccatggtacacaatcactatattatgttattaactgtctgaaggtcaggtgcacagtattagtgtagagagcccatctaatgttacagagtttgtgtcgaatatatatatatgtagtttagaacttggagttgtacttggtgttaggactagagtaagagtcagactctatactagactctcttaaatagaggggtggacctattgtaatcgcatggcgacttagcatagcgagaggaagcggttgctggcggtgtcctagtactgctagagctttacactaaatatagttttagtatgcacttcccgcactgcaagagcaattttacagttcttgaggagataccattaaggataaaaatttagtgtaaaatttagtagctcctagtacttaggtattaagaggtaccaaatttacaatagaaaatgtggtacctcctcaaggactataaaattgctcgcactgctgactgcagagcagtgtgacctttcacgaactcaactgtaatatgtcgatcaaaacagtgttacagtaccaattctgtggttctaagcaacaaattatgttgacggctatgctctactgctcctagacttccatgtcttcaggatgcacgtacgtaactttgccctgctggttttgtactcttacttctgctggtgtaatacgaatgggtttcagcaaaagctgtgatgaatccacatgttctgcagctgcttcaggtaattcacatgcgatactaagtcatggtgcacagtgttgtcactacgccgcgtccttcttggactctcctcccaatcgtttccctcggggctacactattcaaagcctcctaacctaagttctcagtgcctcccttccctatgcttactgggttatacagtggcatgatcagtgattgatattcgagttttcctccatattcttctccttgagtttttgcgagtttcatgaaaccaaaaatgctactctcgacatggatatatagagataagtggttattgagcattcagaacaatgaatccaataatgatttaatttacatcgtatataatcgagtgcacatacacaccaacaacctccagccactatggtttctctggatctctgtaattgatgtcatatggaatttttttttcttttgcaaaacaccatacagaagaatatatttatatgcacgtcggctatctcatacatccatgagcacctccacgagatctggattggtgtatcgtaatattgagtaaggcatcatacacatctcatcatcgatggacgcattgtctaccacttaacgaatagtatcataaatgtgagcaccatgtgacgagtcagaactcgagggtaggttccaccgtaagaaatttaatcaactgagagctactctctccattcatgtcacacaacagttttagtgtgctatcttgaaacagaaaagagcagataaagctaaagggttcatgtctaagcattcttgcacaactgtttctaaaaggacttctcttgcagattttcatcacaacagttttttacaaatgaagtgtcgcacatttttcataatttcattaatgaaaagttaaagggttcaggtctaacttaacggagaggaggataaagtgaatctagcctgctgacctagtcatctggacagccaaagcacaggaggcgattaaaaacaccatcaaacgtcaatcacgtagccatcatcattgttctttaactttcctcaatcaccactgggagatctttgacgatgatctttaaccattggaatcttcagttcatcgatcctaattgcagagttaagcaacctgtacatcaatctcttgtagaccagttgatgcatgattgttgcggagtgaaatatatgctcactagcacaacagtaggcatctatctcggcagtacatcaagctctctgtgtgggtaatgatgtttatccctgaataagatcataagggtttcaacaagtagcacgaaggccctctcagtgcttaatgacgtaaacactctacatctctagttcccaacatggtctgccatcagctgctctacatctcttagttttcccaccaaaaggagtntttccccaaaattttttttttttttggttggctgatcttcgatagtacaagccgcctaaaactaagttcctggggcctccatttcctaccggttatgaccctttattgtgacttgcacctaactccataattcctcgaagatatacagttatacactgttttgatctttgagcattacaaaatggagtacctcttctatttataatgggctcacaacttttagcacaatttctccaccaccaaccatatggaattctgcgcggataggattaactaatagtcactctgtgaaatatatgtatcttgaatgatgactggtgtgggcacaacattttttatgaagcggtatttccaatggttctcaaacaacttaatctacaacctactacattctaagagcaaatttaatggtatagccaactatcggctccaaatcatctatagtcaattttatagctaattaattcatacaataatagttacacataaacatatactacacaattaatatctggtcccacctgtcatacatacatgcatctttgagtccgtgatgtggctagctacagatctgtagcccgctgctcctctctcctattttatctccacaaaatatatttatagctagtttataatctgctattgtacccgctctaaagctcaacatgcaaagatatcacattatcatccattagtaattgttacatcttaaacctcatacaaacatgctcttatctatattttattatattttaaagctttttaaatagaaccatgttaaatcatcatccgatgtaagttacataatatttcaacatatatttctccatcattttctacaatatcctagttcttcttcatttagttaatgttttctatcttctcattagaccatatatcacctaaattatttctagcctttagatgattaatctatagtccaaattttatccctcatttgcttcccacatgaagccacaccacctttcttttacttttaaattatcaatcaatattctactttaattattctaaaccaaatcaattctatggttcatagtcttttccaattatcgatcaaaaatataaattctataagcttaaggcatctcgctatgttacacgttatttctactactatcatactaaactcccgcagcaacgtgcggagtttcatctagttaactaggggatcgagaacgtcatccgacaagtctaaatgaagtttttctcaaaaggacaaaaatcattacaattaataaatattaactaagtagaattttctacagtacattgaagttttgtagaatttgttgtacatcactcaattacaaaacacctcataggtaccggctcatatgtaccaatttatttaaaaccgacaactattacctttttcacctctataggacgaaaaatttggataaaaaccggacatatacttatattatagatatcggttcaagataaaaactggtacttatagttttgttatcgatattttttttttaaaaaaagacaataccaatagtaagctatatgtgctggtttctaaaaaatcagcatccgagccgagccacccacgactccaccttatccactcccctcgcccaccccatcccccttctctctcatgcactcctctccatctgcccctcctctcctcctcctctccgtccttctcctatgcatcctagctccttccccctcgtcgtcgctagagcgtgtatgacattttggcgatgctggcgcgggatggcgcccttgaagttgttgtagaggaagtcgagcacaatggtgcggaagtggcggacgaggcggttgttgctgtggtcgagctcgtggaggcagtggagggtggcagaagcgggtggagttgaggtggagcagcgcgatgtcggatagcaactcgagctcgacggggaggtaatccacgatgtcgctgaccttcccagccgcagttgtcggggagcagcacataggaaacaccagtgtagccgcacacgtcaaggccaacctagtcggcagtgaggttcttggggtcggagaagatggttcttgtagccaaccagcacatgtttccaatctccatgtggcagcaaggaaggcgacggtggggctgctctctccctccggatctggacgagactgctcgcggtgcagcgacggcaccagaggaggcggaaacccgcatggaaggaggagacggagctggtggcagtagagatggcggcaacagaagtgggggttcgagttcatgacaggatatagagagtccatgtctggtggtggctccaggaggcgggcgggactgtggcggccgtcggcatcatggcgataggtgacctgtgcataggttcagcagtgacttggttgtggccctccctcctcctctccttccacctttccccttctcctgatccgacagcggtggtggagaaggctggcacagagggcgaggtggtggctggtggccgcgaaggaggtggaggtgttggccgtcgcactcctctccacgccgccagccatcggatccagtgacagtggctccatcgggctcttttttattatttcattgaatactgtaggtgccggttggaaagggatcctctgacataaagttatccctgacgtggtcactgacatgtggacccgctagtggtgtagcccacatgtcattcaccacgttcctctgactttacgtcagaggatctcaatccggtgccggttgtggggtgcggtcttggatatatttcattgaatattgcagatgaaacattatattcaattgcagtggatgcacactttttgggtacaatataaatatactggtagtatatactgtcattataacaagggcaatttagaaatataccacaaacttaaaaattggatcaagcaagaaaaacgcttcactatacaccgagaatttacgtaagtgccactgcccaatagtatataaagacaattttactcgctttaagttcatactgtaatatatttaaataagtcagcaaattaatctaaacccttaatcaattatactggctgtttatattactagaatattctaccacaaaaattctcttgattttcgttctatagctataattaattattttaatatcccaaattttgggctatatatctgcttgaaatatgagaattgagtcatttgagaaagtttatatactagcagtgacggtggttttgctttcatcggtaaagcaaataattgaacagctgcaacagttcattcacctggatatatcgacataactgttatacggatatatccttacactgaatttcacgcgagactctaaaaaccaggcttctagtccttcgaatcatcaggatgaagctaacagccatcatcgatgcttcccatactgacttgtatcctgtgcttcacatactgacttgtattttgttcttcacatatatatactgactgagctacattgtcggttgcaaccttgcatcgaactcccggtgcatcccctttctactggacatcattgtcgactacaacggttacccacatctcaatcgggcggcaacccccatctagcctcagacttgcagatgttggcccatcaccatcctcatacccctataagaatttgacgacagatatgtaagacacagctcgtgttttctttccaggggctatatacactgataccgatcgattgttgttcatattggagtgcttgctagttcatatcgatgcttgaatatatagcagagccacatcaacgttagactatgtactcctacatgaattcacaaggagtgaaaaaactggaccaatttggtataattcaggaggacctgactgtcattcaagttagtacttgttgaatggagcctactacgtactctggtatctcatcattggtcaccatccgtttctgctgtgagcttcaggcatatgaatcacgtttgatttttctatcatcactactgcaaaatcgattcttcctaacggtcagtttacgttttttacgatagctggtgctgccgccagcgactaaaggctagtgaaaatcagctatcttcacaaacggaacttcaccgcaagcggcgaggttaagctgaccactagaaaaaatgattttcaagaaaaaaaaatctccacattcgccacccatgctcgagcttctatgccgaatgcactgcccatgccctgagtcctcgccaaatctgccgctcgcttcccacgactgagctacaccaattgtggtatcctcacaacctcgagcctccggatccaccgcctgggccccaagccaccacctacacctttgccagatctaggagagggagggtgctagcggagccactgaaaccttgttgagacccagctatcgttgtcgtcatggcagccaatgtcatcatcacgatagtcgttgttgtcattgtggttgctgccgctagatccacttcctccacaaccacctcttttccttcaccattgtggaggcggatcgaccggtctggagcaccgcaagccactggatccatcccctccatcgtcactgctgctgaccactgcccgcgcgccctcccgggtgtggattggcagcccgtgcccctcacgtcatcgtcccaatcatcgccatcaccatcaccgtcgagaggaggaggggctgagggcacaggagggggtgagatgggaagagtggtggagtctgagtgagagtgggggcggaattttaatatagctatttttttggcagtcggtgctccttaggcatcaccagcgaaaatatttcgctggctgtcacttatgagatccacatgcaaaagtagtttttcaaatggatctcttaagtggcagccagcaaaaattttgtgaccaggagtccctctcaagtatcttttacaagcatgtgttcattaaacccacgagtaaaaaaaataaaagggtagtgctatccgaaatgtttttttagttgtgcatgcgatagagtggaatggaatggtggcacactttctaagatcctaaatgatgtgaattttgcaaatagtttctacatatgaaattcttataatactttttaaaattcattctttaactttttatagttaattcattcatttgtagcctcaggtaattattacaaaggaataactctacttcaccccctaaagtatcggggttggtctacttaaccccctaaagtacgaaaccagatattctaccccttgaagcgtgaaaatcggttcaaataaccccctaaagtagtttgtaggtagttttgccatgtaaatgattacatggcagcggtattggcttgcatgacacaaagattagtccagtaaacccaagttgatctaactattgcttcttactcattgatcgggaagcctaaaaaatattactccatctatcctataatataagaaatggtcaaacttggtacgattgacttataatttttcatgtgttataagatttattatgcaacaaaattataatcatatgaaagtaaattcaaatgtcaatccaatgataacattctcaacaaataaaatttaattcatattatactaattattggtcaaatatcttagaagttgaatcttgaaatgcttgtgcgcctcatattatgggttggagggagtatatattaacactaatttacaatcactctcagcctgtttcacttgtgaataaaatgcttagcatgttacaatagtctcctctatagtccaagaggccaaaaccattgccatatcatcgtgtacacagcaaaaacacatataaaaccactaaaaaacactgatgttgtataataaacacataccaaaaaccaaaaagataaccattaaaaataaaaaaacaacttaacccttgttttgatactttaggaggcagaatatccggtttcgtacttctgtaggttatgtagaccagcctcaataattcgggggtgaagtagaccttttccttattacaaatcatttatctattcagagggaagttggcgataagtatcaaatgtcggatgataaaattgctcttattgttttatggaacgaaacccacgactctaacggcgggtgttaattccggaacaaaggccatcaacagcggttaattctaattaactctgacggcatgtcttcatccccttcctccagccgagatagaagactaatcctctattctttctcctctgtttctcttggtacataacactactctgctctgagttgcttcataattcacagtcctcagtacctgtggacattggtattctagatgagcagacctccagaactccgtccatcagagtagctggcaatcaaatttccggtcgaggagcgtggttcttcacgcgactactgtctgcttcctttgcatcaacgtctctacttccgctgcatcaatgtctgcttcctctacatcaatgtggaacgattttattaactataccgattaaggactagattttcaacatggtcgatgatgctaacacagcgggatgtatcagaacgagtaaccccctgacactggtgatttcatggtcgatgatttcatgaaagatgattttccttacagttttcctttacaactaaaaatacatgtgcagagtttttctctttacattctcgaagatatcacgaaatggggtatctcctaacttgtgttaaacatgatgtatatttgtacctcttcctcgtaataattctagacatggacagtaaaaaaatttcacgatgtactgtatttgattcagatactattgagtgaaaattaattaggcccaaataaattgggcagagtaaatcacgtatctcgatcaatgcaatcttatgtgctctgctcccaaatcgtctgatcgagtgcatatccccaccgaagtactggatgtttgacagcccatgaccaaaaatgtcttgtcgataagcagtttgtgttgaggctagctggctactagctcatcgatgatcacttcaactgccgataagacaatgcactagacacttggtgctgaattcccaatgcctctatttcatagcggaattcgtcacatctgacttgtaatgacaattgccattgcctttttgaggtaagagtcctatttgttgcagtgatgggcatatcttaggctctgatgcaaaatgagagagcgatgttgattgtaagatttattttaccattcttaaaagagcaagtttacggtccttgatgtacataccaagagaagtatcatattttccagtataaaagtttgatacatctagatactaaatatctcaaagtaccagaaaatttagtgtaaaaattgaagtacctcgatacacattctctataatggtaaaatttctcttattgtgacatgttactgcagttaccgtggactgtgcttgcagggaaaattaaagtcaatattaggggaagctgatcgtgctgaactactgcatcgattgtcgcatttatacaccgcgcttctataattcatataaagttacaacccacgaattcatccatcttttttacgtatttaacatatacttttacatttatcccgcagcaaagctccagacaaattcgtggacgaatcctgcgtagccggcgccatgttgtagacgactgtgtggccaggcattcctgggtcttgccgcgcgcatcgcgatatacccgtcattcagtcgccttgcacctaaaatcggcagatggtgactgagatacacgcttgcaacctcgcactaaactcatggtgcctctctttcccattattggacatgattgttcatctagtgtgtgttgctgaattgtaggcatgcatttgaccaattattgatctgcatgccccccccccccccccccaataagggcctgtttagttggggaaaaaaaaattttaggtgtcacatcggacgtttgaccgaatgtcggcaggggttttcggatacaaatgagaaaactaatttcataactcgcctgaaaaccgcgagacaaatcttttgagcctgattaatctgtcattagcacatgtgggttactgtagtacttatggctaatcatggactaattaggctcaaaagattcgtctcgcgatttccttcctaaatgtgcaattagtttttgcttttatttatatttaatgctctatgcatgtgtccaaacatttgatatgatgtttttgacaaaaaaaaattgtgaactaaacatgccctaatgtgatgagagaaatggatgatgcagcttctgtttttattttttctcaagggactgtacactggtactgattcttttatatatcggtatgaactttctctagttggtaaggatgcttgaatagcagtggcagagccgcatcaaggttagaagccaaaacggtgcttattagaaaataaaaaaatatctattggtaaaacttttatatatttgtttgtagcgactttaaagccaatgctaaaaattacattgaaaatatctcaaaatcaagttcgaaaattcaaattttagcttttgctttggcttattatactaactgatagggctcataggtcaaggtcttttaaggtactccaacttacctttacggaacctatatatggagataaaagatattcacaaatcttgattatttaggaattgttttgtgtcgtaaaatatatttttgcacattatttatctttccaagcttatttttgcatgcatggagccttgaaaaaaattaatgcacgcagccctgaaaagtgtctagaacagaaattttacttgaaatatattagcaatgttgtttccaaaacacaattttaaagaaaaactataaattagaaatttgaagtgtttcatatgtttataaaaattacttaaaatttcataaaaatgaaacaaaaaggttcaactgattttaagtatgaactttgatatttaaatattatcctacaaataaacaaatatatcacgtacaaaagttaaaatttgctgatgccgttcaccgtataattcaagatatgctttgatgttaatacaaatatgattgtagaaagggaaatattattgtaatttgaatttcaaatatgataagaaagattagttctgttacgttattgccttaaaaacaaccatatccatgacgcatgataataaacagaaactgaagataatattcttgtttccttttttgagatgtgggatatcaagcattggatcaatatgaaatgaatggaactaataggaagtcacatggagcgaaaaaaagcccgtgaaaaaacatggccacatgactgttttagtttttgcattggagtgccctgcgtaagcttcaggcccattcgatctgatcaccaattacaatatttctggtgctgcgccctgggtcgttggaggcttgatgcaggactgaattgccgtgcggacgtcatatatccttttttttttttaagaattaccccgtacaacatatacactcacaatgcacgcacactcatccctattaacacacgcatgcaaaccctacccctatgagcatcttcgaagactgggccggcaaatccatcctggagattgacgaagtcaccacaggcacctcactgtcgacgggtacgtcgcctatcactgaaaacacaaagccattaaatcctgaaaaattcactcccataaggacactagtaaaaaacctctataggtgccggttgggaactggctataggtaccagtttcacagccagcacctattggtcgacacctttgtctcaattttattggtgccagttctaaaaccggcacctatattattaaaaaaataaaaaaaagatgacaccaacactgccgccggcctcctccaccggtgccaccaccacctcgctgggcctccacgctagcacctagccgtgcccgcctccgcgccgccacctcaccgggccggcctccgcactggtggccaccacccaacgccacgctggaggggggaggtcctccaggagagagggggctggccagatccaggcctcctccaccaccgccaccccagcgtcagttgccgcgccagtcgcgcccgcgcccgcgccacgccgcccttgatttggagagaagagggagggcccccggtccggcagaggaccgccgcgccagccgcgggagaggaccgcagtggcacaagaggcactagcttgacttcctgctgcctccatttcctatgtaccgagctatactagcttccactgccatgactacttgctctcttcattcacatatgacatatctcatttttttttctgtcgtcacgcaatttgatctttaagaggggggatgatgaagttttgtgttgcatggccactgctgtgataaatgttgatacaaatatatatgtttgctatttaatatcactggaagtagatgggcatatatggggaatatatatgaacatgtacaaattaatatccaccagctggatgcacgagaaattaagcagtaaaaactaaatgtatgaaagcaagctatccacttagagagtaacacaactacgcagtcagaaacgaacatcttggcctggagagcgaagagtacggcctgaaacattgttcacataaacaggccatctgttttcatcgaataaaatctgctaacaaatcagattaggaacttaatttatttccctcagagaatacgactcataaaaaaccagcctatctattttacgcgaaagaattcaacccacgaataaatccaacttacgttacttttagaataagaattttgtgcttaaaaattataagcggaagaaaagtccatgctttttgggccgagctaatttcttccgaggaagttagcacatcaatcggccctcctcatatgcaaaataatttagctgaataaatttagcccacctcattttcgtgaatgaaatcatctgacgaataaaatatgccgattgtatattatacagtacttccttcgttacagaataagtttattttttttctcttcctatttatcctaaaataagatcatttttaagtaatcatttaatcggggttaattatcaaagtcaaaatgtggaataattacaacgagatttcataaagtgtggttataataatctttttggttttctactggtatgtgtaggataagtgaaaaataaatctattttgggatgaagggaatgtcacctatacatgcaaattttttcctcaaaagctgaaagtagaaataccatacactgtaataaccccccccccccaccctcataattttagtaaaaagttaaaagagttcgggtctaccttaacatcaatagcaaaataaaaattttaaaaaaataaaaacaagccgcggaaaatagggtaaatgcggataccatccaaactgaaggagggccaggtctcaagctagctgacctacacaaccaaaggccagataattaaactgaaaactcagctaagaaacagaaatcaacaatcgacaacattctcaactcacaccacatatatactacgtgcctacgtcagttcgtcgcaaagagccattcaccacaatttctctgatccaaatcaatttgcatcacggcgcatatgtagaaccccgttcagttgactacaatagtaagccaaacgaatgcagcgttgtgtgccgcaatgtacgtacagccatgtgtatttgcttgacctggttagggccatggtttgaaatttcagaaatttcgtttatttcaagcccccaccggcaaaaacacatgtttcgaaattgcaaaccctgaggcaggctgagatgtgtgatctcaaagctctagagcaaagcttggcagcactgccactctgcctcaatcggtacgaaacgtcgcaacaaagcacagagatgttgcatgggaaccatatctgctactctcacctcttgttctcgcaaacccagtgtattgttgttgttttctcaagagggagtagagatgtacaatttaactccgatgcgcactccagcttatgactagttttccgatgcctccttttcctatagaagtctgtggcacttcatcatccttttcgattaacttacattgaaattcgtaacagatgaacatgtatggtggggatgaacatgttgcatgggtttttgcctcctttgcaatatagtatataaaagatatgccgcatgtatgttttatggtaagaccagcacctacaggtattacaagtcctggttcttgacaaaggtgttggttctaaaactggcacctataactttcggcattggtaccacaaaattgataccgattggtaaaccggcagctaaagccggttcctaaccggtactaatatgatgttatgtactagtggtaggtgcagcagatcaagatgcgcttctatttgcatttttactattgctagattagttaatttattcatatagagtgagaccactcacctctttttttcaagtcattcaaatgataatgaaaaaattatgaaatagaacaatatgtgattaccacttcataaatttgcgagtttaaattcgacaaaattaaaaaaataaataaaccctaacaaatatgtgcactattaacaataatatttaacatttaaatttccatgtttatggagtgatactccaaaaatctgtaattaatataagtaaaattactggttattttagagagattaagtatgatgagaaaaatacttgagtacccctctttcaaccatggatggtggagggtaagattgaagaaatttgatgagaggtgagtttgatagaataagtaagcacatgatgttgtctccacaccgtcgtttaccgcttcacatatctagctgtcacaaatgcattttgattagttattctgattaaaccaacccatccaacaatattggcatatgcctatgcctatgccgtctaaaaaccacaactgatttcaaggctcctacttcaccacccatgcatcttctccgaggttggccgcttgcgtgctcgttcttgtcagcggcgaggccattacaagcagccgaattcgaagagcctggaatcatgcctccgctaggcgctaagtccagttggaagtagaattctgtcagttgatcagttattcagattagaccaacacttctcgtgtactctacgctcgtcttccctctacagatcccattccttgaaattgtattcccggtgcctccctttccctatgcatttgacgatttaaggagcttgtttaatttgtgtctggatcatctacaattcctttggaatgggaggaattcaactaaaaaaacatcaatccgagagggttttggtgttctttggttcaccaaacaattcctatgtacatcgtgtatccagatcggaccttctcttctgaccaaattttgttgagacttctatatatcatagatgaaccacctacgcatatctatatctataactaatataaatattcgtatttttccggtcgtcacacctaattttcgtctgtttttcgtccatacacaatcctattcggttagcaatagcgatagaaaaaattgcaaaaaaaaaaccactaccgccggaggagaagagaggcggcggagggagcgccgctgccggatccgcccgcggtggccgccaccgccgacggatccaccctcagacgaagccgacgccgtcgtcgccgtcgacgccaccgtcgctgtcgacgccgacggggagagggagagggagagggggagggacggccgtctccgccacaccccgccgtcgctgcgccatgccggcgagacgctagcgtggggaaagccgccgccacagcccgccgtcaccgcgccgtgccggcgagaagggagggagaagggaagagaagcggcgccggtggtgggagaggcggccagctggggggagggggagcggcgggaaatggggagagggagcggcgccgccggaggggaggagaggggagcggcgccggtagggagagggggagggggagaggcggcatccgtagtgggggaggcacgtccaccggctgggggggagggggtgggga

SEQ ID NO: 21006 - DNA, 8066 bp, Oryza sativa
aaaaatagaagaagttcatttgtggttcttcatttttttcaaagcattataacaattatagtatttgaatatgtttaattcaaagcaaacttaaaagaaggtagtttcattcttttttaattaaataatttttaaatgatgtttgtattattaaaattagcaattaagctctgaaaattccaataaaattttaacgagtgtaactaatcatggagaatttaaaaaaattaaatttaaccatgtcattttatttctcacacttgctttacttgtaaatttatttaattatacacatacctacttaaaaataccaaatatttcagcgaatttgtattttaattaattgcatatttttctgatctgtacgcttcccgttgcaacgcacaggcacttttgctaaaccaaacaacactgggccgaagaaaaatagaagaagttcatttttggttcttcattttttcaaagcattataacaattatagttattgaatatgtttaattcgaagcaaacctaaaaggaagtagtttctttcttttttaattaaataattgttaaatgatgtttgtattattaaaattagcaattaagctttgaaaattccaataaaattttaaagagtgtaactaatcatggagaatttaaaaaaaataaatttaaccatgtcattttatttttcacacttgctttacttgtaaatttatttaattatacacatacatacttaaaaataccaaatatttcagcgaatttatattttaattacttgcttatttttctgatctgtatgcttcccgttgcaacgcacaggcacttttgctaaaccaaacaacacttttggtcaatatacacactccgtaatcacccggtgcaacgcacatgcacttttgctagtataactaaatgaatgtaggcaagaagacgccacatgcacatacgtatggtatttatcaagattctatggtatttatcaagattcacgaacacaactgtttacacccaaatttggcacgtaggttcaaattaagcaaaattaccaagatttgggaaaatcgccgatttcctccacagggctggtatgatcgctgtttgtgggctggtcagacagttacttgaaggccggtcagaccggcgtcatgtggtcggtcagaccagcagagtccgagactgagtctgttttcgtcgggtctcaggattccttactcggcaggctatgtttcgggtttcctttgctttctatcctgaattggacatggagatggaagcaaagtatttagttgtccgatcgtgcgtgtccacttgtcaaaaagttgtcaacataaacatcacaacataataattaaccactccaattaaaaagtagggctcagtagtaagcaccaccattttagtctgtttggttcaagaaattagagattattcatcaaattagttgagataactccatttcttatttcttcgggcagagtttgtgccggcccccacgtcaccataaggttcgggcgacatgggcagtgttctctcgccccgctgccacccccacctcgctgccaccagaacaagccatcaaaatccgcatagctacaaggacggcggtgacgggccttcccttccccctgagactttgaggtcgaagcccacggcccagatgcggggcggcgctagccgcaatggcgacaggtgggaggtggtgcacggtgccaacggcgacaaatgagggggtggtgatgagggttggtcggacggccgtggcaagaagggtccgacaacggtggcaagaaggatcggttaggtggggttgtggcagtgggaggtggacagtggtgaatctaaatgtaaattgaggtgtggttgtgtaaaagttatattatgactcaaataaactagaaatatatcgacgaaattagttttcaatgaaatccaaaaaccatatgatcggaagagaacacaattctttctccattatatataaataaataggtaataagtatggtccgcacagagtgatccacgaataaaatctatattgccttgtcttgctcaaaacaactattggtatggtctgctttagctagtgaggtagcttgccttgcctcaaaccagtttttcattgattaatggttaattatatgtgttaatggctaattaggtgcatgaattggaggtggggatggcgccctaaccagccccaacagtgaatccgccactggttcaggtggaggcggccagcagcctcgccacaccaattgcggggtcgacagcggcagccaacgacatcgacgagggatggattgcccggtgcggcggctcttgagcagtgggctttgtcgctggcctggcacggccggggtgcaggtggtgccatcgcgcaggggtcagaggctcgagcgtgtagatacagtactgatcactgaatactgtcagtgttaatactagaagggataccatcatctcaatcggacggtaaaccccatctcaattggacacggcgtccatcacaggctagaagtcacagatgtgaagagttatcttaatcgggcaaacggccgtcacggatgaatctatctcaatcgggccctaattaaacgccgtcaccgatagctttgacccagacgatcagtcaaactatagcccgtcacggatgacctatctcaatcgggccacaactagcgcccgtcacagatgacccttatctgtgacgggcattaactatagcccgtcacagatgagtcatctgtgatgggcattaaatatggcccgtcacagatgacactcatttcaatcgggcctaagttaatgctcgtcacagatgagtataatccaaaaaaactaaattttattttttggctagtcttaggcctcctaggccagtctttttttttgtcctcacttgaaattcaaacttcccgattggtcacccatcctaaaattgctccaaaccaagtagttgtaacttgttggtataagtattctattaatcttattaagccctaggccaggatgtcaaattggggttattaaatgatttcaaatggaaaagtcaccaaaaccaaagttgtagaactcatcgaggtgcaaaatttttattttgatcatttctccatatggctctatttaaacaatttgaaatttaaaattcaaagtttgaaaagttcaaatagaattttagatcagtctaaaaactgaaaaagtcataaacaacaaagttgtataactcatcaatatctgtaacttttattttggtcatttttctatataacattttttgaaccgtttgaatttgaatttgaaaatatgacaacttcaaacaatattttcaaatactaaacgatatcaactgaaaaagtcatcaacaacaaaattgaataactcatcaagatctaaaacttttattttagtcatttcttcatacgataaagtgatagtaacattgttcacaaaattgacatatctcttatctggttttataaattataacacatatatgtaaaatttgtgaataatattactaacattttgtcggatgaagaaataacaaaagtaaaagttttagatcttgatgagttattcaactttgttgttgatgactttttcaattgaaatcattcagtatttgaaaatgttgtttgaatttgttatattttcaaattcaaattcaaactattcaaaaaaaatattatatagaaaaatgaccaaactaaaagttgtaaatcttgataagttatacaactttattattgacattttttccatttgaaatcatttactacccgtaaaattattttgactcataaaatgaattattatactggacttaattattttgctatagttcaacttacaaatataaaaatttcatataaaaaatgaaaaatagtcatcggtgacgggttttagttaatgcccgatagagattaagtatatagcccgtcattgatgagtcatctgtgacggacctagttgctatctcaaacggggccctttaaaaggtttttgggggggtttttgggggcccccccaaacagtacggatgatggttatccgtgacgggccacaacttgaggcccgtttaagatatggaatgttatctcaatcaggcctaaagttggcgcccgtcacagatgatggtcatctgtgacgggccacatctttaggctcgtttgagatatggaatgttatctcaatcgggtctaaactatggcccgtcactgataggtgtcatccgtgacgggcttaagttttatgcccatctaatatgtctgtgcgaccatatttcaatcgggcattttttggcccgattgagatgacttccttgtgacggcccgctatttctaggcatattagagcccgtcacagatagaagaatctgtactagtgtgtaaggagttgcctgcagttacgcaatcgccacgattccttgcctcccactgtggggattgccgaagcacagagcatacgcatctttcaggctcctatctcgtagtggtttcttttcgcccagtactggcaggtagtatggattataaaacgctgcactagtcacttggacctgaattccacagatgcctccatttcatactggaattcgtcagataagagtcctattgactcccgcagtgacgggcacaggttgtgatcgatgcacagtgagatcgatgttgccactgctatttatcatgaccctcaatgtaattgcgctatgcactggttgagctcacagagtgaagtcaatatatatttagggaaccttatggtgtggaactacttcatgattgcattcatgcacatgtctatatttatgtgcttgactgtctgaaaggagatagcatgtcactatgtcagtttaatctgatgcgcaaaaacacatagttgctctccctagctggcggactctggtcattattaagcgccttttgattacagatgagaagttatagttaattgcagtagatgctcatttatttatttattttgtagagttctttttttgttttcttccattatcttaaaaaaatctcctggaattaaaagtcagaataagtcaggtattatatactagcatcaatgatggtggttttactttcatcggtaaaccatgcaaatagtcgaacaattacagcagtcaattgttcacctggatatcgacataactgaatacaagacgagactctaagccaggcttcctgtccatcaaatatctggacgaagcatgcgcggatgtttccaaccatatcatcgatgcttcaaggtcagcgccatggtcacggtaatcctagctcttgccgccggcaaaaatggatgaaaatgcttcaaggcgggctgtgcccaggcaccctttggtcttcctgctgcgttgcatatcaatcttctggtcggcttgcacttaatttgcctctgacatattgtttgagctacacatacatttgcaaccttgcatcgatcccctttctattggacgtgattgtccatctagctagcttgagagtacttgcagatgttggcccatcgtgatcctcctattacattacccattgtaagaatttgacgagagagagatatatggcgcagcttgtgtttatttgaggggttatatatatacactggtactgattctttttagagttatattggagtaaacttgctagttcgtatacggatgcatgaatggcagcgtcacacaaatatgttgtctatgcgcatgaattcacaaggagctcgcaagggtacgtagtcaatgttaaagggaacagatggactactgcaacgttgcattcttgcatatgtcactagaattatgtatctggcattctgagtgagagagcgtgtcgaattggcaatataaatctgatgcgtacaaagagaaaaaaaaacaattgctctggctggcggactctgtcgtcattaaccgtcttttgatagcagatgaaaggctatactaactgtagagtattgattttttttagtaaagtccatcgccggtccctaaacttgtaccgctgtctcatcccggtccctaaactcgcaaatcgaccgttcaggtccttaaacttgttcgactgtatcatcctggtccctaaacttgtagatcactcgtttagctcttctccaacttgttcagttgtgtcaccccggtctctaaacttggatttgaatatcatctgagtcaaataggacggtctaaagactttatatttaaaaataattcatgactttttcatgtgaactctaatgaagacaaactttgggcctgtttggggaagctttagattctgagaagcagttgtttggtagccagcttctgagaatctggaaaagctctaaaacctagcttctccagcttctagctttttagttcattttttagaatttataactacagattctcagaagctgtggactgtttatggcagcttttagcagaagcagcttttgggaaaagctgcagctgggataagctcccccaaacagggtctttatatcaaacttgtagccctcgacgtgatctacaactttgtagttgaatttttttattgtaagtcatcttttgtcccaaaatgttattttaaaattaaaattttaaaatctataaacatgcaacaatattttgggaccctaaacagttttaattcaaaaacttttcaactacaaagttgtaggtcgcatcgagggctacaattttgatataaagtttgtcttcattagagttcacatgaaaatattatgaattatttttaaatataaggtctttagaccatcctgtttagggaccggggtgacacaactgaacaagttggaggacctaaatgagtgatatgcaagtttagggaccgggatgagtcgaacaagtttgaggacctgaacggtcgatttgcgagtttagggatcggaatgacacagcagtataagtttagggaccggtgatggactttactctatttttttttgttctcaccaaatttgggctttatatctcggggggaaaaaagttgagaattaagtgaggtgagaaagtttatatcgcgctggtgatggtgatggttttgctttcaacatggtaaagcaaataaattgaacacttacaacatattcttacacatggctagtgcttaagttctttcacagtgcgtgtatgtggcgcgcggcccgagcgtagattccataccatgtacgcgagagtcgtagtcgctagcgaggaacgcggaacaaaaatgggacacccgttcttcagacgaaacacggctttgcagcatgggttgaggcatccggccgcactgtgaaggtcatgtcctatcgtaactaattgcctgcgtccaaggttcataaatcactgttgctacatagcactataagacctatgtccttttaggaacttgagcctagctggctagtgggatccaacagatgagaagctgtactgctacgtactgccctaacaggacgaagcacacacggctgcaaactgaaggaagcacatgcttgcttagaacagattgtgtcttcattaaactcccggtgcctccctttcctattggacacgattgtctatctagcttgagacttgcaaacattggcctatcaccaattcaccatatatcctcctcatatactgcatgccgtccaagaatttgatgagagagatggatgagaagcaagttgtgttctgttttgtgggactattatatatacatgaattcaaaggagtgagaagctggagcaatttggttcagtagaggaggacatagactgccatttacggctgtgttgaatggagccggctgatctggcatttcgaatatgtctcatcatgatctcttcgtttcttcctttcacgtctctgatttttctataatgcaatttaatttgtaagagccatcaacttggttcgtgatgagcccgtggttgtacaaggtcctcaacagccagaacaggagaaactgtgttgccatggacaagctctggtcagaaactctccaccacactcttccagtctgtgtcctttgttactggctatagctaccatagcagttgttcatgaatttagcaaatggctctgtaccaagatcccggt

SEQ ID NO: 21007 - DNA, 15814 bp, Oryza sativa
aaaagtttgtagcagctactccaccaaccatctcaacactatttctctcatcgaagaaaagtagctataattagttgagtgattttagggcgtgtacagtaatgattaataggggctctttagctttgctaaagaggaatgtttgctgatatggaagagaaagaaagaggagagataaaatattgttgatgtgagtaacaatggctcaacatagaatgtttgctggcacggaagagagagaaaaaggagagataaaatatcgttactatgagtaacaatggctcaacatcgactcatagcctttataaaatggaaacatagttgcatgagggtgggaaaaaaagaagaataagaaaaaaataattttgagttaatgattaaaacctttatcgtcttaactattgtatagacacggtctctaaataatcttgtaacgtctaagataccatactagactcacattgatacttgttggtattagaggtaccaagatttacataagaaacatggtaccctctatatgactatcagagactataaaatttgtctaattaattgataggagtagaagaaatgcttcgatcaaagagttctaccagtgcatgtgcatgctattctacaacatcatgcgtgtgaaaaatacaccatggcttggttgacgagacctataattcccatcagccaaaaggacagaggaaccagcctgatgaattattcctgatgctgcctccatttcctattcaagtttgcacaacagcgatcatccatatgcatcccatcattcacgtctttttccctgccaatatgcaacttaatttattggacaaaatgaagttcaatgttgtgctcgctcataatgtggaaatgcacacacatataacttgatttgatttcaggtgcttgaaaaaacagcatcttaggtactaggagttaccaaaatttacgagagaagatttggtacctgcaaattcttattaaaaaacataaacatatagagagagagagagagtgtgtgtgtgttttgtagattgctatttttcactggaatgatgagcaaaggtaattaatttacagtttagtgtaacgacattggataaggacctattgagtttggaaccatggtttgatcccggcaaatgctccaacactagctaggctgaaattctttgtacatagaattccttgcactggtggagaaaccgtttgtagtcccggttggtaaccccctttagtcccggttgtccaaccgggactatgaatccgggactaaagatagctctatctttagtcccgggtgaaataaccgggactaaagatcgatctttagtcccagttcgtgttaccaaccgggactaaagatcggtcagtcacgtggccggctaaaccatttttagtcccggtttgtgttacaagtggaaatgaatagtcctggatgcagaatactccttctgattcttacacttattgcatggacaacaaataaaacccttttgcctgttagctttggccactctcaaaaaataatgcacgccgttagtaaactctttggaccgcaacagtcagcgtacatccattgccgatccatctacatgacatgaaaaaaaaatcgtacacaaataattattcgtgcaataatgacagtcatacaataattataaaataattacaaactctttcaacaatgacacaataatgacatatcattattcatacaaaaattatgaaatattacaccaaataattcttatttactatttataaagttttaaactaatattaatgtgttgtacttattttaatttttcattttagtttgttttctattattcaagattaactttcactatattttccttctcaactattttataaaaccttctttagcaaataaactaaatttctatatattctttcttccccacacaaattttctctctcatcaactaacaacaaaattttgaagacaaaaaagtgtgtaaaacatagctccaaatgtaatatgaccaaaaaaaaacattggaggatgaagttgctaaccttttaggcacctccgatttgtataaaatcaccaaaataaattcactagaaattttggcatgacctcccctcttttttgaagaaattttgaagcttgctcgggcagctggagtagaaagaaaacatatatataggggtgggactttagtcctggttggtgttatgaaccggggctaaagatcgctaaagtttagtcccggttggtattaccaaccgggactaaagatcaaatatgtccgttaccctttttaaccgggactaaagatcatctttagtcccattttttttgcaaccgggactattgtggaattaggccgaccgacgaaagatggtttctctaccagtgttggtaatactacaatgcaaccaggttaatatatatagctgcatatatatgtttagcatgcttgatcgagatcataaaaactctctctaaacaattaattatgctcgaatcgatatgctaagctgtaagggatgcctctcgcgatcggtatacttgctcgagcagctcacatggcgcgtctccccttgttcctcagatcagttcgctaatctggctagcagagcaatttgcacaaaagatataggccgtgtttagtttcaaaataattcttcaaactttcgacttttccatcacatcaaaactttcctacacacataaatttccaacttttccgtcacatcgttctaatttcaaccaaacttccaattctagtgtgaactaaacacagccgcaggaaccgtgggactgcgattcaatggtatcaagaggaattgccgcacgatgtgttgtggcctcttgtcatcaaagaattagcacattgcaggccgctagttcatcaagatttatgtgggtgagtgtaggatcgaatcacaagaactaagccaaccagaggggggtgaatggttgatatacccaaaaacccaaacttttagcggaaataaaagttaccctcaaattcgatgtagatcggtctaaccgaggttgatccgccggtctgaccgagctcgtgccgccggtctgaccggtgttgatccgccggtccaaccgcctgaagattgcctgccgcgtgtgaagtcgccgccggtctgaccgcctctcctccatcggtctgaccgccgcctgccgccggtctgaccgccggtatgtcgccggttagactgccgaaacccgatgaaacacaaatcgaagaactctcaaagtagataacaactttattacttctctctgtgtttacaaagtgcaccaacagcactccttacaaaaatctcgactaaactcgaaaccctaactaaactagcaactcaattgctctcaaaagcgataccgggaagcctcacgctccccctctatttatacatgaggtaggcagcctaaagccatgaactaaactcatactaagtgtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacattgtcttaccaccaagccgactcccggtccatcaccgcaaatactctcccgaggcatcgggtcacctacacatgaaataaacaaagaaaacatattctaagaccaagctatccccaacttgactcattgttagcaaacaacagtattacatacgtatagtatccatctagaagctataaccatgaaacaatcacagatatccaaagaaacaacccgaaaccgaaaccgacacagcgtcggccggtcagaccgcgggccggctggtctgaccgctcgatcaccaccggtctgaccggcatacaccacccggtcggaccggtcacataaaataacagtgaattcgatcatcacctgaaaattgattatctcaaaaccactttcgacgataatctccaaatatcaaaaccaataatcatagatgccaattgttcatcacagaataagaatcaaaacacactttaatcttacagtgagtaggcatcaaactcccgttgcctccctgtcctattggggatggttgtatgtacatctggaatgatatatatacttgttcaagttgagttgttgtcgctgtgctcttcctccggttggcaggctgattactgttcaacatgggagattatcattatatatccttgtcatgacaaagtataacactgaaaggtgcatgcaacacgctcacaggctctacccgttctgtttaacatgacacacctaagccatatatagcacatctaccacaatggttgtgaagatgtaatgaaattttcattaggaaggttgataccacctgctagtacctcgtcaagtaccatgaaatcacgctaatataatggtgtggtcttattaaatgttagaccatacaggaaacctgaataaagcgaagaaaacaaaaacaatagcatcaatcgagagcaattacatattttagtattgcctatcttttgaactccagttcttagtactggctgcttaataaggttgtaatttaggtgaaattttaagttaaatatctacatgtagtcataactatttttcttctcacaactattctcagaaaaattctaaaactttcgatgaagttcatgttcagattgttttaatatatatatatatatatacatgtggggccacaccaatagaggatgaagttgctagccttttacaattatgaagtactctttttttttctaaaattatgaagtactcttattttctctacaaatttattctctcctctttttccataacccttttgtaaaagaatgacatatagaccatacatcaatacaggatgaagttgctaaccttttatatccttttgatttgtgtaatatcaccaaaatactttcacaaaaaatttgagcagcaactctcttcctcctcctcctcttggcagcaatgtctcgggctggagaaggaagaaggcatataaaaaaatgaacaacaccaaccggtactaaagattatatgtactaaatatcaatataatctttagtaccagttggcgacatcaaccagtactaaagattgattttagtccctattcaacattgtcagaccgtgttgtactaaagattgtatagtaccgttggtgttatcgaccagtattaaagaacatctttagtaccgtttggtaatagatccgagaaatttgtgttttttgataccacgatgaaagatcagatctcaattagtgtggccttatgtgtctaacttgtgttatctagaaacaattggttgcaaaagtgtttttttggtccaatttgagactcttgtagtgcatccattttaattttcttcacacactaagaattccatgtcatttctacttgccacgaattgtatttagatgtatagagtcaaaatatggtataacagccctcttggctgctgcagttgttcttctccaagaaaaatcatggtcgccgcaaggaagagaataattacacttccacaaagaacatcacattgttatctcaccaagtgtatctagttcctcatggctctctgcaggttatctcgccaatctcaaagtgaattcatccgccatgaaggaagaatagccgatcagtattcctgatgtctccgattcctaccctaccctgagtttacacacgcgtacaacatgctctgattcgcctccttgtttgtctccctttttctcttttcacgctacttcatatatatgagaggacggaatttcatattggcctcgctcataatgtgcatacacaagtgggtgcaatttattgctgggtgtagatacgtaaataatgcactagcgcatggcctacaatataaataatccaccagctatctccaaacccttgctccatcagcaaagtgaattcatggctgaacatcacgtccaatataattggcatgcacaaaaaatgtaagcgtgattggcttgctaattaagttcacatgactgcctgtggcctccgttagtatgctttttttttcttacaaaaatacagagcatgcttcactgaaattataggtaagagaacttgaacacgtaaagatcaagagcaagaaaatgttagtccaatacacagctgagacaaatatgggtttgtccctgtcgtagtgcactgtttgttgtgaatttttgcatgtatatcattgccctattgcgtccattactacacatattcgatggtagacacacttgacttagatcaagattaatggttgtgtttcatattataatccacaaggatttcaaattttaaacttgatttttcagaataatcttagctaaatatcttttacttgtcaatcgtgaaaaaatatctaggcaaagagttatgaagaaaactaaaattattcttaaaataaaattttgaaatcttacgattatagcaaagactcaacaaatagatcatcttagcttgacagtcgacattacacccatggatgaatgttgcgatgttcttttatccatgggaacaccttgttcgaaaaagcaatgattgatatatctttgacatgtatacccctagtatctttcaagtaccataaaaaatccgagtattaaagagtattggcacacttaattctaattgtcttttttgcaaaaaaaaaaacatatcaaccaaaatcattatgtgcatcagtatgcttgtctatgtactcctcgaacgaatgcatcaccagtatctacattactgggtcgagtacaacacaaacaggttgatctggataatagacacacttgaactagatcatgtttgtttgaaaaaaaaagagtgaaaggtctagaggataggcacataaggaagaaaagtgcaaaaagaaaaaaaatgacaatagaatggtaggagaggaagttttacgagaccaaaaaggcattatgatcaacttagaaggataaataataagaaattatttcaaaactccacactcagttgtgctcaagtggatagtcgtaagctagacaagcatatccaggcgagatgtttctgcttggatagcagttctctcatcttagcagccataagatacatgagagccgtagaattaactccagcgggatggtagtaggaagaggtactgcacacgacgtgatgtagcttcttcacgttagagaattgttatcttgcacactgctaccacacttcacccatatttggcttcatggctacgaatggaacttccggtgcctccctctcctatcaggcatggatgtgtactacacatcgagaaagatactagcttgttatgttcatctttcctagagttcaacaggagagattgcctgactagtgtttgaggaactacaccacactgaaacggcgaacgctacatatgtatctgctcaattatatctacacttctcatcatgaaacataagctatggtactattggtacatctagtactccaacaggcccaccatcgtatctcaacaccttcaattttgatttttcgagtaaattagtttgctactcctaattgatagtaatcttgaatggcagtcatcttatacatattgcatgttagtccataaaggaaggcacatggggtgaaagaaataacattaaaaaaatggcatcaagtcaaagcaattgcatgtttgcatatagcatctagtctatatagactgaatttaaacgaattctagtacctagtacaagtctcacaatgtcataaggctggcatttttagttttgagaaatatagtacaagtgcaggcactcacaatgcgtgaacactcacccctatgaatgcacgcgtgtacaccctacccctatgagcatctttggaatactagaccgacatatcttgagattgacgaagtcaccacggctgtctcgttatcgacaggtacgtctcgcctaccagtgaaaaaataattagttgtaaatacgagcacccatatcaagtctagaacttgaacccagttgggttgtttccatcataaggaatcaaccagttgagcaacgctcacttcatcataagactgaaatttgaagttcaatatctagttcttttatgtaccttctcacaaccattctaaaaaattctaaacttcgacgaatgtttaagtttaaattatttataactatattcgtctttttccttcctagctagtgttctctagacaaaaaaaatgttaacaaaaaggccttcgctttcctatttcggggcctaacgcatctagggatgtcaaggggaccctgttccctggtccctggcagggataaggatgggcatgtttcaatcaccatttggctactaacgggaaattctctctcaatcggattagagactttgatgtgtttgggccatccaaataagaaacttacatattaaacatctctaccctccccattctattatttatacttttctgtagctgccaccaagtgacctagcatgagcatgcatggctgagtcgcggttgatcagagcaaaattcactatcagattgcttggtttgctagccgatcgacattgtcctggacggtatccgaaagtgtgatcttgtttggttaatttgctcctcgtgaagcgaaggggatggccgagtgccttatcagaaaataccgtgagtcatcgccatggactaggacgatatggtggaactccgaaccgtccacctccaagaagtgtgtcatcatcagcattaggatgaataaatgaggtggaagggacggtgacttccatagaatggcaggcaagagatacaatattagagcttgtacaatgattgttgatggtggtctcttagcgtagctaattaataatatttgtttatatgaaagagagagaaagaggaaagacaaaacatcgttgctaaagaatagtaataaaaggaatattttttatacaatggttagagtctttatcgtctcaactgttgcaaaaatatgatctctaaataaacttaaaatgtttaagagatcatacttgtctctaccattaatcatgcccttagttgtatatgataacatcttagatggaagtagtaagacaaactacacgccctgatacgactctttcacagcagacaatcattgtcctgctctggcttgtaacacgtccaaacagtcctaatgtcagtaacctcgaattgaattctggtgcctccctttcttatcgagaccagtacatatacatataagctagaatgattcttttatcattgccatctccctccaatccagctgatacttagaatatgattgtttcgaggactatatgtagcactgcaatagatatgctacatgctgagatgcctctatcctatcagctattcataaaactagtggatgttttttttgcgaaacaaccctcgtcttccccattttacaacccaatccctatccgcgattttttctctccgaacactgttcgtggggggcctatatctaattacaaaaaatcggagggctttttcacaaaatttaatctgacgtggcagcgcccagcgtccgccccaagcgccatcctttatagtctctaatgtactccaatggttcaaccgtctacaacaccatcaattaatttgattcgtggagtaaattttcttctcctagatcccaacaagaaggaaatcttgaatggcagtcttataaatgttagttcatattttcgaaacgacaaatatggaacaaaaaacatcaactaactgacattagctagctgagaacaattaaatatttttatatttcctagagtaatttggactttagtgctggagacgccgactggaggaggcaagagtggaggggctgattgtgatgggacttattggcttgagggtgtgtttagttcacgccaaaattgaaagtttgattaaaattaaaatgatgtgatgaaaaaattgaaagtttgaagaaaaatttagacactaaaccagacctgatttggaaccgactggttgttggaatacttctctttgtgttcgcctaggtgaaagtgatcgatcgatcagtagcagtgcctcagacaggggggattcctcgatgtgccatatgcactagagctgcgcatgtacttgtatataataccaatctcaccgggatcctcgatcgatctcgcaagctaattaattaaccgatcacactctcgctcaaacacaagattgacatgcaaccagatgaacacagtaacacatgcacgcaaggtgtttgatgatttgatgctgctgctaaccttgccgcagcttttctgcatgtacgtattcgttgcctgcagtccacgcacactacaagcacatgacccatctggattagcgtgtacacatatgtgccatcgatcccatatatactctttccgttcttaaaaaaaagtccaaccctagctagtatgcactactacagagataatattatggcgtgtgacccggacgtgctgacgctatcacaacgtgaacgtgcaggcctcggtgtgcagaaaatgctctggcacgctcagcaagggagcagccgagctcagctaaacaagctcgaaaatggctaactaagcttaacagacaggaaagcaaaactaacttaaccaacacacacgcccatagggctatcgacggactctgtactaactaagctcccggtgcttccttttcctggttgtttttgtatatcatgctactaggatgagtactgaggccaccactgtttgtcattctcatcttccatgagtctggctgttttgagggtaatatatactccatgcatcctataatataataatctagaattgtaggtatgagacatttcaaatacaactaatctggacggttgttatattatgtaacggagggagtatatatacagtactttctcggttatttttattataacatttgacaccattcatcattttgtgcaaacatgtaaaatataagtaatgcttaaaactcctttagtgataaatcaagaaaaaaaataaattttcttaatttttatttaataagatgaaagttcaaatataattaaaaatttgacgacgttatatattaaaaaatagaggtagtatataagaccggcaatatagcagcctagcaggtcatatatgctcacaagtatctgtgctgttttttttccagccttagcacatctactccaccaaccatctcaacactatatattcatcactggaggaaacttgctagtagtcaatatggaaacggttgaatagcaaattcttatcaattctagtatatagatcaagacagaagaagtatgaaaacaacatgcaagtagggaagagtgaggctaggtagatccatacctcgaggtatctaaactttatactagattttttaaaatttaggtatctctaagtaagtatatagagtacaaaattttacactagaaaatatagtacattattccggtacattcttaagaatagtaaaattattctttttagataatggaattcattcaggcctttacatcagataagttatacccaattattgcaaagactaattaacttgtgaattacaaaattacaacttgatcattcatacccgaccataagccaaaaggacagaagagaaccggcctgaattatttttggatgcctccatttcctactcgagtttagtttgcacagctagcagccacatcctatcattcacaacattttgtttccccacatgtatgcagtttaacttatattggcctcgctcatattgtggaaactcatatgcacatatgcttgcagcttgctatatatttatcactagaaagatgagcgggtataattaatttagattagagcttaattacttaaggtatggacaataagcaaaattgagtttctcgactagctaacataaccctgtcaaaagaaaaggattgctttatttggtcgctacataaaatggcaatttttcggtcaaattaatccatgtataatgcgatcatcaattccaatggaagaatccataagaggatcttatgggaggtaaaggtaccactaaaaatcaaagcatttatgtggtttcttcaaaaaaaaagtaattttgacgaaatataacctcataaagagaaaatagagggaaaacaagcaatgttgttttttaatacacaagaaaccatccaacatttttttctttgactgtcatgttgcatgttttgcttggcgatgtgtcttctttgccttcaatattccctctccccacaatgcaaaagatatttttggtaactggctaaggggagtgcctagacccacaaaaaaatgattttatttggagctagtgctctatgttggtcaatttggcgttgccgtaatgatatggtttttaaccataaaaaaatgcctaacatcatgcaggctatcttcatgtgttccaattggctccactcttggtgtatgatgctttcacaggaacaacaagatactatgtgcaatggtgctacacgcttggaattggtagccaaggaacttttactcaagtttggatggcgtagtacctacagaatttcgtgatagaatctacataattttaaaaaacattattttagtagatcatattatctgcagaagttgggagtttgtcccatctcgccttttttaagctcttttctattcacttctggactttttggctgtgtgcctacggacagaggccagatatgtaacccattttcattatctagacatggtttgatatcccgcaaatgcaatgcactagcttaaatggtttggcttaaaattcttttgtaatactacctgtcatacaatacaattaaacatgttaatatgttatatatagccgtcgttagttcattggtacgttcggttgcttggggcagtgaaaaactctacacagtttagctcaaatggatacgatcgataaatgtaagctagggatgcctctcctgcaggtagctttgatgctttcttgaacagatcgcgtggaaaaactctcgcactaattaacagaactagaacctacggcgcgcttcgcggtgcccttgctgtgtaaatgaggaaaataaataaggaggccctgaagagcctattcagtggattggctgtagcaccgctagctatagcattcaggttgtgaggaaaaccattgatggattaagtagacataaaatacatagaccgaatgttaacattgtttgtggagaacaatgcataatctagagtacattatacatcacagatacaaccattggaactaacatcgataaataggcaggaaattatggggtagattggtgagggccacgcctgcgaaattcgagaggaagacggcgtggaagcgtggctgggggaccaccctagaggtgtgaggcaaattctaagcagcagcgccggcgcagcatccacgatcccccctgcacacgcacacacattcagaacagtaggcagggagcataaatcagggcagcagattacctagtgttggccattgatgtaagagcgaaaaggggaaagatgagagaagagccaagaaaacaaccgaagcaacgcagctgtttgaatggcctcaatctctactaacgaatcaggtaagaggaacgataggaaaggctagggccatgccagatgcattaatgcctgcgcgcatgccggtacggctcgtgcgtaggacgatttgatgtggcctgacgaggcacgtcagacactgtagcacgcggcgcttagaaaaacatggcacgatagactcacagcctcttggatacgcataacacatggtatatgggacaacccacaaaaccgaccccacctgtcattggctctacaacgaataggtgcatgtccatcatttatccaatgtaataaccagtaggtaatttgcccaatcctttcgttgcactggatgaacgtgctcctagcgcacaaaacacaggcagagaggagcactcgtgtgaccagggattacggtggaccagacgttggtaggagaatcatgaagaaacgtgcctgcctcgcactgtcgcacatagtgacatcgcatagagaaacatgaggctatgctgggtaaacgtgggggtgcaccaaaagtcaaggctgtcaggcagggagagagctacataggccaagcgcagcatggaccaaggtgatttccaggtgggccatagagcgttaggaccgatggcacacacgcacccaaccacatgcccacggtgaaccgcacaaaggatccaaggcatcacaggatgaactataaacaccacctaattaaaccgacaaatcaaacgtgatatattcatcgtattaatcacataggtaatatgttctgtgtagcaacacgaaagacacatgctaaactttggtggcagcatgccacagaattactgggcaaattcctatcgccagcagaaaatgatgtgctattttttgttacagaaaactaatctgttattgcctctcttttttctggaaaatgaatctccatatcgaatctaccatgtgctctgagaagcaacataccatagtttttttaatggctatctaatttgaccatgcaaaaatctgcataattcaaggtaagaacagagagaacagataagagctgcagttacaacaggctgtgtatgtggaggaatgatataattcaaggtccaaatattagcaggatctcaaggtctaaatattagcaggatccaggatcactaagtagaaataaacacacacggagtttctgtttacagtggcgctataccagattctggataggaattttcctaccaatatatcacccctgtcctaagcacatatccagttatacatgcttgcttaataggaaactaatctggataggaattttcctaccaatatatcacctctgtcctaagcacatatccagttatacatgcttgcttaatagaaaactaatctgcatattgagtgttatttttttgctgtagtaaataaatctgcatattgaatttaccatctgttctgagaagcaacatgattcataggcacaaatggatggggatctaggacagaagccctgatgtacttgtctagaacactaacttctttcaaaaaccagtcagtattgtgattttttttatcaaacagtcaacatgcttgtatagaacactaagggtgtgtttggttcctggtcaagattggatgggatacggtggtccatattttgctggatatggcggtccatttttttgtttggttgtctgaatatggcgattcaattttttgtttggttgtagggacaaaggtggatttggtgatccaattttttgtttggttggaggaagtatggtggatttgtaggtgtggtcgcctctcacttgagatggtgaatataacccatcaaattaatacataatacacattccattataaatacacactccattataaatacacattccattataaatacacatagaaaaaagaaaaaagaaaaaagaaaaagaaaaaagaaaaaaaaaagcagcgccagatctgggctcgccgacgccgctggcagcctcctcccgccggcttcctcccgccgccggccgcctcctcccaccaccgaggctcgcctcctcccgccgccgccttcctctctcgtcacccgcgccagctgccgagctcgtcacctctctcgtcggccgccacgctcgtcgaccgcgccggccgccgagctggtcgcctctctcgccggccaccgcgctcgttgcccgcgccggccgcctcctcccaccaccgaggctcgcctcctcccgccgccg

SEQ ID NO: 21008 - DNA, 4154 bp, Oryza sativa
tcgcccgcgccggccacagagctcgtcgcctctctcgccggccaccgcgctggttgcccgcgccggccgcagagctcgtcgcctctctcgtcggccgccgcgctggtcgcctctctcgccggccgctgagctcatcgcccctctcgtcgcccacgccggccgccgagctcgtcgcccctctcgccggccgccgcgctcgtcacctcgctcgcatcgtggtggtgaggggtgacacgagtcacgcaactcgcttgcccggctcgcccgagcctcgagcggttacatccggccaaatcagccgaatccctctatccagcatctggagggaatattcatctctgggctgccctatcccactctcgcccagcatccaaacaccctccaaaaagcggcggccatgtcctatccgggtatatcccaccaaccaaacacaccctaacttctttcagaccagaaactttaatcgctaaaatcaagcggcaaacagctactttaagtaaaatcagggaaacatttagcttctaataatcctaacatatccaagatcagctaaaccttcttccaatcacctgcgctagattttaagaagcaacctaagcaaaatgataaacactctgcagtaatatttacatataagtgcttcatctagtgtcgtaggtaattgcaaaataaacatgatggttggcatattcaaacgaaacagtgagagtctgcacacctcttaaatagaagcatggtacaaagatgaaatattacatgcttcaatgaatctggatacagaaagaatgtccagtgccaattgtacagaaaatctgcataattaaaatcaatatataaaggcaagatttagaggaatgaagtcctatataaagataaaatgaaaggccactgaatcctaaccattaattttctggcttcctcatcacaccaaaccactacaacttttagtttggaacaatatttgctagctgcttcattcagcagcaagcagacagcagtaaacaatagcccaccaggcagcaaaacgaatcgccccgatgttgttgacggctgtgagagtggaaggatcaagtctatagccatctgacatagaggaaaaaaccagatcaagactatctcacggtaggcaaagcgagtaaaaactgaagaaaagcaaataaaaaggggaaccacctcaatggcgaccgaacctggcatcctcgagcttgtttcccatcacaggccaatgtctggttcttgagtgagtgtgtccttgccaaatgctcccaccattggtccatgggtcgcttcctggccgaggctaccgtcgtcgcagctccgtggagcccaacacaaaacagggtaactgctgcaacgggtggcgaggagaaacgggcggagagtgcttgagggtgcggcaggagatgggcaggacatggaagagcgtgagggggaggccgtcgccggcaaaactccatcaccgcacccaaatccaacgctgcgccatccagtccctaaatccccttgctctactgggaggggggtgatggagggagcgccaagaaaggaggagggtacgggagagcgtgaggggaaagccgtcgtcggcgaggagaagccggggaggtaaggcaaggcggcggcggcgcaagggcaggggaaaggaagagaaagggcgggagaacagtgatgggtagggtttcaggggaatggagaggatagaatagggatgttctcttttgcagaaaacacccttatttcccttttttcagagcgcggtcctatatctagaatttcgtctccttcacgtagtatataccaagacattgagggctgttacgaaagagtacaaaacacaggaacatagggtgagggacgtaagagtaattatcaagttaatcgaggacttttttgcaagatgaccagttccaacgcggggcgatgtggataccaccggaagcgaacacgccagccaaaaaaccgcaaaatcgctatggtgcgaagcgaacacgccagccaaaaaaccgcaaaatcgctatggtgcgagcattctgcgatggtctttaatatctccgattgtctaccctctaccccgcagcttattagtaacctcaccaagctggcagccaaaagatatatatataagagcggtaggattacacaattggatggaaatgcatggcatggtggtaagactgcactacgtgcgtgtcgtagcttctccacgtcagggaatcggtatacctacctcacttcccccagttcgatatccttgacttcgaatcgaatcctggtgcctccctctcctattggatatggttatacatacgtcgtctaggattatgaaggacttgtcacggtcatcgattggcagcctgattattgcctacaattcaacaggagggtatctattcttattttattttgaggaattatatatatatatatatatacatatatatatatatatggtaaatttgtttggtgctccatggtgcccgggcaccattgttgaaattgagtatatacccaattcaaatgagtatgaaactttttcaattacttaggtattaacattaactactttactaacttgtttaaagcaagtttgaactgaatttgaacttgtttttgttagattttgattctaggtatatagcatccatacatataattagttaggtatgtaatcatggattgtgaaataaagttaaatttgagttgttttgttgataagtatagggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatatatatatatagagagagagagagagactactgaaagggatgtgatgcatgttctatttatcatgaatgaaaggtaagccgtccatagtaggtacaactagtttgtcacattccttgttactatgctttccgcacctttttacaaatatagaagttaaacctcaatgaagagatttgtgaaatgtgtgatttttataaaaaatattcagtagaactaaattattcatgtaaaagtcctatatattactagggaccttaaataaacatagtatatttctgctacaaaccaatagatctaatgatgcttttttttatcagcatttaaacctaaaatttaaatcccattaaataatattacgggctataaaaaatgggtgcgccaaccggcgcaacgattttctagtatttcgtataatcctggatgagatagctaccgatgggcctaccttttacaatggttcttctgttattagcagcatgatctgtgttgctgagagacaagcacgatcatgaacttccatggagaacattacgtcaggttcacaccaaaacagctttgctctggcatgcctccatgtcaacttatctcggtactcctgttgcagttgttccatacacgatgaaggaagaacacctcgtcagtattcctgatgtctcctattcatacccaacccgagattacatgcttgtaatcagtttgccctctcgatcgtttacatcttcctttgtcttattgtctatgttgtttttcctcttttcttgcatactttatatgaagggaataaagatattttttttgggggtcattcataacgtagatagacatgtgtgtgttacttatcgccggatgtagataggtaaatgtgctactcccttcgtttcaaaatatagtatttactaacattctctttccaaccaatcacaaccctccaccattcactttttccacctatctccactactcatccaatcacaaccctccaccatttacttctacctactttctaaataaccgtgtccaactctaaaacttcttatattctaatacgaacgaatgaagtagctcatggcctacaagataatccaccggctgtatatcatctctccatgggcaaagtgcattcgtggcagtgcacagtggtggagccaaaagccaaaaatttctcaaaagtatggctcaattgatgtagttttcataggcttgtcttctttgttctaaattttcaaaatttggtgtgttcaatggg

SEQ ID NO: 21009 - DNA, 27940 bp, Oryza sativa
atagttttacatatttcacaaaattttttgaataagacgaacggtcaaatatgtgataaaaaatcaacagtgtaaaataatatttagaaacgaagagagtattacgtctacaaggttttgtcacgttgcatccactatttcccccacatggatgatagatgcacatgaccagtgaacagagacggattcaatgtgggtgtcgagggctcaaggccacctcccaaaaaaaacaacctggatccgcccttgttctataattaatcaaataaaatataatcttaacttatactttacatatttataacaaatttttaaataagacgaatggtcaaactttatgaaaaagtcaatagtgtcatatattttaaaaagaagatagtattatacaattaaatgcgtttagacttacagctgccattagtagttagttcgttggtacattaggttggccttgaccagagatgaaactgttattgtataatatcaggcaagcaactgtgacgaaatcaattaagggattttgtgtcaaacgtataatttcaccgcactactagaaaaaatgtttttgtaggcggtcaaaagatattttcgcaagcggtcaaaccttccgcctgcttctaaacgacggtaaaaatccccaagttttactggcgggccaaagcatcgcctcgcaggcagccgttgggattttctcagatgatacaagcgttatagtagccccgtctgcaaaaatactcatggtgcccaaaaacaatttcccgccagccccacccttccctaggtttcaaatcacaaatcacaaattctcacaaatctcatccaagaaacagaatccaatcacaaacatccattcatcaacacaaaacattggattcaaatccacggcaatcaacatgtaaacttagaaaaaaaaaagaaacaacatcatcgtcgtcgccggcaaactcctttgcatgcggtggccgccgccacccccctccctcctcaggccggatctaggagggagggaggtttccgccaccgccaccgccctcccctctcctcgtaggggccggatctaggagagggaggggaggggagccgcgtccgcaccgccgtcgccgtccgggcaaccgctgtcgccccatccatgccgtcgtcgccatccacgtcgtcgtcgctccccctcctccagccagatctaggagcggggagggagagagggggagccgccaccaccgccgtcgtcggcccatccatgcagacgtcgccgtccacgccgccgccgcgtcccccatgtctgcatcgctgctgtcaccgtcgctccccctcctccagtggggagggagagagggggagcgccgcactgccgttgctcccctcctccgatcggattgggagggaggagaggaggtgagccggtggggaggggtggagaggagaagagaattgttgagggagagggagttaagaaaatgagtggtgtgaccggtggggaggacaagataaggatgacttaaagatttttttggtaggtacgatttttgcaggcggaccacataaggtttcgcctgcaaaaatcatatttttctaggcggagcacttaagaagtccgcctgggtattttcgcaggcacttaagtaggtctgcctggaaaaattgattttcgtaggcggatgatgaaaatccacctcggtttatatttttgtagcggatatttggctcggagggtcatacccgtctgcgaaaaaaaaaaagacccaacgtcggtaaaaatgctttttctagtagtggcaagtatcatgtaaactttttttttaagataatggataagtatcaggtaaactatatgcggcagtaagaaaactcttcacagttgagctcaaatggattggatggcagtatggcactacatagtaggaactgcaggagaacgacgcgtcgtcgtagcttcttcacataaggaaatcagtataccgcaactgctacagtgctacctcacttcaccaagattacaatccacaacttcgaatcgaaatcccggtgcctccctcttctattggacatggttgtacatacgtctagtattatagacgacgtgtcattgtcgatcatctcctccggttggcagcagcctgattgccaacaattcaacaggagagattatatatatatatatatatatatatatatatatatatgtttcatgagacacagaaacggatatatatgttgcatgctctacattatttttttttcatgaatggaaggtgtgtagtacattttttttatttgcgcagctaaacgtttggaacttagggtagaagaaccggcctgaattattttttatgcctcggcctgaatttctactcgagtttaatttgcccggctagcggccacatccggcccatcattcatgtcatttcgtttcccctcatatgcaacttaacttagatctggttcatttaatcctcacgaacaagggactgaaggggatttattccatacataccgtggtctgaaattgttccccctcaatcccctgcaatcctcttcaatcccctccagatcgaacaaggccttataggagaaaatgagatatcaacataagctcaaaaagaaatttaaaaaaaaaagcaaagcgaaacagtatgctcactagctacccaaagaaaatagtgcattagagcatctcactaataatccggtagctcaccaatttttatggcggtaaagctagatgcattcacggacaggaatggatttagccataagagacgccgcaatcggttgaaccttcaagtttcaggtcagctgggcgcatggaaagacaagggaggatgcaagctcagatctgctgaatgctaacatacataaacacatgtagtttatgatggtaggcaagagatataacatccatacagatagttctttttaaccagacaagtgagacaactactccacactatgttcttgcttgtaacttgtccaaccaagattgacgttactaacctcgagtcgaaatcccgatgcctccctttcctcttcctattaacacacacacacacatatatatatatatatgttgtgtcgtatctctctaaatttccaatccagttggtacataagttgttccgaggactatatataaccgctgaaacagatattgctacattatttaatgtatctaccctattcatcatgacacatgtgccgttaatggtcaccttcagtttgattgttggagttagtgaacttcttttttatttaaggttttaagaattaatattttaaaaataaaccctctaagagcaggtacaataacaaactataagccagctataaccacatatcgagaagaaaagagaagagagaaaagaaagcgggctgtagatttgtagccagctgcaacacagactctaagacgttatgtgtgtataagaggtgggaccgggtatgaatggtgtagtatatttttatagttaactattgtatgactggctattagattagctatatagatgatttggagccagtggttagctatacaattaaacttgctctaaaagtttattttcaaattcgagcctttcttttaccacgccagtacaccagcataacatttacatgctgccacgatatttatattgtcacaataagcttgccacatatatatactggtcaagacccattcaattggcacgcgtgacaatcacgcagatatactctagtcctattctgcaatgaagtccctcatatttacatcaaagtgcaaattcgttattttcagtttatgactagatatctttatatagttgtgtccagcggcggattcaccgcccggccagcgcgggcaattgcccgggctttgcatgcggcgtgtggaaggcatcgaggatgatttctctatgttaaaaccgaatgattagctagctccttgacaaagttggcaggctatatatacgtacgtagtagtagatgatttctggtacaagcaggagtagcatttgccgcactgtaacatgcaattaggccgtagccactagttaattaccaacttgcttgcttcacaatggatggcataattcattcactaaagtactggagtataggtatacaaatcatcgctttttataacaaaatcatcctgtttatactagtgaaaatttacatctatattgaattatgtttttattaaaaatttgttgtctttagttgataagtaaaataagcatatcatcattacatgagtggtaacgggtttactatttttcttatacttgcccaggcttcacaaaattcctagctccgccactggttgtatcatttcgagaaattattacaatgtagttcatctatgttgttgagttccacacaaagaaatctacaataattgagtataacatatactcctgccatctcaaattatgaggcttctaagttgtttacacggcattaaaaatagaactttgacaattatttcttagaatatattatcaataattaaaaaaatacggagtaagcattatatggaagtatttataaatatgaatataatagtacaaaatgcataacactaacatatactccctccgtcctaatatatagcagcctaataccggatttaacatatccaagctatgactatgaatatgggcatatgcatgatcaaattcgtagtactaggatatatcaaatccggttctagattgctactccctctgtttcaggttataagacgttttgacttgtttcaagtttgactaagtttatagacaaatatagtaatatttataatactaaattagtttcatcgaatcaataattgaatatattttcataataaatttgtccagagcttttttctataaacttggtcaaacttaaagtaatttgactttgatcaaagtcaaaacgtcttataacctgaaacgaagagagtatatattaggacggaatgagtactgtatagttaatttagttattagtataaggttacaaacattaacctttataaaattgtatgcgtgctacactttggaatgaatggagcgagtacattatacgtgacaaggaaatagatcattactatttacatatttcaaattcacttgcatttatgggccaaaagaagtgtgtaccaccaacccgtatttctgcgcactcaagggctatgttttgaacacctgcatctgcatgagctgaaattactcgcacatatcgacctaaaataagcgcactaggccgaaattacacactcctgggcaaaatatttgtgaactaccagctgatgaaagttactgttttcacgggctgaattctcttgtactcgcaggctgggtcggccttaggcacactcgtgggctcaatctacgcactcatgggccaggactagacgcatttgcaagtggaaaaagttcaacttgactccctcaacatatgtgaaactaatttgtattcctcaatttctcgcatgtcgtattacactagcaaatgctggaaatgaaacttcggtcttgtaaaaaaatagcatggcaactaaggagaacagctatggatgcacatctggctgcaatcttctcccagatataaagagtacaaatacagtatatggcctcatcagataagcgaaaaaaatgtttattttcaaaagaaaaggagtaatccctattcatcctcgcaaattttatcgaggatatataaataaagacaacaacaaaaacccaaggtgcagtccatccaccaatcatcacataccgaatgatcaaaattaattggcaaaaataggcatcgcgctttttctttacattcttccctaaaaagaaaacaacaatggcttgaagaacaggtggatcaggctcagttggagagtcagcttggacaatgcggttggatggacggagttgaagggaatcgggtgaaggtacataatcttcaaggagcatataagcacatgcgaatgaatgttgaagaaagccagatgcttttattccccttgcaaacagtagagctggcggatatttcctgaagctggaaatggaatacagaattgttattagttgttcaaacagagtattgcaaaatagaacaggccatcctttgcgtgaacaagaatgagtgtcaacactgaaataggataaagattttttttttcacagaaatcactgattgagtttaccacttcagcgaccagtacaactcacttaataaactacttttatgcttatatccagttggatgaacaactaccaataacatacgtaaataatcgtatccaacattttaatatatgatagattagttaaataatcaagcctctaatcacgataagcaatcaagattcaagcttctaaccatggtaagaattaaaaattgcacttccaggtatccctataagtcctgcccaaatttagacaaatcaaacacttacaggggtccagaactccaataccattgttggactatacacttggcagtgaaagtgatagccatatttgttatttaaaaggtggtcaagaaatggggctgcttggttggcggcttggaatgccacgccacggcgtggctcgccacaggagtgtggcggacgtttcgtccgcctcagaaaacactgtagcgtggcgaaaatactgtagctatggcattcaatggctgggatccaaacacaccttaacatcaattgaatagtagctgatgtagatgagaagagtacattataaacaattacagccccatatccataagcaatcaccagttggtaactactgcacaggaagttgcacatggcacatttgtctaacttgggatcataattggcccagcataatatctgatcacattattcatgtgctcaagtaccaccaattactttaggataacatgagcatcaaatactttaggataaccatgagtccatggattaagaaaaaacagccaaaccatgaaaagataatgttctgagtctaaactaataagacacacacaagtttgaaaaaataggcatgcaactatgtaaaccttaatactccctccgtcccataatataagcgattttggagtgacacaacctagtactacgaatctggacagggttgtatcacataatcccttatattatgggacagagggagtatatattctctaagatttttttttttttttgaaagactctaagcaaattttatcaataggtgagtattaccgtatagccagtccttgaattgggcatgaagggcagatgccaattcttttttccgagtatcatcaagctccaattctcggatattcttttgaatatcttccagagaaacatgctgaaattgtacagaaaggaatcgaacttcagaaataaatatgataatcaagagcatgtcagtgttttatcagaaagcataatttacatgatctgtgctcttgagacttttaacccccaacttgcagtaaataattgttagatttcataatcttgatcaatcctgctcaaactatattcacggaacatccaccacaactttttgctatgaatattgataataaaataggcaaacaatggatgcatatttttatggaattcctatattgtccacagttacatcagataaccaccctaactagcaagcaagcatctcactaaataagccctttctgattaacccattgttagaaagaaatgaaaattgtgttgcagcttgattgtaatgcatacatacctttttcctttgggaggcccaataaacttcaggcaaggtaaatggattatattttgtaggtccttgtgcctcaaaccaactgggaatctgtacagaaaattaggccccaatcacatttttgttacagagaaaaaatagtgattcggggattaaagttttgagctgcatcaaatgctgagcaatagggatattcttgatttcctactagttacaaccaaaaaatgtagcaaaatggcttcatcaattcttaccaaaactgatttggatgagtcaaagaaggcaaaagaaaaaaaaaacatgataatgttaatgcagatacatccacgtattcaggcaggcacatccaattcaacttaatctactaaagtactaatgaaacgtgaaatgaatactactggtcaaccacaccaggccaaaaactaggtaagcaggtgcagcatgataacataaaaagatgatttgaagggtttagtgactccaaagtcttcaactcttttacatctcttttgaactccattcaagttaggcctcggaccatgtacaactagtaagccccaaaggccgattagtcatttgattgcttgctacgtcacacatgtcaacattacattggacacataacgtgtacaaaaggttgtcatatgccaacaaatgaaaagctgaaatctgctcagtacaagcagctaagattttcactaaatccacgtgtctttgaaattgggaaagacaatcggagaagggtaacatatagttacataccaaaaagttggtgaatagatcaggatctagacaagtagcagattcagcttggacatcagaaacccctgcaggatgagataatgaatcatgtggatcaacaactcccagcacaaaaggttggtcccacttgttgatgttagaatccacaccaacttgcaccaaatgttctcccaattgtggataataagtattgaatggagcaacctgacaaagcaagaaataaaaatttatttgatgttgttgaaatacaaagagaattacattgaatcaaattaagtgtaacttccatgtttttaaagcaaacttgtttctgtgtgaatgaaccaaaatcaataaatcaaattataaactcgaaggtttgtctgattccttaacacttttgagggaaaactaaatatgtggtccttcactagaaatggttccttgccaactagcaagtattgccaaataaccaaaatgacataggttaaacatgcgctagtttcttttagcatctcaaatgatgtagtcgccttaatttgatgggatggcttcttattggttaacaattagttatgaaggatatgaaaacattcagatatcagcataggtttctgttaagaaacttgaacatcctgtatgtctccatgcttccttttttttttcctttttgattgtccataaagctatttatcctttatagcaaccagatatgtatatacaacagtgtacatttgtccataagatataaatagttgattagaaaaagatatactcacttgtaatttatggttgtcacccacaataagcggttggtgatttactcccaagtagaagatacattcacgacaattggcgatacaaattcgctttgaagctgcaatgatttgcactcgttcacaatgctccacttttaccacctgatcgcatgaaaattgttagaactacaaacagaaaagagaaaagtgtctataggcctttctagaatgtgcatcacattaagttgtatatctgcaagcacattccacaataggtcattgtgatgctatatggacccaaggtccacccacatgtcaataggcatcagtggcataaaatggtttgccctttggtagagcaaaattctaacaaagtgtgttggttgtcgaaacatcaataaaaaaaattcaagggatctcatactttttcatgttcaagctgaaatattgttaacaaaagttgtatgatatacataccttaccaacagcaccaagaacgatagtagtgtcagaacacccatagacagtggcatatttaacaggagctaatatgtagataacagagtcatggcagttcaaaacctacaaaaaaaaatttcatcaatagtaggctgacaaaatctcgactttcaaataagagtctggagtaggtagtttctgttttttgaattacaacacacagagatatcaataacaaagtaaggctattccgccctctagatgtttatagtactaccaaaaactaatagatgcatacctttattgaatgccctttgatatctgatgcttgtttcactacagaagttttggagaaaccctccaggaaagttgtatttcggtagtgtccttgattgtttggaacagcagttccagttggtgaactgctatgaattcttgaatttgtgacagcctcagccattgtcacatcaggatcagatgcactctgttggctgttttcctttgctgtcaatttttctgctgtattttctaatgaagcagctatattctgcagaatccaatcatgaacctgagcagcgggaacaggtgcagcaggcatgtctggatcagaatttgcaaaaaatgtagccacttggcttaaaggagtcccttcagaaaactgaaataaaaatccgagatgctcaaatgtctctgctgtcaatacctgcataaaaagcaatgtgcataacagttagggtccagggaatcttgagactaaaaataccataaagttgaatatacttttcaaatggaataattaatcctacatgacttaaagtgcccagatttattgggagtttgaaagtagtacacaacgatggacctatacatcaagatcttcaatattctattgatccaaaaaattaaaaagtacatttcattgcagaaattagcctagaatttactttgtcagctgcttcctgaacaggcgatgaagcttccgtacccataactgttcatatcatcatatgaatatgttatctgactattcattatttctttttatcacacagtggagggccctttccagtcctttatttgcttgataaagctttgagttataccccctcctattccaaaatgtgattccaaatgcaggtccatttgatctttcctaaatgtatgctgtttataacttccagtcttccagcacctttttcatcttcccttccatgtttgctcttgccaaacaaatgctactcctctcacaaatagataactcatcttttcaatgtggcaacaaagtcaagtcagttagggtgtgtttagttcacgctaaaattggaagtttggttgaaattggaacgatgtgacggaaaagttggaagtttgtgtgtgtaggaaagttttgatgtgatggaaaagttggaagtttgaagaaatagtttggaactaaactcggccttattttctaaattcttgtgcacaggtttaaaaggacttatatttggaatcaagaggacaaatttaatcgtagttatggactcatgggcactgaacaggaaacaattatatgtttttttccacaaacaactacatcagaaaaggacagacaaacatttatacaatagctatactaaccatagactcatcgccctctccatcaacagaatctgccaaaagactcagaatgttgaccatatgcttttgcagataagataattgatgagcttcttcatctgcttgtgaaggcataaaccggcgactgttactgcgtacaagctgcatattaacataaacaatgaagattaatattaaaaaggcccttacaagtaacaaatatagaaactgttggtctctgcactagcaggagtaaagcaagtcgcaagtgatggcaaagcgctattgtggcaatcatgaaaaggagcaaactggaacagtcaacattcaacagtcccatgcttgcataactcacagagtcatgaaaaagagtgactaaaagagcccttcggcctagccgaggcatctctagtcctaccataggactcctacacgacatgatagaatgatacaataatacaagtaaacagcatttcaaaggggaatatgaacagaaggtgagatggaatttctaaaagcagggatgaggatgaatatagagtagatatcaggataaattagaaaaggaaataggtggaccaagggtcaagcttctcacattttaaatttagaccttataacagtgacgtctgcaaataaattgtggcaatagcagcacattttgtgctgaagtatttttatcacaactattacaacacttaaccaacacatatttgcagtctatgtgaatactgaatagttgtagtcatcatatattggaagagcatattttgaggtataatattacaatccagctacagagaaaagcttacaaaattatgaatcagcttgagcgagcaatgtagctaccaggcaacctgatgattaattgaattgttttgaatgccccactctctgtgaccccgagtagccacagactggtgtccagtactatcataaatattaccagtttaccattgcacaacatcaaatattccaatggatatggataaagaaaaataacactgacaagcgaagagaaccattatcaaaggtttctcatgttcttgtgaagtgccagtagcattgtaaagttgaagcttttgtcagttcttacaatgtattcgtacaaaagcaaatatcttttaggaatcaaacagcatttcagactaaagtttttttttggggccagtccttaaataggaatcattcagctatggacatatcatgttatttctaacttatagtagtgatcccacaattgcattcctcagttggcagaaacattgcccatctctgtacgataaatccatttgaaattacattgaaacgggtcactcggtcgctcccaaatccaacgcaagtgatcataatcggctgccgcaaaccactgtgcacacaaagctaacagaacaagtgcccaccagggcggcggcggaagagggggagggggaggggattgatcgagacctaacctggatcggggagagcgcggagaggtagccatcgaaggcggaggtggagggccacacgtcggtgaccgcgggcgaatccttgtgcgcgcgcgggacgaggcgcttgtaggactggatgtagaggaagaggagcacgtcgcggaggtcggcgtcctccgcctcctcctccgcggggagcaccgcggcgagcgtcccgagcaccagcgccgccagctcccgcgggatctgcagcgcctccgcgagcgccgcggcgcccacccgcggggccgcggaggcgtctccgtctcccccagccgcggcgatgaggcgctccttcgtctgggccagggtctgcgtcagcgtgccctccgggaacaccagcttggggatcgggaggagcccgtgctcgaacgccacccgccgcggccggaggaggagcgccggggaggcggcagcggcagcggcggcggtggcgggggtctccgcctccgccgccgccgccgcggcgtcgaggggctcgtcggccatggctggatagagagagagagagagagagagagagagagagagaagagtggagatctgagagggaaaagtggagacggtgaaagggacggcgacggcgagtctcgtcctcgtctcgtgtagtaacatttctctcgccttttttttaattttttttgtgacgggtaattcgaggggtcgagaaggtgggaggctgtgccactgacaggtggggtagataagtggggcccacatgtcatgctcaggtaatgcgaggtactcgactcccacggccatgaatgaattcagcccatttatttctcgtcaactaaaaaattgggcccaccgacttccatactacaaattaggcccacttaaatcttgtcaacgaattcagcctgctcaataaatgataacgaattcggcccaccgaattcccatcaaccatttcagcccaccaaagaggaagaataaatttgtcctgcctaatcttgtcaacgaattaggcctacggatgaatttggcccatcccagtaaatcaatccagaccactaacgaccactaataggttgagcaggaataagtccattttctctccctcaactcatggccgtgtatgattagcatccctcaaccgcaaaaccgggtataacccatcccccaactccgaaaaccgttacaaatcaactccccggacggttttggaggcggttttatcctacatggcaattgacttgcttacgtggcagttgacttgctgagtcatcaaatgggacccacatgtcagcagtctccacctcatctcatcttctccctcatctgttcccctttctctttcatatcttcctcacctcaccttttgaccttctatcagcagggcggcgacgacggcgcacgggggatgaactcgtcggctggccacgcagcgtgcgggggagcgactcggctcgagcacgcagaggaggcgggagggcgccggggcatcatctgagagggggtcgtgaggacgaggcagcccctccaagtcgccggccatccgcgcgtgtggaggatctcgccggcagtcctcgcgcggggaggagcacgccggccgtccgcgtgcggggaggatctcgtcggccggccgcgcgcgggggaggagctcgccggccatccgagaaggaagccactggggatgtcgccgagcgtcgggttgtactgcagcatgaggacggagaggctctggcacggggacgacggcggcattgcccgcagctgtgcatggcggacacccgctccgcgttgcgcgcacgttagaagaactccgctagcttgtttgctgtttgctcgtgttcttcgacgatttcgtggtctctgatttgttctgttcgttcccctttcttgtttcatgtgatcgccggtgtcttctctgaattcggcaaccaccatgtgctacttgtcttgccgttgatcttgctgctcgattctatcgcctcgcctccgcttcttgatttttcctttcccgtttcttgaagggaatcatggtgagggagaagagatgagttggagactgctgacatgtgggtcccgcttgatgactcagcaagtcaactgccacgtaagcaagtcaattgccatgtaggacaaaaccgcctccaaaactgcctggggagttgatttgcaacggttttcggagttgggggatgggttatatcgggtttgcggttgagggatgctattcatacacggcgatgagttgagggacatctggacttattccggttgagcatgcttaattcctggcaaaaaaatcgatccacagattattcggcccactaaaattccaatcaacaaatcccgccacgaaaaggcccggaggaattcagcccacctatgaatttagcccacgaatctcccgtcaacgaatttggtccatgagtgaaattcggcccactattttaccgtcaagaaaatcagcccgccaaagccacgaacgaattaggcccacttaatttccatcaaattcggctcagacaattcccatgtacgaatttagcccacttattgtacgttagaaatatatgcccatgagaaaattttggcccaccaaatttccgccaacaaattcgccacgtatgaaattggcctacttctttaacgtctatgaatttggcccgcaagtaaattttgcctacaaatgcctacttgtttcacgccgacgaatctggcccgaaagtaaatttagcccagcaattatcttcgaagaattcagcccactaaggtaaaaaaaaaagtctttacctatttcccgtgaaagaattcagcccaccaaggaaaaaggtcttttcctatttcccgtgaagaattcagcccatcaaagaaataggcccattagtttccacatcaatgaattcgaccccaactaaattcagaccagtgaacacccaacaaatcattaggcccactaatggccacaaatgaattcggcccgctaaattgccaagaatgtattggactcaaaattgaatttggcctgcttaactcccaaggatgtattcggcccaaacatgaatttgacctacttaacatccatcgacaaattcggcccaccgataaattttgtccacttaattatcatcgacaaatttgactaggattaaatttggcccacctatttcaagttaacgatttaggcctatcgctgaatttgacccagttcattctcatcagtaatttcggcgagcaggcgtatttagcccaccaattacccatctgtgtattcggcccaggaattaattttttcacttgaacaaatttcagcccaagattaaatttaacatcgacggattcgagccattactgaatttggcctacttaattctggtttataaattgagcccacccgataattaggcccaccctgtcccatcgataaattcagcccgaaggtaaattgggcccacctttttaacgtcgacgaattcgggcctcccatgaatttggcccatcaacaggatgtttacacaaaagcccttacattatcacgaaatcgccaacgacgccagcgccgccgccgtcccccgtccttccgccacatcgacggcgatgtccccgccgacggcgatccttcccgctctccgcctccgccgtggaggtgtcacgatggaagggcaaatccggcgagcaaccaccgggcctggaggttgtgatgtttgcggcggcggcgggcggagcaactgacggcgacggggagacgaggcggcggtggaagagaagaagacggagataaatattgggattgaggatttccgttgaggtgcccatggtttggggttataattactcttctgtttctccaagcaattctttctctaggccgaataattatcactttaccagtcaagtcagtttgaagatttcagtcaaatttatagtttcgctcaacaaaaaatgtttaggtatttgatgaaaatttaggcctttgaatcgagtctctgatttacaacagtagaagagcatatcacagctctgcattgatttagtttttactcctgtcaagtaagccataagattcttgattattggcaaactggccaaattacttattaagttcagttggaggtttggtgagttctgtccttttttttgattctttgtgaagattacaagatcctgtgaatttgatacggcacaagctgcctggacaattatgtgtagagacaattgacaagtcatactgaccgctttttccccgattacaaattcaaagtctaacactgactcaatgatttgcttcaaatgtttcctcttttttttttgtgaagtgcacgagcagtatctaaacttgtgtgggtgtatcatctagatccctaaactctcaaaatatatttttagatcttcaaatttgtcttgggtatcatataagtccaaacgggccatgtactttactcttttgtttttctttttaacggcaatttgcttcaaatgttactatggttcctttacctatttattaatttcttagtgaagtgcatgcggggggtcatatccttaccttcaggctttcagtgcaggtacaaatgcagctgaaatgttcagaaaggttggtcagcctgaaagcttcagtgcttcacacggttgatgatacaatgtggctgaaactccacaggtaaattattttgtgctgctagttattgtacctaatcaaccaggcaatgcttggccaatccagagtaaagtattgtgtatagtatttatatattcatctttttgaaaatttgaattttcgaccttaaatttggagttgatttggggttttttttcatcgaagtttatttttcagcatttgcttttagatcgctaagaacacgtatataaaagttttatttacaaattatttttcgtttgtaaatatgccgtttcgcttattccccgaataagcgaaacgatgggtctgttagtttgttagctgggcaagctggcctgtctgtggttcaagttctaccactgatgactgattgcaaccatggtaataacttaaggcttaagacttgactacttaaggcttaagacttgactgtaggtttctgagactaaatatggcaccactcttgtggtcatgtgtacaagatattaaactactgagtaatacagtggcttagatctgtagtaaatttgaacaactctgtcattgacaaaaattctgttttagtgcccaatgtcaaagaggatatttgtcctgatattgacaaagaaagttccaaagaattgaaacacattacttcacaacagatagacttctttttttccccttgtggtcgaagcaagaaaataagcaaaagacagcccttaaaagattttttttattctaattatggtgaactcagcacttatcagtgcttctagctaattcaatcattttctcaattactccgcatcaggaattaatcatagttcagtcagtctatgtccatgtgtccaaaaggatggcttttcagtgctgtttaaaggaaattgagacaacaagaaaattggcctgacgaattccttagcttgaaactttagtctagtcaagaagatatgtaatgttgaacagataccatccaatttagttggttgcttagtcagataaaaacaagtaattccgttatacttgtataagagtggccttttctgtcattttctcgttctcctaggaggtcttttcattctcttgaccaaatcttgtgaattacaatattataattatataacacaattaaggtagagtgaaatggatctctctgctggaggatgacactacacctaacctagatatataggccaaaacagtaggttgaataacgcaacttatactgtaacctaacaatgtgtcctactagaaaaatagtcacatgtatgtttaggaaaaatctcctaattatgtattgcccaaatccatttattttccactttttgagaatattacatgaattttaaggacgaaccgattaggatccatctgcttgcccttgctgctcttcatgattatacaaaatttaagtagctcgacacaaaagaaatagactatttgttaacaaagcaacaataaagaagttcaaggttatacaaatcattggaaatttggaatatcacctaatcaattgaatccatcaattcaagtagattcaaacatagagtggaattggaccgactctataactatgtttcttttaaccaaatccactttcagaaatattaatatatgatactaaatgagaagggtaaaactgctccaaaactgtctgattcacagagtcttttttacattttttttctttcctgtccgataataagtatgtctgctttccaagttttctttaaccactggttcccgttccatttcttgcacaactactcctctagccaaaagtcatcctttagcttctggtcagaagaacagccgcagggcctgcttggaaggggattaatttgagcaagtcagcaggcaagtttgggagaggaacaaaaagtttgcgggtatcgataaattcatcggttgatcatagaagatcagatgggaaagaagcaggagatggatttggattactaggctgtcagataccatttcaagatgggtgaatcatgtctgaagtgattcagaaggaaggttgaagcactgctgtttagtttaaggaagtatttttcatggcttatccttccacctctggcatgatccaagcttcttcctccctccatggcagcatcacgtaaaaccaacaatttcttccctcaacctttgtcttgattatctatttcatctagtcttgattctctatttcactaaaacaaaggacttgtgtatgtccatatttgtaaaatttaatctatttccctactgacaatactgcttttaatcatgattaccctgaaatggatctctatttcattaaaataatggactttgtgtacgttattgtttgaaaaattaatttatttcccttctgacaatcatgcttgttttctcaaatggattaattgtgatcaatctacgccctttttcaccttagctacttggagtacttctgtttttgttttctcatgcatatgatgattttctcagactaaggtggcattttatataatgattgagattgcgaagatcgcttaagaagttttacccttcccccacatgtttaattcttctctgtttttagttgtttaggggggattaattgattgactaaaagtttttttcctgcagaaaagaacccatatttccccctcccttttttttttgtttttaagcaatgagtatgtttaacttttgcacccttttccaacatcaatttgttcatttctaattctatggaccacattcagataatcagcttaattgttcctttctaattccatccccccccctcttttttgtaaagcaatgagtatgtttaactttttgcacccttttccaacatcaatttgttcctttctaattccatggaccacattcggacaatataccattaagaaaaatcaagctctaaatcagtcgcagtagagctacgtactaaatgcaaaatagagactaatggtatattgtcataatgtgtaaatgcagaagaaggaaccctgaaggatatgacatgccatctgatttggatcaagctctcctcctctactttgatggccaggaacaagataagccatctactcaagaagaaccccacaaaccacttaattttgtaaaaggtcgatctactgttaagagtattttgtcatagtatattacaaacatggcttgaagaaaatcacaaagaatgtcatgcatacattgatttctgtgatttgacttgctttagcttatagctagatgtgtaagattaggaatggctaccaatcttctcattccctttcttttccttttggtcattatagtcatacatgattttattagctaattggagaagagtgacacgtaacaaacatagctgatatggtcgcaggatcttgctagaagattgcaaccaaaaagaacatattttttgccccacttttttgaagatcttggccacacgcatttgaaaaattagcacagatatatatctgggagacacatcagttgcatgtgtgcatgaaagcatgcaagcacctgcctacaaactatgtaaattactaagtcataatgcataattactgaacttgttcatgtgtgcatgcagagactctcaacatcttcccctcccagccaatggatggagagccaactccaacaccaaaggtatatatgttaatatgtgcacatatgtatctctagctagctatcacaatttaagcgtgttgttcacaaggtgccagttctcctcttaaggcttcgatgtcagcgccgcccatcgccggcttttccaggagatcgccggcgccagcggcggcagatggcaggccactcaccctaggcaagacctccaaggcagcattcaaggttttaacttttttacacacgtacgcctctgtagttgtccggaatttttctcggttagacagttgtatcatttttttaccccatcatatgggtggcgttctagtctttggatagatggcttttgatcaatcttgtgttcccttttagttgtgtatgttgggtgttttggctgtgtgcactttcgtggtacagaggctatgagtatactcagacttttgagttcaataaaccttccattatctaattaaaaaaggatagttgtatcacattggtataactgggtgagttaaataaagtttccattatcttagatgttactataattttgtatccatatggcaactagaaagaaggtggcagtggcagcggcggcgccatggcagcgtcagcaagttcagagctcaaggggcccaagacgccggaccccaaaacgctgagaaggctggcgcagaatagagaggccgcaagaaagagcaggctaaggaagaaggtgattacttactatagttactactattactatataccccattgattaaccagctcaatagcaagctaagctagttaattagtactagtactcttgtactaatatcagtcaacaaatgaacaagtagtcagccctcagaagcctaaataaacaaaaatctttggagctagcaagaaaagcaaagagatggtggaagtagctagtgaagttaacctaccacctaatgggagttgtgtgttagacacatgcatgggctttgcatttgttttttctttgcagaatctgataccttcgcttcatattatcatgtgtaattaatccttaatttgttctctttttatttttgtctgtgtgacaggcttacattcagcagctagagacaggcaggatcaggctggcgcatcttgaacaggagatacaattcacaagagctcaggtgaaaattaataagcagcaaagaactgaatcatctcacagaggacggatttggtttgggaaatattaattactactcgcaatttataaaccaccaatatttgtaggagaatcgaagtttctactactaggcaaataatcaatatctaaaattaagaacaaattatctcgaacgaacaatttgtgtttgtaaaaaaaacaatttataagttatatgatgtgtttctgtatctccctgcagggtgcattctgcggtgctggaattctaagcccaggttaacactttcgaactagcatttaatcataataaagagatttacactgctccatctcacgttaaacttaacacgcctagcaacaatagttatttgcatgtcttggtgcaaagaccataagtatttatatatgtcatatcatctaacaaaaatgcatttatatatacattatgtgagggcgtttcagacgctgcattgttcaacttggagtatgagcggtggcaggaggcacaccaccaagtgatcagccggctccgggccgctgtggaggagcaccgaccggatggcgagctgcagccccatgtcgatgaagccatgtcacactatggggtgctgatggctcacaaggctaggctggttggtgctgaccccctccacctcctctccggcctgtggaagggcgccgtagagcaatgcttcctctggataggcggcttccgcccctcggagcttatcaaggtaggctacttctcttctgtgaatgtttgaattttttatagttttatatcagattcatgctttctttttaaaatagtatgaaagttttgttggatcaatcagacggtccaaatcccttacaaagtaccgtacatgacatcttttacaatggtctatactgataacaccccaccaacaagtaacataccacctcacgtgctaccttgatccatctcaccaacatcgctcatgggccttcctctactgcaaccagttttctcctttgctgtttacgaaaattgatttttcataagtggtacagtactttaagagtatccctgtttttatagtcagctgccataaaactaccgtttccacaagcagtcacagagcaggatttttttaagtccacctgtaaaaataaataatatgtaatgcccgcgaaaatggtttttagtagtgagcttcctcccctctcctgttcatatatttttttaaaagagacattaatttgctaaattatattaggaggcaagcatctttttatgtacaagacgtggcacacccatagaggtgtgccttgaaaaatggaagaattttcttaagcagctgtcccgataaaataaaatgttagctggagatgaatctatacccacgtcttaatgtccaaattcattaaaattccacatacgcttttcaatctacctgtcatgttctagatgaaggtcaaaatttactcaatactttgcctccatatattttcctcgttacaaaagcctgattgaaacttgaaaggggcagcaaaagaatttgccgttaatttgaaatttcacaatttctttgttaattttgcaatttcggtccatacctgtattgtgaagcaaaatttaaaaccttgattctttaaagaagcaagagcaggctaagaaaggtataacgcataaatgagcttgaatactcttagaaaaataattacattcaagtaaatatatttatttgtgctagtttggatattgagagcagtgtactataaatcagtcagcaccttcttctatttttcttttttttttcccatgagttagacacattaggtacctaagttgacaactaatgcaaaaatagcagaaatacagtttaggtacccaaagtttctttttgctgggattacccaaagttttacgggatattataggaaagcacaaatttaagagcacgttatatttacgggattttacccaaaattgtacaaaatccatacgttccaaattaagctaggagccctatatatatgtcttggagcacggaaaactattgttctggaggaggatatatagatgctttgttcgactgattaaatgctacagatagcatatatacgaaatcacgaaataaaattgtgcactggagacatatatatgttccaatcatcaacccaaacaaaacatttttaagattatgtggcactcttgaaatcgacaaaataaaactcccaatggcaatggtaatggcccttgccacctgccgctcagctaccaaagtaattactagtagctactccctctgtcccataatataacaatctagtatcggatggaacatttcatagtacaactaatctagataggaaggtgtctagatttattatactatgaaatgtcacatccagtactaggacgaagagagtagttaggtaggtgatgggcagttaggctttggaattcttcatggattgagaagtagagatgcgtacatgcgcaagcgtcgatcaccagatggccggggttggtggagatcgatatatcgagcaggtagaggtagccgatcgatctagctacgtttgtgtcacattctcgatggagacatcgtctggaaccgttgatagagatgcattttagttaggacccctgaacatgcgtgttgtcgctcgttaatttctttcgtctaataatctaattttgttgttaaaataactgaattaaataacgatgttgcgagtattccatattttaccatgcgaaaagataaaattttcatttgattagatgaacgagaacagataagtagtacagctacatgattttgtttttctttctcttttttaagatataaattgaacttgaacttacacatatctatggaatgacatgtggtagaggaatctataaatattcaaaatatttcctgactttaattttgtcatgattaattagtttgaagatatattttacttttcttcttagcaatttcataaaagagcgtggtgcgcaacaaattaatataactcgataaaaagcccttaacattagtcctataatcaaattcaaaatggatcatacatagcatttggcgcaattcatatgttgaattacatagcatctcgcacaattcatatgttgaattaatttttaggtatagcttattagatacttcctccattttaaaataagcaaaccttgtaaatcttttctgaatcaattactgcatttatgcacaggttgtggtccggcatgtggagcccctgacggagcagcagctcgccgccgtctacagcgcgcagcaggcggcgaggcaggaggagaacgcgctcgacggcggcctgcaggcgctgctccggtcgctctccgacgtcgtctcctcctcggacgcgccgtcgtcgtcgcagcagacgccgccggtgatgtaccacccctccgcagccgccgccatggctgcggcgagcttcatggggcagtacggcagctacagcaacctgcagctcgccatggacaagctcgccaacctcgccatcttcctacgacaggtaaatcaacaatcctttcttctagactttttaagttaatttctctgagcactgaagctgatttgggttgggaaattattctaaaactctcgagggatgtcctctcgttttttttgcatggtctcacgtagttatgaaaaaaattaaaaagataatttgtttacaagaaaattaagaagataaattaatatgtgatatattactccacaaacatacaattttaagttgtatgttcgtagagtgatagcatactacatatcttcttaaaaaaaattaaaatcttttatagttatttaagtgacatgcaaacaataagataacatccattcgagagtttcaaatccaccctcgatttgggttgcaagttttcgcatcggtgacgacgttgtgcgtgtatgtgtaggcggatgaggagaggatgcggacgctgcacgcgctgcggcggatgctgacggtgaggcaggcggcgcgctgcttcgtcgccgtcgacgactacttcggccgcctccgcgcgctcgccttgttctggaccaccacccggccgcacccggccgccggctagaaatcaattgaatcggcttagcttaggttattagccacacacgcacacatgcaaagagtagctaaggctatatagcgacatgtaagagggagacgaggagtagatatatagctagagagagcatatgcaccatcttaacgatcaaaataaggttgtatgtgtattcgatcgggaaaatagttttaaaaatagactcgacgtgttgatcttgattcttttttttactttttgaatgtttaattttaaaatgaaccttttcaaaacttacttccagaatctaaactttttttaatcgagctaatgtgcttggcatgacaaaacaatactgacatgtcactcgtagtgggcgtgacagttttatcttgccaccctagtgaggatggcgtgactaaataatattgtcacacttgtcagatcgtggtgatagatcttgaaaataataaatttcaaaaagatcatatcttgaaataaattttactaatgtttaaaaaggtttaaaaagttacaaacatcattgatcttaggacttatttggattggaactaatctttacactagcaactcttgaccttaccaaatttggtagcgtagaatttgtacgtatgggtaaaagattcatagaaaatccaccaaacatccatgtggcattattgaagttgtcaaaaatttagtacggcaaaaattaacctcagtggaacaagcccctttcttaatctaaaaggagatggtttgcaaatgtatcgaggaaattgcaagtatcattagctttaggccactgatgccgcctcgagtaaaagcccaaattaacagcatcctgggcttggcctgtaaattataatttcaatgggctggagttgcagatgttaattaatttgggctgaaagctataccaactttcttccaggccacatgctctcaagaaagaaattaagaagaaaaagaatccagaacggctagatgcagtgtgttcctgatgtagaggatcttgcctctgaccaaaccaagctacttactgtatgcttaagactacagaacaatgatgcaaccatgaaatcatctgcatacaccgattagctatgaccgatgggcttgattagacctcggaatccatattagtttcattttagataatagaagctttattaagactcagttacatacaccaaaatgatacattctaactgagttcacccccggtctctgtatagaatgtacacagccaaaaaactggacctaagaagacttcctcatcataaaacacagaaaccagtggctatcaatctgtagactagaaacacgtaaacatattagtttcatgctgagcctgagaacgatgcaagatacacactgatattgccggtggtggtgaggcgagagaatatattcgctgctgcctttttgacacatttgcagcttagccagtggatgcatgcatgcctcctctgctcggaataaaggcaacttccgtctgcttctttcttaagcttattctgcaacgcatgtcatgtgtctcatgtctactgtattggcattctggttctctctagcttccagaatttttcagccactatctcgtgaattggcggctaagaacatctatgtgcaatctgtgtatcgttctgttgctgctagctagtggaaatggattctgaatttctaactcttacaggatgacctagtgcatgcttttacttctaaaaatgtaacattacaacaaagattaacattataccccccccccccccttcattgaaaaatataagacatatttcgactatttgattttgagtttttataaacgattaatccaataatatttaat

SEQ ID NO: 21010 - DNA, 1513 bp, Oryza sativa
attcataatatattcttttcttcttgatacgtaggtcaaattaattaggactccaaagtttacgtgatggtatatatatacacacacctatcagagttgtcaaatagtattgtcacaatttccggctagctctgctaatccaatgggtcaaaaatgaactttgcaacacaacagtagaaagaagcatcgctttttctgaacgctttccctttccttgcccctgctactgttgtttttttaaaaaaggtaaaaaattttaaaaagcggcaacagaccgcgtcgctaagctggaaattacctctgaaaatcaccggcgtttccacacactgtgcaaggttccttgccccaaatcaaagcgtccataaagttgagaagaaagaaaagaaaaaaaaacaaggcttagctagctagctacttaaacaaagcccacaccacaactcaaagaatcgattcccccattgatcaatcaatcaatcgatgagctagctctctttatttaccacccacaaacatcttttaatcccctttgatcaacacatgatcgatcaccatctgtccctttttttctctgaatttgaatcgatcccttctctgttaatttctccttgccatacatggcttctgcctcttcttgctcagcttaaagttcagaaccctagaaagttgttattggcttagctatagctgcttgctctcccaccaagtctacactactgtcacacactgacattgtccgtcctccatgtacatggatgcacagcaaaaagccctagcttaattagctacgtataccttccttgtcgccgggttcaccgcggcgaggcgacgtcgacgccgacaccggcgtcgccgctttgcttgccggcgaggccacctcccggatgcccctccatggccgtgcagtgaccacgcatatgcctgctcatcactttctccttgtagagttctaggtataaatgtctcgcgccattgttaccgtctagtgaaatctcgatcttggaacatttaggtgagattattgatgccgagttatctgcgaattttcatggagttttccggtgttttaattcgatggtgtggtttggttgcaggtacaaggttgaagacgacggccggcaacgacggcgacgatgacgatgaccggagggcaccaccatgacgcgcaccacgaggacttccagctgaaggacacgaacccgctgctgggggagcaatggccgaagggcgcggcggggccggcgcggccggccgtcggcggcggcatcgccggttggctggggttggagaagccgtcgagcacctacgacctcgtcgagcagatgttcttcctgtacgtgcgcgtcgtcaaggcgaaggacctcccgcccaaccccatcaccgggtcccccatggatccgtacgtcgaggtcaagctcgggaactacaagggcacgacgaagcactacgaccggcgagccaacccggagtgggaccaggtgttcgccttctccaagtcgagggtgcagtccaacgt

SEQ ID NO: 21011 - DNA, 17519 bp, Oryza sativa
  unsure (1)..(17519): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattcgagttcgnnnnnnnnnnnnnnnnnnggacgagtccaccatgtacattagcgacacccgccccacggcgaggcagctctggaagccgcccgtcggcgtgctcgaggtcggcatcctcggcgccgccggcctccagccgatgaagaatcgcgacggccgtggcaccaccgacgcctactgcgtcgccaagtacggccagaagtgggtccgcacgcgcaccatgctcggcaccttcagcccgacctggaacgagcagtacacctgggaggtgttcgacccgtgcaccgtcatcaccatcggcgtcttcgacaacaaccacctcggcaacggcaacggcaacggcaacaacgccggcggcggcggaggaggaagcccgccggcgagggacgcccgcgtcggcaagatccgcatccgcctctcgacgctggagaccgaccgcgtgtacacgcacgcgtacccgctgatcgtgctgcagccgtcgggggtgaagaagatgggcgagctccgcctcgccgtgcggttcacctgtctgtcgctgatgaacatggtgcacctgtacacgcagccactgctgccgcggatgcactacctccacccgttcacggtgacgcagctggacgcgctccggtaccaggcgatggggatcgtggcggcgaggctggggcgcgcggagccgccgctgcggcgcgaggtggtggagtacatgctcgacgtggagtcccacatgtggagcatgcggcggagcaaggccaacttcttccgcgccgtctcgctcttctcgggggccgccgcggcggcgcggtggttcgccgacgtgtgccactggaagaacgttgcgacgacggcgctggtgcacgtcctcctcctcatcctcgtgtggtacccggagctgatcctccccacggtgttcctctacatgttcatgatcgggctgtggaactaccggcggcggccgcgccacccgccgcacatggacacgaagatgtcgtgggcggaggcggtgcaccccgacgagctggacgaggagttcgacacgttcccgacgtcgaggcagcaggacgtggtgtacatgaggtacgaccggctgaggagcgtcgccgggaggatacagacggtggtcggcgacatggcgacgcagggggagaggctgcagtcgctgctggggtggcgggacccgagggcgacgtgcctcttcgtcgtcttctgcctcgtcgccgccgtcgtgctctacgtgacgccgttcagggtggtggcgctcgtcgccggcctctacctgctccgccacccgcggttccgcagccgcctgccggcggtgcccagcaacttcttccgccgcctgccgtcgcgggcggacagcatgctctgagcaagacgacgtacggcttcaaaatgtttgaaattttcagtccaaaaagatgagatttcgttttgtttttgtttttgtttacattttgctgatgaatttggacacttgagatatgagaatttccctcccatgtaactatgtttgtctcgaggattctaataagtgcatgcctggattctaataatacgcaactctttataagaaagtttagggaatgccattctgcgtgatctgtaatctgggcctgaattggaattaggctattttagcccccaccaagatccatacatagcctaacaaaactgagtgggtgatgaagaaagaataagttcactttaggtccttcaatttgtcgctaagtctgaattcctccctgaactgcaataccagactgatatgatgtatccctcaacttccaaaaccaatacaaataatgtcctaagacgatttcgatggtggtttcagctgacaaccgctccacagaaccgccgttaaccattgatcgttgaggaggcgtattctcaagggacccatatctacagctgtgttaatgggggcgtggtttggtaatacgccaatttggccactattagtagaaaaaatgatttctttcacttcacaatcccaaataattcgcttaggagtcagtacataaagattaatttcatttcttcaatttgttttcctcttctaagtttatagctttcgtgctagcttcattgatgttacccaccaaataaaaaacttgttcgggtaggccgtctaattctccggaaaggattagttgaaatcccctaattgccgtggaacccacatatgaatgagacagtgactgtccggttaaaaataaaaaaatacggtggaactcatgtctcctccccaatatgcccatctcctccgctgagagaattcgtgatcgagccagtcatcgtcaaaacgaaggcggcgctgccatcagtgatcaagaacatggtgggtgctgtgttgactggaatggaaaaggggaacgctccgatcatgtcgaaggaggaaaccaaggaagcgtattttatataggacgcgtcaggggccatgtcgaaggaggaaatcggggagtccatggcagaaaacaaccaaagcggcccggccaccgtcatccaccggcaaggggcaaaagaaggggacacgcatcggcgagggcgccatcatagaggttgctgtacatcctcgaccatcctcttggtggccgctggtcattcgcaagacatcgtggggccgtcactggcttcaccgttgtcgtgccaactgcgctggtgtgcggtctcattgtaatttttttttatttttaactagacagtcattgccccactgactgtcgccatatggaaaggaaatatgcgaactcgcagcgtccgagacggggactcagctgcgccacccgcaagttcgcttggtatatcacaggagatttcaaaacctatcacttgccagatgatgcatagggattggtggattatgaaatttgaattctcaaaacccattcaaactttcactcgggatatactttcttcccacatcgaaacctcgaaatttcacggttcttcagtcgattttcgtcaaaaagaaaaaaacgtgaaccctaccctatgacggacctaagtaaggtctgctttatccgaatttacttgaggtggctagctactacgcctaaaagaaacactacagctaattaatccaataatattacatggccacaacaaattctcaaaagtatttttaaaataaatttcaactcgtaaccatgcaaaccagcgtagaagaaactctactcgcacatggtagaggctaactgaagaatagtgctacattgcaacaaataagcatattcaggatcttttttctctggacgaataagcatgttcaggattatggatgtaggcacggaggttacgatatgatccaataattcaaattaaacggtaccttgacaaccaataaattagcagcacgttcgacactggatatgattgaagatagcattttcactcgtacatattttctttgtttttaaatatttaacgccgttgacttttttaaatatgtttgaccatccatcattcaaaacatttaagtaattattaatttttttctatcatttgattcattgttaaatatacttatatatatacatatagttttatatatttcacaaaaaattttaaataagacaaatggtcgaacatatgctaaaaagtcaacggtgtcgaatatttaaaaacggagagagtatctcattatccttggggtttgaaccgtaggttgggttgtctaaaaggaatattctgcgtatatccagttgccggttggcttggtccaatccatctctccaattaaacatggtccgttccatccctccaaccaaacaaaaatcagatccatctcatcctaaaaatatatgaatggacctaacccatctcacatcatcctcaaaccaaacatatattagaaaagatggaaagaatcacacaagtcattgagaagcaagtgcaattacctaaaaaaaataaaatccagatgaataacacttgctgatatgatcatataccaaaaaaaactacaaaaaatatgaaaaacgtacccgtcaaaatccttcaatagtctctgtatcattaatcgtggtagataatgtgtttcttttgttccatagaagtttatgccaacgaaattcccatcaaaatcaatcagtggtcctccaataccggcctggcaaaaaaaaaaaaagcacatgaatagatgaaattttcaatgacacgcatatgaagcgatgaattaaattactcatattctgatacaattaattgtttacaccatgaaagaaatcaacccaatgtaccttagtgattttacaagtggagatcataagctctctgcagtcaagcttgctttcctcgtcagacaatatcccacttgtagccattaatttgcctgattcaaagatacgtcctatagctactacctccctatgaggttcgatttgcatctgtttgtcgagttctgctgtccgaagacaacagaaacccttgacactgaccacagcaatattgtagctcaaattgcaatgctgcaattcgcttacggcgattcgtttatttggaaggtacactttaatctgctaagaaacacaatgtgagaattaaagagtatctcaaatgcacaagcaaaaggagtgtttgtgatgccaaccttcaggttatcagcaatcttgttttcatcagcagatattctaaccaaacttgctgaagtcacaactcttgatgtggatccattgaagtctataaatacacctgtgcaagcaaaaaacctttcttctcctacaaagatcagtgattgcaattatagtcaggtgatggaatagagaaaacagacaaatatggagaagtaaagattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgccaagggtgaggagccaatttttcggaccattcgacgcgtacgtcgtgcacgcgcgccgcctgccctgccctgccctgccaggccaggccaggccaggccaagccaggcgagcgagcgcgcgcgtgtttcccctcttctctccaccacacatgcttcaagtggctagaagggcatcctcccttttaaggaggtccccctctcctaaaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatagagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaactctgccttgcagctcacaagagtatatgcatcttcacttggatagggtatatatatttgtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccatagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaaccacatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaagagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctacttccagtagtctgcattaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgtactggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccttgccaggccaggcgagcgagcgcgcgcgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaagatcatataacattgtaatctcacctttgaacgaagcaagtgagacaacactttgggatgtatttaaagcaacctttttactcagtttgcaccatgtatcttcagcaaattcctcttcaaaagtatttttcaagcgcataccccctggttaaaaaaacataaaactacagttgagtttgctagaaaataccgtcaaaatgtgcaacaaaagtaaccagcaaaagtgaaagcaatgactcaccccaaaacctgattggcatgggataattacgagactttagatcctttttcaaaagctgcgtgaattctggtgcaacaaggtgaagagtaaataatgatcatgtgatactaatagctagcaaaactgaaagcaatgactgaccatcatctggcaagggcttaataagttcaggaaacaattcctcctcccagaaatctggtgcaacaaggtgaagcgattaatttacatgttctggtagtgatcaataagcagcattataacatgctgagagcttgcatgataatttggtaacaatcagttagaaataacctagctcgattcaccttctgaatcacttgtagaatattcaggaagcttctgagtctcactttcattctcttcatctgaagtacctaaaataaaatttaaaaaataagcaagaaaaacgaacaaaactcaaaacaagcaatgagagattaatgaccctgcattagaaatgactaataagtaataacattataatacgaggacagtttgcatgatcatttaataacagttagaacttgatacttgattggctcatcttggttcaccttctgaaaagcttgtgatggatacggtttgctcctggttccttttttttgccactcctcttgaggtacctaaagcgggaaaccaaatgaaatgaatgaacataattaaaacaacgcaatgctctatccagggcatcaacagtagattacaaaccttacatgttattatagtgattatactatctaccctgttccacaaatatggagtgcatttattttatattattattgaaaaactagcatattgcccgtttgctgcaatggattttcttttttaaagaataacttattgtaccgtatatattttaaagcccataaaaatgttgtttctattgtccaacatattatcatcatgctactttttctgttactttatagatgaaaaattccataatattcgattgtcatatttttcttctggcggggtctgtggcctgtggggtataggagacaggaaattctttgtctcactctttgtggtcccgaatggtagttggatggtggtggtggtaaattcactaccaccactaccatctttcatattagtacatagatatatagatacatggcatatttcatactgcaaaacaagataagcatcttatctactatacccctaacaaatatatccaatttatgagcaccgggaacaccacaaagttaagctttacccacaggagaggaaactacaaccaaggattaataatatacattaatgaagatcgacttctgacaataaacaatttatccagtacaaagagtgattgtgcttcaactgatgaactcaccaacaaaattgttgtgtatcatcttagatctgcatctttcaattatgcttgtgcattcatcgtcgatttcaaccctgcagcagaatgtagtatactcttatagtgcaaatacacagagctgctgatccccaaaaagaatggattgcatatagctaatcaaaaatactatcaagattaacacttccatccataagaagcatattatggaaatcagctatagggcgtgcaaaacatagtaatatattgctttatctagcagagttataataacatagtactatgtgcaaaaccaaatcgctattatgtgataggctgtcaaataaaaatgaaaaaggtccactttaatccctcgaactactattttgcgggagcacttaaccccctaaactatttctagctcaatctggcttggcaagtgtttgactgtttggaggatctgaatgaaagtacgaggcataccagagtgtgcaagatcgcaccaagcttcggtaaattttgttccttggtaggaatggagtcctctcctccgaaaaaaagttcatgccaacaaagttcccatccaaatcaatgagtggtcctccagccatatcctggaagaaaatatactgtcacactgagctaagataagcacaaaaataaaaccatattgaatgaaaaaactacatgaagagaatgaaatgtttaaggccccaaacgatatagtacagtgtatgtagtgaactagtgataaattctgctactcatatcatgagacaattattaatttccacaataccgagaagaaagaagagatatcagcagtgcaccttagtgattttacatgtggagatcataaggtgttcaggataatctgttggcccatcagtcactatcccagataacgccatcaatttgcctgagttgaaggaacgccctacagctactaccttactttgggacccaaatcgcacttcgtgatcaaaagacgcagctcgcaaaccaggtaaatatttgatcaccacaacagcaatattgtagtttaagtcaaagtgtcccatccacccgatgacacgttgcttatttggaagcagaactcgaatctgcagtgataatgcaagcaacactgcagaattattatcatatcttaaacaggtaagtaacagagtgcagagaaaattaggggtaccaacatccaaaaacggattgatcttgctgtcatcatcaaaacatctaatcacatttgctgaagttagaatacttgtagttacttcatctttgtttctgacaactatgcctgtgcctgaaaaatgcgtctgatctcctgcacaagataatatcttcaatgtttagaactgatgatcagatacatatatggaaaactaatttgtataggcactcaccattgaatgaagccactgagacaacagtttcagataagtttgaaatgacttcttgactgagtccactctaggcaccttcactataatcaattaagctaccagattcctcttcaaaagcaacacatttagagctgtgtaaatacatgtaagaaatggcggaagtgaatcaacattcaagaacggactcacctttctttctactatttgtgcaagttttcttctcttcatttgagctcgagcaattgccccttcgtttagacatctttccaaccttggatcagaaaggacaagacccaaatactgagtaaacattaccatgaaagttcgatctttaatttgtttttgtttttttttcttttggcagaagcaactagctagtcaaatcacaaactgattttctggcacattacgtatatagctaggtacacgtaaaactgagtagggccagaccagctagtaatacccagtaagctttgaacataattaaggtgtcatataaatgatcttcgcaagcaaaagaggaaaaaaatccttactgcaaatgaatctatagactaatataatgccattttaactggagctgcatgatacctgattcacaatagaagaagctaccaaaggttaactgagcaacgatgaaagcaaagttcagatcaattatttatctaagataaataacgtcggcttgtcatggtaatttacaaatttgcagtagataatttttttaaaaaaagaaaagcaagtaaacaccagtaatatccaaccagctctataaccatgaagaaccaatagacagggaatagtggagaaccatgtgtgagagatgaatcaattcacagaagaagccccaattgctcggggttcaactatatatctttcccgcccaatgacaaaaactaataggtcaagtagctagtacatgacgagcctagaacaaaaattatgaaagataagatacatactaattatctaattattgactaatatagtataagttaacatggtataatttagctagtattgaataatttactcgggggccttgggacccggtaacgtagtaagcataacgtagacacgccaccggcaaatgctactgctagcttgccttacacagatcacagacagggcaagcaagaacacaatttgtaatttttgctcaactaagaacacaatttggaaaaagaagcgcgcattataggtcaccttattgctgcctagtcacccaagttagtagccgacgcaggcgccggagtacaaggcaaagcgacggtcgccggagacgcgagcaacacgagggggctgggaggcggtgacgccggccgcgccggatgcgcgcgtctggtggccgtcgccgccggcgacggtgagggaggaaaccctaaagtagactagggaagaggagaagggggaggcggtgcgcttgcaattttcgcgcggatgggaaaccaacagacttgggctatatagtagtagttgccgcgccggggaaattgattaggcccttgtttggttgggccgggttgaggctggattgcggccggatccgcggggaccagaccagcccaacccagcccagccaggacgtatttttaaaaattaaatccatgccactgcaaatgtgctgattcagaaaaatacaactactatttgtgatatctattgcgtaccattgaccatgccatcgccatcacattttctgttataatataaattaaaatacccctacatatgagacttacatgttagctccatcttcctcctccaccctcgcctcttctcttttcaacatctcgctctacatctcccccggtggatagaggatgcggtggcaggcggcccatgggtgcgcaatgcaagtggctaaagggcaaggtagcggtgacctcatcgacgatggaattagaggttgtggaagctgcatcgtcaggacgggagccctcacgcgagctcaccaatggcatcacacatggaagctgacagatgagggagacaacatgttgcctacatgcatggtgtggtggtctgtccggtgtaccagagccatcggcggggtggttaaggcagcaacggcgcacagtcgacatagaggggtggcgtggcggcgaggttcggtggatgggggaggaagaggcaatggtgagaaaatagatctcccctctctatttcctcactcaggctgcaacgcatgaacatctcatcctctccgtcgggaggtcaccgacagcttctcacttaggcggattgcgcgcgttggtgttgttgttgctgctactcctggtggtagttggcggcggtgccagagacggttgttgctgctactggtggtgattggtgtcgatgtcggagacggagaagccaagtaggttgacggatctaacgaggcaatgaaagaaaacgtgacggcaatggcatgtttcaatcttacaaaattccagtggcacgcaacagatatcacgaataatggtggtatttttctgaatcagcatacttaaagtggcatggatctaattaaccatttttccccttctcaacctattgacctgtttattcacagtaaagggaagagaagaagagggccacgcatgtcacgcacgctcccacggcccatggccaccaaccactccatcgtatctcctctctctatatatatcttatccatttctttctctccgtcttcacccgtgcacgtgtgcaagcgaatgaggaagcgatgacgctgtcgcctccctctagcgatggtggaggccctctgacaaacccccttctctttacagcaagcttcctccgatggagaagagggacggaattgagcaaccttcttccagcgacgaaagcctctatttggcaagcctcctctttcttcctccagcaaccaagttagctctatctccaccatcatctccagcctcaccagcgccaaaaggtgtcaatgttccagagcggcctccttcccctcctattcgccttactttgccctcatcgatatcatcagcccacaacccgctgctgacctcgcggctctaatggcgtcaccgccacctcaccaaccgcccttgtccgccacacatcgtcaaattgttgcctcataggccatccctctaagcttgagtattctatagtgtc

SEQ ID NO: 21012 - DNA, 881 bp, Oryza sativa
caccagtaatatccaaccagctctataaccatgaagaaccaatagacagggaatagtggagaaccatgtgtgagagatgaatcaattcacagaagaagccccaattgctcggggttcaactatatatctttcccgcccaatgacaaaaactaataggtcaagtagctagtacatgacgagcctagaacaaaaattatgaaagataagatacatactaattatctaattattgactaatatagtataagttaacatggtataatttagctagtattgaataatttactcgggggccttgggacccggtaacgtagtaagcataacgtagacacgccaccggcaaatgctactgctagcttgccttacacagatcacagacagggcaagcaagaacacaatttgtaatttttgctcaactaagaacacaatttggaaaaagaagcgcgcattataggtcaccttattgctgcctagtcacccaagttagtagccgacgcaggcgccggagtacaaggcaaagcgacggtcgccggagacgcgagcaacacgagggggctgggaggcggtgacgccggccgcgccggatgcgcgcgtctggtggccgtcgccgccggcgacggtgagggaggaaaccctaaagtagactagggaagaggagaagggggaggcggtgcgcttgcaattttcgcgcggatgggaaaccaacagacttgggctatatagacataaagattaatttcatttcttcaatttgtttttctcttctaaggttatagctttcgtgctagcttcattgatgttacccaccaaataaaaaacttgttcggtaggccgtctaattcttcggaaaggaatagttgaaatccctaattgccgtggaa

SEQ ID NO: 21013 - DNA, 541 bp, Oryza sativa
ggtgttcgtcaaggcgcaggtcgggaaccagatcctcaagacgtcggtggtggcggcgccgacgctgaaccgcggtggaacgaggacctggtgttcgtcgtcgccgagccgttcgaggagcagctgttgctgacggtggaggaccgggtgacgccgcgcaaggacgacctcctcggccgcgccgcgctgccgctcgcgctgttcgagaagcggctggaccaccggccgttcgtccagtcgcggtggttcgacctcgagaagttcgggatcggcggtgccatcgagggggagacgcggcgggagctccggttcgcgagccgcgtgcacgtcaaggcgtgcctggagggcgcctaccacgtcatggacgagtccaccatgtacattagcgacacccgccccacggcgaggcagctctggaagccgcccgtcggcgtgctcgaagtcggcatcctcggcgccgccggcctccagccgatgaagaatcgcgacggccgtggcaccaccgacgcctactgagtcgccaagtacggccagaagtggg

SEQ ID NO: 21014 - DNA, 561 bp, Oryza sativa
ccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccaccc

SEQ ID NO: 21015 - DNA, 883 bp, Oryza sativa
  unsure (1)..(883): unsure at all n locations
atgtctaccgtccagaaaaccaataactctcgacagaagaatgattatgaaccatctacaacaggctctgttgcaggtaatatatctattacaccactatttccttctatattatatattattacatgttttgagaaatatttacatgtacttaatgttcctatcatgcttttttggtttagatgcacataggggacatgcatatgaagatgatgatgtcgaggcattcacttatgtattgcatggtacatatgatgatgggttgccatcaaaatcgagtcacaaaaggaaacaccttatgcagcaaaagatgaatggcacaaggcattacagtactggtgttgacatgccttatgatccatatgtggagagcaagccaggaaaccaaccatttttatcaaatggaaaaagaccttcagatttctttaatattcctacaaaacgcatccggacagctgctagacaacgagttgtaagcccatatcctgctaatgcttctggagccactgcattcacaagtaaaacagatgcttctagtggagacacaaactcttgtcaagatgaccaaagttcattgcatggtggatcttttccaaggaagaatgtggatattgaatcgacagttgattttgatagacaattgtatgatggcagtgaggtatctactaagtcaaaaaagaagaaaaagtctaagccccttgatacaagacacctcaaagtgtcgctgagtcttgctctttgattgctgggaaggttaagatctttatgccaactctctctctatcttgttaccaatgttgtagagtaagtgattctgctgatgtttcagggcannnnnnnnnnnnnnnnnnnnnnnnnnnnnnnnnnnnnnnnnnnnnnnnnn

SEQ ID NO: 21016 - DNA, 1809 bp, Oryza sativa
gtgccaccccgcgacctcccttgcccgtgcaccgtgcatggcatgtccgtgcaccgcaccgcgtcgcatcgcgctggtgtggtccccgccgcccgaccaagccaccgaaaccccgcgcaaaagctgcgccgctcgggtgcgggcatcgcctcggagccaagggataacggcccatgtgccaccctgcgtcatcctagagaccctagctcctaggcccaactaccctaaagtcgcctggctggatatccgctctcaccgagccgcgccgctctgccattgcccatgtgcgtgcgtcatcgccgtcgcatccgtgacgccgtgccatgccaggcggacctcggtcaagccgccgtcctctcaaaccttctactccaagggttggggagtgaaccgagtggccacatccaccgcctcatccacaactaatgatgactagagcccttctttgtgtccgatggataaaacagagccctctccctcagctagtactagaacacccattccataggtcctagatgtgatgattacctacaaaaccttaatggagaaggaaatccactcttatctgcgtcggccacctcattgcccttattcgagtgttgtttgagcttcttaagcttccctctagtcggcctcatccttccggaggaagctacccatcggatgtctgatgctaaaaaaaaatcggacggtcaaatattgcagttgaccaacaaatgaaacattaagttatatattgtgaaacaaaaaaattagcaagtgaaacatttaattattttatgaaacatgatgaagatacacgttgaaacatgtcgctgccacgtataaacaacaagtattaacggattgaaacatgtgttttcttttatcaaaatataatcatgtgatatcttgttgtaaatatttaattaaaacgaatacaatggtgtgattggatcatatattggataaataatttaagagaaaaattattttgaagcttactaaaatacatgcacgtgtgcatggatgagatggagagagaggagagagagaagtagcgggcagtttcaggaatgtaatgaaacacactgaagacgcacattgaaacatatcactatcacgtatgaaatatttagttttaacggtttgaaacacatatttttctttcgacataatataatcatatgatatcttgatgtaaatatttcattggaacgaatacaacagcgtaatcagtttgtagattggataagtaatttagaagaaaaaatatttaaagagatgaggaaagaatgaaaagaaatagctaggcatacatgttacagtgatagggttcatccgatctgccgatttgcagcatttccagtggggtagatgaggcgtccgatatttccgattcgtcggacgtgcgatataaagcgttctcccatccttccacaacctctcaaacagtttctcactcaaacctctctctccaacccaaggtgacgagtgtcgaacacctggtgggcggggactgcgctgccgctaccttgccacttggctagagctggtggcggactggcggggtgtggagttggcctcgaggcgctgctgctgctgttgttagaacgagccggaggctatcggaagccgaggaacgggcgtcgaacaccttcgagcgccgctgacgccgttcgcctctgctttacccggcccggaccggcgtcgttgaccttcgccttactccatcatttggtaagccctcacgcaccgagcacctcctagtgacctagaagccggcggccctcccaatttgggctatgtgccgccgtagccgtaccacct

SEQ ID NO: 21017 - DNA, 1341 bp, Oryza sativa
ttggtaagccctcacgcaccgagcacctcctagtgacctagaagccggcagccctcccaatttgggctatgtgccgccggagccataccacctccggccgccaccgcgcctccgtcgagctccccgtggagagggcgaattcaaatgcaacctaggctacatttttgattaaatggcaaccctactgattctagatggtgaaatcgtgctcggccgacgttcaactcttctacttttgtgccatcgccgtacacgcataaccggctgccaccgcgcgccgttgcgccgtgtgctgggaggccgccgcgcttcgccgtcccagccggggtcggccgccccaggcgggtgcgcgccgccgttcaccgaccgcgcgccgagccgtcccggctcgggtcggccgcactggccgcatgccgctcctctgctccgctgtgagcgtgaggaagaagaagggtatgaaagagatagagagggagagttggagagatgtaagccctactttctattagcgcatagtaattaccatgctaatgatggttagttgaaacaatgacatgtgggcccgagcaatcaggaatctaattaaaaaaacaatttatatggtacccctatggcatgtgggtcccaccgggattaataagaccggtttgacctcggtcaaaagaggcaggcccaccagtcagtgacacgccaaatttttccttagaggaataaagccagaaaaaggaaatagggatggcctcacatgtcagccactgagacttagggatagagttcgattaaaaaaataaatcaattaggaacaatgctgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatccaataccaggcttcatccaaccattacaggcaagatgctacaaaaagaagggtgatcatgcagatcggg

SEQ ID NO: 21018 - DNA, 2099 bp, Oryza sativa
  unsure (1)..(2099): unsure at all n locations
nnnnnnnnnnnnnnnnnnnnnnnnnnnnnnnnnnnnnnnnnnnnnnnnnnnnnnnnnnnnnnnnnnnnnnnnatacaatttagaaataactgaaatttgaaaattaaaaagtgtaatatgaaaagaatagtcaatcgtagtacaaaatacgagattaattaaaattagaataataaataaataaatttcgaaattagaaaaatcaaaatatgagttcatgtatacaatttatcaacaactaaattcatcataaaaataaaaactattaaaacaacacaagattaatgaaaaaccgggataaaaattttataaattctgaaagttgacaaataaaaatgagagtttgagaatgaatattatttacaaataacttaaataggaaatagatgaaataacaattcatatagactacaatacggaattaactaaagttagaaataaaaataaattaaattatgtgattagaaaaactaaaatgagggttgagtaggaatataaattataaataacagataagatattttaatagaacatattacatctataacataacggtggtaagtgaccataaatgcaaaagggacatcagacaaaccataaagatagggttggtagaggttgatgggatattaaaaataaaaaccaaaactcctaatgattactagattcaatatttagaaaccaaaggatgattagaaggaaagattttgggtaggctgtaaattaaaagagaacggtggtgatggttgacaggacttcttggaagtaaaaagaaaacgaaaatccaactataatcatgttccatttcataaatcctaatgataataaagaggttgaaagttagtacaccgtagaggagtacaatgttgacgtttaaagggacttccaaaactacaaatcaaaattcgacaagacaatgaactagacaaactatccaatttttaaagtataataaaagctgtggcaggtcgggcaggagaaaaggattggcggctaacgtgacatttaaaaattataaaataaaaaacttgacaatgataaaatttgatcttttgaaatcctaatataactatatggctacttaacaaattttaaagaaaaatatatgtaaacaaaatattttatacggatgcttgccgcgcaattacacgggccacactcaactatgtaattatgaatcaatctaataatagcgtttgttaagacacatgatgttgcgtgcaaaacacattaaattcattcatcgtgctgtacaacctaccaggagcagtgacggctctgtagatggactctaccatggcattgacctcgtcctcgctgatgggcctgagagcctccatccgacgcggcgcaaagagctccaggttgcacagcttccgcaccttgacgtagtgcgggccatagtccgcccagatgaggtccgtgccgccgcggcttaaccgctccgccgagtggttccgcgggcggtcggcgagctgctgatcattgtacgttcttgaacacctctctggctagctgcgacgtcgacaccacgatcgacggcgacgtgcccagccagaccgtcatgatgggtccgtacttgcctgcccactccatgaagcaccggcaccgcaccagcgtgatgtcgaacaggttaccaccggccacgcccggggcccgggggacagcctgccgaggcggatccgattgaagatcaagaaggatggtgatcgggatggcaacaagggcaagcgccaacgggagcaacgccggggtgtccatggctgtcggtgtatgtacgtgggcaaagtggttcttgatcgtcggccagaggcttggagggtttatatagagcaagagcaccataacgcctctgaattattgagggaaaaaaataagaaagagctagcgagcagcaaagtagaagtagagggcggataggttttttatctagatatcatggcaaccattatttctatacgacttaaatagttataaaaagttaaaaaaaagtaacatctattgggatgctatgagtctatagacaaacatgtaagattaaatttgatctacaactcgagaaacacacataataaaatcaggcagtggatatttacttg

SEQ ID NO: 21019 - DNA, 1923 bp, Oryza sativa
ttgatttacaactcgacaaacaaaaataattaaatcaagcggtggatatcacctgtacaacgaagataaattttggtttttcttttaacttgcacgattgtatagtggtttatactacataatctacaagcatacatataggtgacatgatatcatgggtagaaaatacttttccaaagcgaagcagctagctaacgcatatagcagtagtaatgcagctgcccactggcattggatgtactggtttacaaagcacactggtttgatgtttttttagcgaagttagaaaaaaaaatacatgagtgtttatagctaagttcataatagagtccaacaagtaattgtcaagtaattgtcgcgaagatatactatatcacatctatcttatggaacgacgtgacaagtacagtgcaactgattttttttataattaaatagtaaggcccacaaggtgtctatatgtacagtaacatttctaagtgtgctcttgacgtgatgtggcaaaggttaatgttcttgggtgctaaacatttgggatgctataagtctattgacaaacatgtaagattaaatttgatctacaactcgagaaaccaaaataattaaattaggcagtgcatattacctatacaacggtcataaaatttggttttttcttttaaactgcacgattttatagttctttagactatataatatatatgtatacatctaggtgacatgataccaggtgtagaaaatacttttccgaagcgaagcagctagctaacgcaagcaacagtagtaatgcagctaccagctggcgttggactggtttacggagcactggtttaatgttttttagcgaagttagaaaaaaattaatacaggagtgtttatagctaagttcataatagagtcaaataagtaattgtccaaagatatacgataccacatctttctgaaggaacaacgtgacaagtagagtgcaactaatatttttctaattaaatagtgaggcacacaaggtgcctatatctagagcaacatttctaagtgtgctcttgacatgatgtggcattggtaaatatacctacataagtttgaaaaatataaaatattcaacatagtggtatgatataattctacaattttcacaagtgttggtgtatatttggatacaagtgacaaactatcaaagttgagacgaattacatgtaaaagaggaggctctcacccatcgagtattgggcccacaaactcatcgaaataccagaaattgggcgaaaccaacacaccactaggccaaggactcaattgctaaagtccaggagacaacccacggccaggggagctggcagggtcggcggaccttgggtttggccgacctgagcctatcccggtccaaccacaactgccttctgacggttgctaccgacatccttatggctgttgtggccggtattggtgctcccaactgttattcacttgctatataagaacctctcctccttcacttcacacacaccaagcacgagctaaattagaagtggttctttgtatcttttattgtatacttagaaaatggagagaatgagtgagaaagagtcggaggaatttcagagttgtcgatattgttctatttacctttttgtaccttgtcaattactctacttaaattgataatatctttatcgagtaattgagatttactttgtgcggtttacctacgtgatgtctatactgttgaatacctatatttgctgcgtattcaacagttcgtttgaggctgatgtagaggtggtgacagctctcgagatcacttgagttcatcctgtttgggtacggattagagcgcgtgtgggtagcaacgagaaagctagtgcatgaagtagtgtgataatgttaaatttaaactttcttaagaccctggtccttactaga

SEQ ID NO: 21020 - DNA, 759 bp, Oryza sativa
cctatttaagttgagatactccacttttaattcccagggtggtattattatccttaacatttcttatgggcccttgagattttaatagaaaaatcgggcctagcccatttattctaacaatccccaacaaatttcatggctcataagaaatgttctcaaagttcaacctgtttgatataccagtgttttggtggagactgttaagttgaacttccacctaggaaaagagttacatcagaccacaactgaacaatggactatgccttgaattgtcagtcttgtgtgagcaggtttcactcaaacccttgactggtactgggctgccgtttgcatccgctctgtttggagcatataagtcaaactccaggccctttcatgagtatctagagatcgcccaaatctcatagactgtgactagcagtcgaactcatataggtgtgttccttctgagatgttttgcaggtcaatatctctgcttagaaaagccacttgaaccacattaaggcataagccatcctaccatgcataatagaagagaagtacatcatgaaaatgagcccttttcaagggggcttttaactatttgccacttttagatttggtaattaactatttgccacacctatctcaatgacatgtaggtccacatgtgtctatgacatgtgggtccagtggcaaatagttaattgccacatctaaaagtggcatatagttcaatatctccttttcaagagtctcttctctcaggggctgcaggaa

SEQ ID NO: 21021 - DNA, 5067 bp, Oryza sativa
  unsure (1)..(5067): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagaagaattcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttactgggatggggattaatacactagcgttcgggaaaatgtatttttctcggtcgcgacaaatacaagtcaaggtgcgcctaattggttgccaccgattcagccgggcctgagagtttcgctgtggaatcagggaccgcagttcgacttcatcaacgctgctcaggcgccaaccgttcggcagcaagctccaactccaggcttcggaacaaaccaagcaccaatccaagctgccatgatgtggtcacagccaatttttgacccatccatggcggctcagcaagtacctccagttggagccgggcagccgaatgccatggcccaaccacacgcacaagctgcgatttcgcccttcgccacaccgtacccgcagtagggtgcggtaaacagggcgggaggcgaaaaagggctaccgctgtgtgggggaatcaagactcgtccaatcccaccccagtttaagttcccacccgtcccgcgctattcaggcgaaactgacccgaaggagttcctctccatctacgagtcagcgatcgaagcagctcatggtgacaaaaataccaaagcgaaggtaatacatctcgctctagacggcatcgcccgttcttggtatttcaatttaccagccaatagcatttactcatgggagcaattgcacgatgtttttgtccttaactttcgaggcaccaacgaggagccgaagacgcaacaacatctacttggcattcgccaaaggcagggggagtcgataagggagtacatgcgtcgcttcttgcaagcccggtgccaagttcaagacataaccgaggcgtcggttataaatgccacttcggccggtctgctcgaggacgaactcacaagaaaaatcaccaacaaggagcctcagacgctcgagcacctacttcgcatcattgacgggttcgcaaggggcgaggagaattccaagcgacagcaagctatacaagctgagtatgacaaagcctccatcgccgctgctcaagctcaagcacaagttcaagttgtcgaaccacctcccctcttcgttcgccagtctcagccggcgatccaaggacagccgccaaggcaaagccaagcccccataacttggagaaagttcagaacagaccatgcgagcaaagctgtgatggcggtcgaagaagtgcaagccctccgcaaggagttcgatgcccagcaagcgagcaaccatcagcagccagcccacaagaaggtccgaaaagacctctactacgcctttcacggatgctcttcgcacaccacggagcaatgtcgaaacattaggcaatgtggcaatgcgcaagacctaaggccgcagcagggaacaattgtcgaagcaccccgcgaagcagttcaggagcaaacacccccaaccgaacaacgccaagatgtacagcgaagggtaatccaagtgattacaagggctgacccgccaagccagttgtccaaacggcagaagatgatgcagatccgtatggtccacagcatcacttcggcgggtgaaggggcgccgcagtatctgaaccagctaatttcttttgggccggaagacgcagaaggagttattttcccgcatcaagatcccctggtaatctcagctgagatagctggtttcgaagtccgacgaatcctggtcgacggagggagttcggccgatgttatcttcgctgaagcatatgccaagatggggttgcctacccaagcccttaccccagcaccagcatcgctccgcggtttcagcagagaagcagttcaagttctcggccaaacacttttgctgatagcctttggctcgggggagaatagacgcgaagagcaaatactgttcgacgtcgtcgacatcccgtacaactacaacgccatcttcggccgtgcaaccctgaacaagttcgaagccatttcccaccacaattatctcaagctcaagatgcccggcccgacaggggtgatagtagtcaaggggcttcagccttcggccgcttcgaaaggcgatctagccataatcaacagagcagtgcacagtgttgagaccgaaccgcatgaacggccgaagcacacaccaaagcccacccctcacggcaagataacaaaagtgtagattgatgatgccgaccccacaaagctcgtatcacttgggggcgacatgggcgaagaagaagttgagagtatcctagaggtgctcaaaaagaacatcgatatcttcgcctggagccctaacgaggtggggggtgtcccggtggatcttatcatgcatcacctagcagtcaagccggacattaagccaagaaaacaaaagttgcgcaagatgtctgccgatcgccaagaagcggcgaaagccgaagtacaaaaattgctcagggcgggggttatccaagagattgaccatccggagtggttggtgaatccagtgctggtgcggaagtcaaacggcaaatggcgcatgtgtgtcgatttcacagacctgaacggcaaatgacgacttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaacgaacgcaggagcaacttttgccaggctggtgtacaaggtccttggcaagcagttggggcagaatgtggaagcttatgtcgacgacatcatcgtaaaaagccgcaaggctttcgaccatgcgatcgacctgcaggagacattcgacagcttgcgcacagcaggcacaaggttgaatccggagaagtgcgttttcggcgtccgcgcaggcaagttgttgggtttccttgtttccgaaagaggcatcgaggcaaatcccgagaaaatcgatgccatccagcaaatgaagcctccgtcaagcgtacatgaagtacaaaagcttgcaggccgaattgtggcactcagtcgattcctctcaaaggcagccgaaagaggtttgcccttcttcaagaccctccgaggcgcaggaaagtttaattggataccagagtgccaagcagcattcgacgtgctaaagcaatacttcaaagcccgccagttctgataagcccacccccaggaagcgaactgctattatacttagcagcttcgccggtggcagtcagtgctgccctcgtccaagaaacagagttcggacaaaaaccggtgtacttcgtctccgaagcactgcaaggagcgaagacaaggtacattgaaatggaaaagctcactgacgccctagtgatggcatcgcgcaagcttaagcactacttccaggcccacaaagtcatagtgccatcacagtatcccttgggcgaaatactccgaggcaaggaagtcactggccggctcagcaagtgggcgacagagctatccccgttcgacttaaattttgttgcacgctctgctatcaagtcttaaatgctagccgacttcgtagctgaatggacaccggtacttgcccccgaccccgagcccgccgaacaattctgggtgatgtgctcagacggctcgtggtcgcacaggggagcaggcattgcggcagtcctatttttgccgaatggtgtgccgattcggtacgtagcaagactgcagttcgacacaaccaacaatgcagcagaatacgaagccgttctcctgggcctaagaaaggcgaaagcactgggagtccggcgcctgctaattcgaactgactccaagttggtagcaggccatgttgacaaatccttcgaggtaaaaaaagagggaatgaagaggtatctggaggctgttcggtccatggaaaaatgcttcaccggcataacggtcgaacacttgcctagagaccagaacgaggaagcagacgccttggcgaaatctgctgcttgtggtggcccacattcgcctggcatctttttcaaagtcctacatgctccaagtgtgcccatggacagcttggaagtcatggcaatcgaccaggagaaactgggcgaagacccatatgactggcgaacctcatttgtgaaacaccttgaaactggctggcttccggtagacgaagcagaagcgaagcatttgcaactcagagccacgaagtataagatggtctcgggtcagctttaccgctttggggtacttcaacctttacttcgttgcatctcttttgccgaaggcgaagaaatggcaaaggagatacaccagggtctatgtggcgtgcactaggctgcaagaacaatggcctccaaagtatttagacaaggagtttattggcccactgtgttgaaagtctgtgttgagcaaatcaagaagtgcgaaagttgccagcgtcatggccgaagccaagccgcgccccagtatgatctgcagcccattgcaccagtatggcccttcgccagatggagactggacatcattgggccattcccggtggcgcgaaacgggtataaattcgcaattgtagctgtggaatatttctctcgatggattgaagccgaaccccttggggcaatcacttcggcagcagtacagaagtttgtatggaaaaacattgtttaccgtttcggagtgccaaaagg

SEQ ID NO: 21022 - DNA, 4091 bp, Oryza sativa
tacaccacaagcacttcggcaacttacaacaaaaagttcgacccacggagctgagcctggtcatctcgtcctaaggaagaaggcgaacccagtagcggttggcaagcttgaatcaaagtgggaaggatcatacctcatcaaacacaagtccaggacgggatcttttcgcctagcgacactcgaaggcgaggagttcgaccattcctggaacgccacctctctaaagcgcttctatgtctagaatgggtggcacccaaatcgccaacttgtaaaaatgtacatactgttatgtaagcccttcggcactatgtaagccctttggcactatgaaagcctttcagcaagaaaaaaaaagaagaaagagagaaaaaagaaaaaaaactggatgtagggctattatccaccatggaggcccgaaccagtataaaatctatgtgtcctccgccttctttttatttttttcgtgtgattgataatttgtggaaaaaccccaaggcaaacgcctgatcagcgaaaaaggccaggggggcgaaacgaatcggccgaagcatcgctcgccgaacgttgaaaccgcaacagcttgtctcggaaaataaatagccgaacgatgttacgttcgatcagcataaaagcaaaagcgtttctttcaacacagaatgctacagatcgaaaacgaacgacgaaaagctaaaaagtcagtacacctatttcgctaatatatgcaaaggggccggcatgttccgacctaacaaaagcacaaaatgtgacgatgcaaacaatagcgaaaaggaaataaaacacgtctttattaacttcgaaaaaaaataatcgaagaatagaagtttcacaacacgatacaattcaccttacatgtaaattacatcttcgtccccataatcactatcactccctaaggaatgatcaggcgaactaggttcatcatcactactaatataatacacaaccttaagaggagtagggggcgaaacacagactaaactgtaacgacgttgaaagatcgtttcctgacgtttagtcttctgatggtttcgccgaaagcgagccatatcctccaaacgtcttgaatgaacaagatcgtaatcttctaaggttcgcccggggtgcgcccgcagccagtcggcaaccatgaaaaccttatagctgcgaccgtttatctccatttcgcgataaataggccgaaatggacatcgcaccttcggcagacccttcactgccacaaatttcttgttttgacttcgccagctcccgaaagggggccggatgcatgacttttggcgaaccccctgatggacagtgcagaaaaagcaaaacacagcttacatagtaagaataggaggaagaagggggaggtatggcataatgcgagatgagcgaaataataatatgccaaagacttcgatcatcaaaaagtaattaagattgtgtcatatattccaattgtacaaaaaagccttttttaaggtttggcggcagcctgccgaatgtacatcattcgcctctccaggcaaacgcagaagagggaggaaaacctctgggtgatcctgggcatcgcctccaacctcttcgcctgtcgtgccctttccttcaccctgatctgccgcctccgccttcgctagttgctctagaaggcgcactttggcagcggaccggccatctttctgccagaactgttttcgccacgcgcgaagagcgggcgaaatgttctgcgcactaatctcccagtcccccttcgcataggtagggaactcggcgacgtgctcgcagccgaactgttgcaaaagtcctaaggtgaaggccgccgatacatgctcacagcaatcgccgtacgcggtggcgcagtccgaaaccgatcctcagcagagaccccccgcactttcgcgcccatgtcagtaagggcgaggcggagcgtttggcaagccgttctcgcggattcggtggtcttcgccatctcctggaaccgctgcgactcctccgcggcgctcgcttcggccctactagccttcaggcaaagaacctccatcttcggctcagtaaggttgtagtagtcaatcagcactgctgaatgggccttcttcttctccatttcggccttgaggggatcaacctcggccctggccttaaactgaaggcgtttgacttcagttttcgcttccttgagggtattggccagggcctccacctccaggttcttgcggcttatttcgtcgtccttggcccgaagacggctcttaaaaccgtcaaaacgggcccgtacggttcgctccgtcgaacagtgagccacaagaatctagatgaaagataggagcgggtgaaaagaacaaaaggttaattgtcagacgtaaaaaaaaaagggacgaagaggaaaacgaagaaggaagaaaaggcatacccgaaccgccaggcttttaatggcggaacacccctcgtcgaactcattaagttcggtgaataagctcggggtgccggcgggcaagacaaggttgctcaccccctccataaagggaataaggtccacccgagtctcgaaatcaccaggggcgaagtggggcgccgcaagggaatactccggtggaagatgcttcggtggccgcacacttccccatcgccttgactagcggcgaaatagctggctcacgcagagggctcccgaaaaccctcgccacagccgacacaatccgttcggtggaggctgaagccccggcggcattaccgcctgccccagcaacgccgagcggagcgaggggagcagtcgaaaggtctaaactgcggccagcgggcgaagttggagtcccgtcagaagattcgtcgtcgctgaaaacgcgggcgatgtcgacgagtcctttctttttagagatcttctgcaccggacctcccttcgccgccttgcccgaggagaacgcaactagggccttggccccttccaaatccttccgtcgaaggtgggagctgttaaactccaccccggtctcgttgtgaccaggacttggggtaggagtgtagccgagggtgtcgacgcggtcttcgatcgcctcgttcgcggccttatcagccacggcctcctcctcttcctcctctcctaggggcaagcttcacttcctaggggcaagcttcacttgtccgcacattcacattcgcgaaggccctgcatcgtcgtcagctttgtgggggtttgcccgaggaggcaattcgccgttgtaaacccggttcgcccgcccagccgcttgtcgtgttagcaactggctatactcgacgaccgacacgtcgccgatcatcctgcgggcctcgttttcagcctggtcgagggtcaacgctgcaaaagtaaagtgtgtagctatgttaacagttagacaaggcaagataacaaagcacagcagtgtatggcaagagaacagtcttactgtctgtcccttcaggaagaatcaggttcggcaaaccgtcaacctcttcgccttgatcaactgtaacttgccatgactgggagaggggaaagatgcgaagcatacagaattcctccaccaagtcacggcagctaaggcgggagcaaaccttccgcagtagaacgaaccgcgcctccatagcgccgtccacggcgatcttgggtttccagttaggcgcgatcgccctatgccggcaacggagggctttcgccgagtaagtgccagcctcgaaggggatggtgtgatagaaccacctagccatccaatggtggtcccactttgacatggcagcgttcaccggccagagatcggaccactcgggacgaacgttaaagttcatgctcccgaacactgtcttcttcgttctagccggggtaatcaccgtcttcgagttcacggtggcgaaaaatatggcgccgaagagctcggcgttaggctcaaacccggaagtccggcacgcccagtagaagatagcgatccgaacaagcgccaacgggctcagctatggaagttccacctggaagaggcgaaggatctccggcaacaacacgttgcagggaaaccgtagccctgcttcaaaaaagacggcgaataccaccgtccgattgttgataggtttcggcaccacggcct

SEQ ID NO: 21023 - DNA, 1095 bp, Oryza sativa
ggaaccatgagtgcaaaaacacccacgcgggatctcccactttgacaaagcaatggagcaagtcaacaacaggaaaagaaatgaaacattcaatgacatcaaatgcacacaacctgcaaacataacgtggtggttgtagtgttcatgcatgccaattgccatccattgatttgatttcctggctggctccatcgatctgatgtcctggccggcggccattgatctctgatgagttagagctagctatatatgcatggacaagtatgagagcacaagcttacaacccgtactccgtgcacaccaactaataccaataaaaagttctagaagaaaattgtgcatgtattttcaatagtgttgtatatatctataaaatattaactttaaattcattatattctagccataacaaaaaggaaatatgataattttatgagtatatcactgatagaagtttgttttttttttttgctaacatataatgaattgaagatgagactttatatataggtataattaatactattgacagtacatgcatacttttctctctaaagttttttttgttgaaatttgttattacctctgtctgaaaataagcgcagtcctctaatttaaatttgaactagatgctgcacttttttaaaacaaagggagtagatggtttgcgcggagtatacatagaatgcgttccggatcagagtttccagagatacaattaatgcagataagccagcatatgtacatgacatgtcagttggtgtacgtacaggatttgttcgatcggcattcatatctacatcttttccaactggcattctctcctaccgtagttttagttaattccctcctctgcgttgtactatgtccattggacaacaggccatatatgcgatcgaacactgaaacagtaaatagatcgaagatcgaattgacttaattaatagcgcagccgaatatatagaaaatggtaggtccttaccagggcgaattgtatgaatcgtatatttgttatagaactttaaaatcataaggtttgaatgaggtattatttgtcattaaatttactcgatattacctactgttgaaccggag

SEQ ID NO: 21024 - DNA, 4353 bp, Oryza sativa
cggcgcggggaaccggctggtggtggactgcacggccgaaggggtggtgttcgtggaggccgacgccgacgtgcggctggaggacttcggccagccgctgctgccgccgtacccgtgcgtcggcgagctgctctgcgacgccggcgacaccagggctgtcgttggcaaaccattgctcctcatgcaggtaacacccacgacgacgtacgtttgtttctttcatttttgtttacaatccaccactcagttaatgtttaactaacctgtctactatatatccgtcctaagatataaccaactaaataaaacatattttaatattacagatctgaactgtggtatatttaaatttatatttattgtgatgtctctaatccagtattatatcgctatattttatggtggaggggtagctaaatactttatttgtgttttagtgacatgattaatttacagtccatcttatttaccctatggattggttgtaggcatggatcaagattcattcattcgacaacaatattactttggttgggtttaggttcactggtactagggaccgtgatcttaataaggattcgtaaggacgccacattgttacgagaacagtgatggtagcttcgtgcatggttggtagggattgtacctactattaattacagcaacccactgatcttcatttacgcaagaaataatccaactttagatttgcagatttgattatgcacaaattagttctggagttaacaaatctcttttctgggcaattggttttatagttttcagttgccaaactgcttttcttttgaacactgccacaaacatgagaaatacaatgaatgtggcatcatattttgataacaaaaacttaaaatacaaatacaacagccacattaactaagatttagtctgaagtagtggtgaatgggattggaccagaaaagcattgaaatggttattcaacacaacgattagttggactggctttgggcccatcaagaggggttccaactggagtgtgatgttgcagttggatgatatatatatgggccggcaatattaagattgcgaattaagaatgtggtaatgttgtgttgtattattttcaatattataaaacgttttagcttctccatccctcatttaaattcactagcatccatatgaatttgtacagatatataaacacatatacatatgggatcaagttgcatggtccgactatatattcatactaacataaaaggtcggattttcacataatactgacaatactcgagcacggaagaattcttttaatgttttataagaatatatactgcctctgtttcttatttctgattgagctgaccaatgtcatatagaagtgtttaggatggaggtaccatacttaccatgtctaattaattaattaatttgactgttactgatttctatatgtggcggtttcattaggtgacgcaacttaaatgcggcggattcgtcctgggcttccacatctgtcacaacatcgctgacggcttcggcatggcgcagctgatcatggccatagccgacctcgcacgtggtgagccagccccgaccattctgcccgtatggaggagggacctactcacggcagcacgcctaggtagcggcgcggtggcacgcacgccctttgcatcggcggcggcggcgtcggcctcggcgtcgagcccggcactacagaacggtgctcgccgcgccgccgccgcggctgacgcgatgctgtcgaccccgccggaccggatggtggtggagtacttcctgttcgggccacgggaggtgtcctacctgcgtggccagctgccggcgcacctggcggactccaccacggtgttcgagctgctcaccgccgtcatgtggcggtgccgcacggcggcgctcgggtacgggcccgacctccgcgtccggctaatgatcaccatgaacgcgcgcgggaggtggaacgcgcacaccccgctcccgcgcggcttctacggcaacgcgcacgtctcccccgtcgccgaggccgccgccggcgacctcctcgggcggccgctcgccgacacggtggagctcgtgcggaggaccaagcgcgggatgacgcgggagcggatgagcgccatggtggagacggtggcgcagctgcgggagtggccgccgtcgagcatggacagggtgtacgaggtctccgacatcaagtggaccaccgtgaacttgctcaagttcgggtgggctgagttcgccggcggcggcataccgctcgcaggcgatctcacctccaagctcggaagcgaccacacgaggtgcaagaactcggccggcgaggtgtcgacggtggtgtcgatgctgctgcccagggtggccatggcgaggttcaagaaggagatggccgttttgttgaacaaagatgacaagaagagcttgacaattatgagttcgctgtagttgttgccacacatttcaagcaaaggttcttaaacagctaatggtcaccaaagcacatttttatcactgtcacttcatcatttctgatcgatctagttgtgcacatctaatttagtgggacaatcggtttacttagtggagtactacaatatatgtaattgtattcagttgtgtctacctgttcatctgcacaggctattggattttcatcagttctttaattgtaaaatacacccctccctttaatgtatgcgcacatacttttaacttgtaaagttacctcgctcattatagtttgtaatgtgagctttttataaatttgtttctattacttatgacggaaaagataaaagaaaataattaaattaaactcctcttgtaaccttggagcggcctacgttacatatctattattccctccgtttcatatatactactataaaaagtacgagttcatcaaacacctgtctctcctaacccttagatctattcatccaacggtttatatcaagagttggatcacccctgcaattagctatcccgcctccactaatctgcggttacgaaaaggaagagaggaatagaataattcatattatctaaaaatattcaatgttacatttaatgaaactaatttagtatagtagattttgataatttttttataaacttggttaaacctaaacgacctaaagtagtaaaatagtcaaatgacctataatatgaatcagagcgagtatatattaatattatttatcaatcaatctatctatctatctattatgtctttatctttatctattataaaaataaagatgattcgttacacacagttggttcgtttagtctgtcatctacaagtctggcttgggaatgcacatatagcgtgaagtccgtccatggttgttatcgcgggagaagcaaaaaaggaaacataatcgtatctagaagtccatatgccaccttcaaatgtactgtcctcctctctcctaccacaaaattttcatcgttgttcctcgggcccactcaatttgtccctttgaatgatgaatcactctttccaaggcgtgattttcttctccccttccccccttcacatctgctgcagtttcgccaagatcatttcctcggttcccctactcctaggacaacgaggatgagcaatccatgcatccagtaggtttgtctctaattggataatgacgaggaaaagccatatcattagcttgagaccttcaacgcattagactagtaggagaaacaaagtcatagtgctaggtcctcaccgatgtgtcaccgcctaggcgcctatagttagccagaaggtttgcagcccaatagcctgactcacagcatggagatttggcttggcacatgcgcagcacagcccaacagttgggccgtgcctactgcctaggcctctttgtcagcccgacgtgtcggccaagcatggcacgccccaacgatcaacatgcccaaagagataaggaaaacgaaatagacttattccagccccataagacagtaacttgaggccttcgacgcattcgactagaggagaaacggagccatagtgctaggtcctcaccaatgtatggctgcctaggtatggcctgaccgttggaccatgcctaggcctttttctcagcatgacgtgctggcctggcacggcacggcccaacgatcagcaggccaaagagataagggagaaaaatatacttattccagccatataaggtactgtccaaagagatgagggaggtaaaataaacttattccagccatatgaggcatggaccaaagaaatgagtgaggtacaatagactttattgaaggacgagcacagtgggctgatcgtgcctttgtgctggcatggcacaacctgtgctttattgggccgcgcct

SEQ ID NO: 21025 - DNA, 3243 bp, Oryza sativa
tacatctattctcttatttctatatctacactaatataaaatataccagtttcatctcgtagaaaaatgtacacagatgtttcctatccataggatctcttaatctaacattgttccatattacgagttggattcaacatctgcaattagggatccctcccctcgatgtccactacacaccgccaaaatagtggtcggttaaaaaataacacttctccactcctgactccttccagaaaacgccgctccaccgaatccagcccaccgctaccatcgtgcgcactaagccgctgtcgcctcctcccacacttgccctacccggtgcaccgctactgcactcacccctagcccaccgcctcatgcatgctctctagtctccattccactgcacacactgtcgatcacgagggcacatcttggtcgcgctatgagggagaggggggctcgagtcttgtccctggctttcactgatgcggttactcgccggtttccttccatgcctcactggcccaatcaactgcccgtctcgcgcatactaagccgttgcctcttcctgcacatgccctaggccatcggcaccgtcatcgtttccactccagcgcccaaccaacacccttctaggcgtagggtggtggttggtgcctggcgagagtgccgagatgatgcggtctcctaattggtgagagggtaggtacatgcgatgctgctgcttattgaccttaattgatgagcttgtgtctttttgttcaggacaagaatcaagttgcaatagtcacccaacatctctatctctactaatataaaacacaccagtttcatcaaaacaagcattttctaactcttagatctattcatccaatggttcataccaagagttggatccatcagagcaagtataatagagggcaataagaaggctaaatgctgaggtgtatgagagaggaaaggagagagatgagaagcgggctgtaaccttacagctggcttaggtacaggaaccaagaaaatctatgaaatagatagatgaactatatatttatactgaagagctaaccactatatgagtgagctgatagatatgccataaagatctatacagtaagtagttggctgtattattagccttgctctcatccaattagcactctcccactctgcgtgggacccaccactccgcacgtctcctcacgcctgcgcacgttgtggataccagctgcaaaccccaatccctgcaatcccgagtcggatgcccgacgcgtggatggagtcgggatccggttcaggccgctcggctccaggcgcattgtgagaaggctcagttagggtgagcggagtcatcgagcaggacggttcgcctttctctggccgtgatttcccttctccccatctcgtctccattgactagaatcacctctcctccacgccgtcggctcgctcacctacaattgccctacctcaggtctcatcaacttatgcgccgctgtcgccgtccccctccgcctaactcctggccacgtgcgccagctgatggcggcggctgggtcagcgagggcaagcatcaggcagcggaagaaggttagattattaagtcagggagttggactgatgcgctgcctgtggtggaggtgagtgtatgttaaattaagctgcatctttgtgggcatgaaaatatcataccctttataccgtggcaaaagttctgaaagaaggtttagatgattaagtaaaggggggatgagttgatcaggagatgcatgcacatgtggttaagtttctcgatttgtttggaatgcagtgaacaatagattttttcagtggtctatctgccaaattagatattagtgttgttttagaaataaattgttttctcattccgtggaactaattaaatatttatgcttttgggtttcttccttgcctatcccttctttctataaagttaaaacccaaagctacctccaattcgccacgtcattaacatcatatcagccattcgatcaatatgtacatcagatatataccattagatcttcatttacctacaagaaaacgtgcccaaattgctgggtcagcccaggtagacccacctcctaatcaaatggtaaagctgcgctccttccacccatggaaatcattcgccaatgctgaaactgtcgccatgaaagagcaggcgaatgatcgcatttaatccattttattccacccatcaccacgattgtttttgtttttattgcgccatgtaatcctctccatcttcctccactaacccagaaattatcacgatcattatcgtcgatctagctgccagcttactctcaatatatatagaccgtccgatcaatatatagttcttctgcgtcacttgaaatcttcccctgatcccatcgcatcaccaacaagaagtaccatgtacttgccctgttgctcagcctgattctctcatcatctgtaactgacattttctatgtgtatcttcctttgaatttacttaatgaatctatgctgtatcctttcgcacaagtgcacaacctgtatacacatgcataaatgtcactatatatccagatgtcagatcaattgcttgctatatgagtataattagacatttgagcaccacacaacatttgtttcattgctttgctgcaaactgaatttttcatcatctctgatgtttctggccattaattatcatcagtagtgcagcttcgagctaaccactctcaactttcaataacggtggcggtctactgccactgattctgctcgataaattgtagctttcacaaggcatcatagtttcctgatgacctctgtttttttaatctctcaaaggtataagtcaccactgcactaaaattatatttttactattgtacatctttagggtaatcgtttggatgattatagatttacatgacttattagtttcaggatgttgtcaccttggctatgatttaagtagttaggtttcccttgttggaaatatagtcatatatcggcatattttaatccaaaatattaagacaataatcatgacatgaacaatgtgaagtgatctagagataaaattaaacataaccaggagcatgcttaagatagaataagcatcatcatcatgtagagaatgcaataacattgcgactaacagaagtaacaaaaacagagatagcgatagaatgttataccctatgaaattccctttgctggattgtgaggcagaactgcctccgttggtgttgtcga

SEQ ID NO: 21026 - DNA, 1861 bp, Oryza sativa
aagccactcggcgtcaactgtcgcagtatctagtgctgtaagttctgcttccattgttgacctcgttaagatgatctgcttgcaagacttccaagaaacagcaccacctccaagtgtgaacacatatccacttgtggcctttatctcatcagcatcatatatccagtttgagtcactatacccttccagtacttttgggtacccggtagtgtgaattccatagcttatagtgtcatttagatagcgcattactctttccagagcctgtcaatgatcatctcccggatttgagacaaaccggctcagcttgcttacagcaaatgatatgtcaggcctcgttgcactagccaagtacatcaatgaaccaatgatttgggagtatctcagttaatcccttgctattcttcggtttttccttaatagcacgctaggatcataaggagtagcagctggcttgcagtcactgtagccaaagcgacttaaaatcttgtccatatagtaggatttcacaagtgtaatcataccctcatctcctcttagtagcttaatgttaagaataacatcagcctctcccaaatccttcatttcaaagctcttggataaaaagtccttgacctcctcaatcacattgaggctggtcccaaagatcaatatgtcatcgacatataaacacaagatcacttcttctccccccccatagcgatagtacacacatttgtcagcttcattcacgacataaccagcagatataagtgtggtgtctaacatgtcatgccattgcttagatgcgttgcttaaggccacacaaggatttcaacagtttacgcacgtattccctcctgaccttatagtacatattcagtgctagttgatccatatagatctcctcctgcagctctctgtttaggatacctgtctttacgtccatctgacggccgagcagaccatgagaggctgccaaagcaagtagtacacgaatcgtggtcaaacgggcaactggtgagtaggtgtcaaaaaattcctcgccttctttttgggtataacccttggccacaagccttgccttgtacttttcaattgtaccatcaggcctaagctttttcttaaaaacccatttgcatcctacaggctagcacccatatggacactcaacgacttcccaagtaccattagacataattgagtccatctcactgcgtactgcttccttctagtagtcagcgtgaggagatgaatatgcctcttctatgtttcttggagtgttgtccacgaggtatacaatgtagtcatctccaaaggattttgcaaccctttgtctcttactcttacgagtatctacaatcttatcctcctcaggatttccctcaggcgtttgatcattgtgttttatcggtgcaaagtgctgatggggtatgacaatttcttgactagaagtgctaggcgtatttttcatgggaaattcattctcaaagaatgtggcatctctggactcaataattgtaccaattcacatgtcgtgtactccagagtttactattaagaatctataacccacgctgtgaatagcataaccaaggaacacacaatcaacagtattcggtccaagtttacgctttttggctataggtacatttaccttggccaaacagtcccaggttcgtaggtatgagagatttaatttcttcatttcccattcctcgaatggtgttacttccttatgcttcattggaattttattcaggacatgacaaagcagtcaaaactgcctcaccccaccattccttggaaagtcctgtagtgtctaacatggcattcaccagcttagctagagtatgattctttctttcagctaccccatttg

SEQ ID NO: 21027 - DNA, 1107 bp, Oryza sativa
tgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatctcgactgtaggataagcgaaatggtcaaaccttaaggactaattttctgaaaatatgatttgtgaaaatttctcctttcttccttatctagaattctttgcaaattgtttcattgtctactcccctctctctttcaacttcagtagttctgagacattgaaacttgaagacgccaatgaggtctacttacggaggttaagtaaagtggatcgaggaatatgaaggtgatgatcgatctgaagtgccaagtgttcaagatggaatgaagtttggatcctaccttagaacctatgccgccaaactatctttgaagaatagttagtagggtagaacgtttgttgcttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaatagatggtgaacactcgcgccagtggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactaccaacccagtagaagcaggtgattggctgcacgctatcgagaagaagttggaattgctctagtgtacggatcaggagaaagttgttttcgcttcacatcagttgcaaggacctgcatcagaatggtggatcatttccggatgaacagagcagaaggacaaccaatcacttgggcggagttcacggaggca

SEQ ID NO: 21028 - DNA, 17001 bp, Oryza sativa
ttgagatctcccctagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaatggccgagcaagcaaaggcgcacgacctctctccgagtgtgagcggcgacgacggggagccaaacccgcgccatcgagctcgtactcccccacctcctccgcgccaaagtcccaagcggggggaggcgctcgagagagtcgaaaaatccgcagcatcgccagtcgcgggtggtgcaggagaacggcgagatggggagcgtcgcctcctcggcgacggcagcatgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgagagcgtcaaccccaccgagtttctccaggtctatacgaccgggatcgatgccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcggtcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcattggtgtgacgccggggcacacatggccgttaggtcacatcgacctaccggtacctttggtggatcagccaacttccgcacggagcgggtgaacttcatgtggcggacctcagtctgccctacaacgcggtcctggggaggcccgcgttggtgaagtttatggcggcggtccactacgcctacctccagatgaagatgccgggccctggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatctggagtggctggcgaacccggtggtcgttcccaaggcgaacggcaagcttcggatgtgcatcgactacaccgaccttaacaaggcatgtcctaaggatccttaccccctgcctcgcatagatcagaccgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccattctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgggaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctccgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccgacccccgaggcccgtcggagtccaggcctcgggacccgaagggagcgctccaagctcccttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgacttctgcgaagacatgggcatcaagctctgcttcgcctcacctgcccaccccagaagcaatggccaagtggagcgcgccaatgcagaaatccttaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgagggggggggtcgggtgtcaggtttcgggctcgggctaaccacgcacccccctcgggtgtgcagggttagccgggggctaccacacatgcacaaccttacttttcttattttagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgcgtctcgaggttagcagcctgttgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatcgcctctgcctggcgagcccgggcggtttcctcccgggtggcttcttcagcctgacaagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtattcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgagggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgaggcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagggcttgagatctcaccctaagcccccggccgaactggcaaaggggggcctgcgcggtctcccggtgaggagccccgagctccgtcaaatgccatttcacaattattcgaattaattcaaagttgaatctttaaactagcatagcttggatttgaatgaaacttaaacctaaatttatctaagatcaagatctatctgatggtatcacttttatcatttattttgtattatatgaatttatggtgattttatttgaattctattcgaattcaaataaaatctttcgtgtctaaatctagatccctaggaagttgatgagttgagtgaagaccagggtcagcaaggctgtgagcaaggcaagtcatctctaatctttgagcatgttaaacctattgtgaagttatgttgatttaagtaaaatttgcatgctatatatatatacacacacaccatactttgatgttgattccctgcaattatttgtatccgcaatattgtgtctcgtaaatctaataactgcttagtcaatgccacttagattcatgcacatccatgtttatcaaatgctatggtggtgtttggatccagggacttatcggatgtttagacattaatttggagtattaaacatagactacttacaaaactaattacaaaaatgagatctaattcacatgacaaattttttaagtctaattaatccataattagcacaagtttactgtcatggattaattaggctcaatagattcgtttcacgaattagtctagggttatggaataggttttgtcaataatctacatttaatacttctaattagtatccaagcatccgatatgataggaactaaatttttagtcccatccaaacagcccctaaatgcttgggcatctactttggggaagctagttgatatacggcatgtggagacatgagcgccactttgatataacatgaacaaaatggtttgtgaaaggaaatctaaactaaacaaatgtttttagactagtggctggatgacttgggtggtgtccggtaaaggctagtgccgtccttggtctgttaaggaccgtgccttgaagctaagcatgaaatgaccctagtacaaccatacttctcgtatgggtatagacctagcggagtaaatagccgagcagaggtggtacccaagtgcactggttttcatctaggtgtgtgaataggcggggagcctacggtgggtaaccatctgtgggcaaccaaattaaaacctaacttaactataacttaacgcatgtgtgagtttttccctcctcgggaacgccagaactcctctcactactagaaaccatgtatgcctagagtgcatgagggctcaagttcatggagcgggtactgccaaagtgaggttattgaaaggctttgccatgacgcatctcattcgttcggactttggctcatgtgttgggcaagtcacggcgtacaggtggagtgtatatccactacagtgtgagtaaaccaacatattcgaatagctgtgcgcgtggatattgagcaccgggacatgtgttacacttgcctagaatctaaattcttaaaatgatgggtgggatatgcatgatgattttgtactggtggatgaacttctcgaaaagcgagaaagggtagaccctagaaaaccatgatggtccagtggccggaagctatccttgggatcacaacggatggtggacagaagcgttactgtttaatgaataatggtattaaaacctgatcagtctatgctaggtcttaggcttatgaaaagaattacaaaatgagctttacacaaaaagaacctttaaccattccttgaatatcctctatgatatgcatcgttgagtgtaattaataatggataatttaatacaaattaaatccagccatgctttatatttaggaaattttattttcccacatttaacttcatttgtaaattaataaacatttaatataaattctaaaaataatttataaattctgaaacgaaaatcaggatgtaagagtgggttagcccaattcaggtagtgtctaagaaaggtggaatgacaatcgttaaaaactcaaaaaaacgagttgatcccacaacgtaccgtcacgggctggaggatgtctatcgacaatagaaaactcaaaaaggctacaaagtcagtccccgttgctctttgttgacagttattaaataccaaatttaaaccgtcaatacatgcataaatctaaaaatataaaacatccaacatagtggtagggtttaattccagcaggaaaagcagaactcgaactacacacaagctccaagtcacttccagatcttcatggctttgcatggtgtgtcactcgcattgtgttcactctaatatccttcctgggtgccaaccataacttgtttacaagatttcatttgtgacttggtttagcagcacatccacccattgcagcttgatgacttgcctcctatgatttatgtagaactaaatgacaccccgcgcgttgttgcgggcataacttgatttacatagtagatttttttaaaaaaatctactgatcctcatcatcaagcatcgaagttgagtactcctaccttgctcagaaagcgtaaaaacatttgacatcaatgatgcaagaaatcactatgagagcgaagaaaattaaatataaagaccttttgatcattacgattttcaaatgaatgaaatcacagcacatgttagtttgactccatatgcatttgcatgagcttgaggtagcacattggggaatgcacatggccacaacccacaactatgtatcaattgtatacaacaaaatgagaaaaaaaaacagcttgtaaaaatagataaaatagaagaaatgagtaaagatctgcacaagctgcaattaaatctttggataattacatatccaatattattagtttttacttcatgtgctaaaaaaagtgaactgaatgatttatcatgatcagaatatgaattttcgtcgcagattttcactgcagtgggatcaagttccatagtgaaaaattaaagcattcaaataggttcctctagcagcgaatggcttaaattcaagaattgagtaagggatgttagaataaatgggctaggcccgatttttctattaaaatctcaagggccaataataaatgttaaggataataataccagcttaggaattaaaagtggagtatctcaacttaaatagggagttattggaggctccctgttgaccggtcgaggtggggatcggaaagccacgcgcgcgccgagccgagccggccgggccgaggccatgggcgaggcgtggcgtgcgttgcattgggttgggttgcgttgcgtctctctctcgatccttttgcaatggaccggaatccaaccccgcgagattgcctctgtaacgggcaggcgattcaatacgcattgatcgcgtcgttactatggcaacgggcggattcctctcttgcgctattaggaaacagagacccccgatcagatctccatgctttctctcccatttctgtttccccggttctgatcccgattagatctccacgctttccttcccatttctgtttccccggttctgatcgcttgcgcgcacgagagatcggaacgagcaaggcttttggggagtgcttccgcacgactgctcctcttcttctgttcgttgtccgttcgtctgcatcacctgactgctcctcttcttctgttcatcgtccattcgtctgcatcaccatgtcttctggagatggcgcacccggaggcaaagctggcgcacctggagctggagctggcgcaccgatcgacaacaccaacagagacagttctacctcacaatccagcgaagggactttcacagggtataacattttgtcgctatctctgtttttgttacttctgttagttgcaatgttattgcgttctctacatgatgatgatgcttattctatcttaagcatgctcctggttatgtttaattttatcactagatcacctcacattgttcatgtcatgattattgtcttaatattttggattaaaatatgccgatatatgactatatttccaacaatccaaaaacctgatatatcattttcggtagttgtctttgttgctgcactaaaaccacatacttttgatggttctaattataaaagatggaaagcacgtgcactactgtggttgacagcgatgcaatgtttctatgtttcatggggtaaccgaagtgaaccacctctctctcctgaggaggaggttaagttcgaggcttcggattgcctgttccgtggagcattgatcaatgtactcgctgacaacatagtggacatgtatatgcacaatggcttcagggaacgacatgtgggatgcacttgaggccaagttcggagtttctgacgccagcagcgagctatatgtcatggagaagttctatgactacaagatggtcgatgaccgttctgtagtggaatgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattcctaatttttaatcatacaaagagcatttcagtaattacccacatattaaattaatcattaaatggtctggttttaatattgttaaatactttgggtgtccaagtatgttcaagatttttcttggaattatttgagcattggaagtatttttaacaattcaaagatcatttcattgattaatttaattggaaaagtaataataatcctcttcctagtcttgggccctttccggcccatctccctcttttgtgtgcacggccgtgcagccctagtcggcccagccgagcttcccccttctctttctttcttttctttgttttcagccagcccaagacgaaaagtctaatttgcgtccccttctctcttccttcctctcagcccgcatagaagtctgtttttcgtccctgtcgctacagtgctccttcttctacctctagcagccgaactgagaccgatttggctcggtttttctcctccaa

SEQ ID NO: 21029 - DNA, 1163 bp, Oryza sativa
gtcaccaccgttaggtgcgcgggagggtggagaagcccggccgcctgaccaccgaagccgctgatcaccggagccccgtcgccgccgtcgaccgaagccgcgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcagaaattcataactaaatcatcgtaactcggttttgagtggttcaagttgctaaattcatctaaaatcatgatctacatgtttgtttactttttatgtattgtttatttggtttttattagtctttttcttcgttttgcgtgttagcttgtcgtttccgtcgttgcgaaggttcgtgagtgccgccggaagtattcaagaagattaattgaaaaccgattattgcaaggcaagtcacacagatcctaaacacgatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgttatatatatatatatataattgcttagcaatgcttagaaacattagctcactaatgggatgaatcttatatactacattattaatgatggttatattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacctttaccgtgccaaccacaagccagcatgggcaacggctttatcttttgtatagcgtgattcattatagtgcgccagactgagaagtggcgagaagtccacgggggtcgctggggagtccatgccttgtttataaaggggtgattatgatcca

SEQ ID NO: 21030 - DNA, 637 bp, Oryza sativa
taaactcattggaaaaatactcgccactcctatcagaactcaaccgtttgattttcctttcaacttggttttctacctcagctttataggtcttaaagtaatgcaatgcttcatcctttgttttcaatagatacacataacaaaatctagtgcaatcatctatcagtgtcataaaatatttctttccccctttagtcaacacgccgttcatttcacgcagatcggaatgaacaagttctagaggtgccaaatccctcgcctcagatgccttgtgaggcttgcgaggttgtttcgattgaacacaagtatggcacttggaacctatgaccaaagtgaattttggaattaaactcatgttagccaagcgcgtcatacaacggaaattcacatgacaaagtcgcgaatgccacacattggactcatcattctcgctaatatggttaacaacattattattattacacatgtcatccaaagaaaagcggaacaagcctctgttgtcataacattttccaataaaagttccatatttagatacgacacatttattggattcaaacacaagtctaaaaccttctctacacagtagagagccgctaactagaatcttctttattgaagggacatgttgcacgtt

SEQ ID NO: 21031 - DNA, 593 bp, Oryza sativa
  unsure (1)..(593): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccttatagctgcgaccgtttatctccatttcgcgataaataggccgaaatggacatcgcaccttcggcagacccttcactgccacaaatttcttgttttgacttcgccagctcccgaaagggggccggatgcatgacttttggcgaaccccctgatggacagtgcagaaaaagcaaaacacagcttacatagtaagaataggaggaagaagggggaggtatggcataatgcgagatgagcgaaataataatatgccaaagacttcgatcatcaaaaagtaattaagattgtgtcatatattccaattgtacaaaaaagccttttttaaggtttgg

SEQ ID NO: 21032 - DNA, 6380 bp, Oryza sativa
gggtagttgctggtgtggaagaggaagagagaaagtgagtgagagagagagaggtggcgccttggctgctagcctcatagagtcaaagagtatttaggaccttgcagctatggctatagatagatagaggcacatacgcatacgtatatagcttgctaccttgccttctctgtgtatgtttcggcgtgtgttcttcttcttctcttcttcctcctctcgattctgaagaggttagctatgatttgatcgatcgatgatgagcgggagcgagagccagcaggagagggagcatcgtcagcagcagaagatgaacatctcctttgggatgatgatgaaccatggccaccatcactacggacagcatcagcagcagcaccatcatcatccgcctccgtcatcgtcttcctcttcctccatgcatgccgctgccgcaagcttcatgtacggctttgtttactgaatctctctccctctctctctctctctctgatttgtttgatgcatatatatgtgtgtctctttcttgttcttgatttgggccgtgtcttggagtttgattttgatctctgatttgttagtcatgatcatgcatggtttgttttggtttggttcttttttcttgcttgctctctttgtttctgctggttcttctgatctcttttttgccatggtttcctcttcttcttctccttcttctttttatggaaactgctttaatttcctcttctcctcctcctcctcttttaacaaaacactagccatggagaaactaggttaccaataatcttcttgtggactgaattttgcattctactgttctacatgttgaagattttgcttctttttttgctagaattttgcattttacatgcagacgattttgcctttttgcttcctggttgggaattcagtgattgtttgagcggatgcaaacagatcggtccttttctcttccttcttcctctccccccaagaaaaaaaaagttagacgatgatcaaacaagttcagatttaaaaattcagtacttgtgatttaatatctggagccagatatagttgaattgttgcaacaactcgctagtctttctttcaaattttgggaggtcagcgattcatttccgcataagtacaagagcattacctaagacatatttatgaccaactgatcatacatatctgcccaagtttttacatttaatttacagtgagcatgacttgcacacatgaaatttggagagtacatggccatgcttattttctgggctgtgccaaaataaatgctacaaaggtagagtagattcatattattcttctgctcctactcttgcagtcttgcagaggttggaccagacaaataattaatatagcatcatacataattggcttatagaagcatgatttcatgatgatgtgtgatgccttcactacttcctcaaccttgtgcatgcatgctactatactacctgcatctatctcacacatacatatagctatacctcatcaccaacaattttgcttcttgtgctgctcctaattttgcttcttgtgttgcaccaccaggagcagcaaggaggcatctgcaggagcttatgatcatctgggggagctggaccaggccttgttcatgtacctggatcatggcagccatgcggcgtcgcaccaagaacaaaggcgtacgtatacgaaaaaaacccgtaaattttaattcgccaaccgaaaaatcaccacaaattttctcaaacatgcattcaccatatatatttccttgcaaaaagttcagattttttttttcaaagagtattaatgcaggtgatgagatcagtagtaacagttttcagttgttcttcttttggcatttagcattagtagtaataatagcataataacagcagtatatatagcttaggcacagaaacaaatgtgccaagcatacacagggagtagcagtaggctgtagtataggaggaggagggatatattcctatggttgcagaaagttgcatcctttttctggggtcatcagaaacgatcatggtatacggccggccggcctgcatgcagcagattctcaggtactccattttgaccaggatatctgctagctgcaacaaatctctgcagtactactactgctactactaccactgcactcctgtggagatcacacatctcaggaccagggaatcagcaacccaaagtccatgcatatgaaaccaacaatctctctagctatacctctctcttccctctctctctctctctctatctctgactgctaagatctggccggctggtttggactgtgacatgtaacaaactgctcaatgatttcgccgagatcgagctgcatctgcatgtggcctggtgcagagaaagagggacgtacacacacacgccgaagagatgatcgatcaatccccatgctactgatcgttcttgttgctgctactagctaggagtagtagcaagatgtgcacatttgttcgagtttgacccgatcgatgctatccacttctgttgtttccagcttcaggttacagtgatcagtgttgcagtgtagcagcagctagctgtgcagctgtgtgatatctgtccttggctcccgtatctctcgtagcccccagctttctcgtgttgcctgtgtgcctgcagtactgcagctatagctagctttggacgtacctagcatgcatatatagtacacactactctctgccatgcaaagcatgatgaatttgagcagcagcagcagtagcacagtagtgtcttgttccagctgcatgcctgcatatatacagcctagctctcttcttcagtagagttttcagtagcaattcgatcagtttgtgagttgtggtgtgtgagtctccagggttagctggtcttctgcttttgctcgatcgatctcttgatttgtgttgtgctcatggatgatgcagagaccctcaacatcttcccttcccagcccatgcatgtggagccatcacccaaggtatttaattaattttacttactttcatctgaatctcacattggttatgtcatttgtcttttcaatgtagcactcgtgtgtagtatatatgaaatcaaagattggtttaatgtttgtggatgtgatgattgattgattgatttggcagggagagattagtttagtgctgtccccagcagctgtgggaaccaagatggcgaggtcacctgatcatcaccaccaccatcagcagcaagcagcagcagccatggaggagttggcgacagggagcaggagacaggatcaccaccacctgcagcaccaacctttcgctgctgagcctgcagggatcaacagggatgtgaagccggtgacagccaaggtcagcatcatcacttaaccacttaattaaccaactaatatctaaccctgctagctaaagaaaacaccctgattaatctattcagaacactgtccttgattgtttttatgttttagcttacattaatgtgcatattgtttatgtttttttttattattgcagaaggatcacaggaggggtgtatctactggtgaacgcgacccaaaggtactatactagtgatattctcaagaaataattagagattagttgttgttctctttttgtgcatatcagttgagttaaggacaatactaaaaatgatttggtctgatcatgcttacttttttgcgtatcattttgtgattaatgtaaatatatgcagacgctgaggaggctagcccagaacagggaggcagcaaggaaaagcaggctaaggaagaaggtgagtgaagcaaaattaaacagtaattaaacacagaaagaaaaagaagaaaatgacaggctatatatattcaatatattcagaacaaaagcaatcacccaaatttgatcaaattaaaccaaattaattttgctagttaattactaccactcttcttcaattcagccactgtggattaattactttactgaaattttgactgaaacgacaggcttacatccagcagctggagtccagcaggatcaggcttgctcagctcgaacaggaactgcacaccgcgagagcccaggtaggcgaatttcataatttcaaattcgagcaaaattcaaactgcacccaaatcaaatcaaacacaaccaattcggattatgtattatggatgaaaatgtgtacggatctatacatggtgcagggggtgttcttccccggcagcggcgggctgatcggcgagggaggcagcgggaagggggtcctgctgggcgggatcgatggcgtcggcggcggcggcggcggggggctgagctcggaggcggcgatgttcgacgtggagtacgggaggtggcaggaggagcaccaccggctgatgtacgagctgcgggcggcgctgcagcagcagctgccggagggggagctgcaggtgtacgtggagagctgcctggcgcaccacgacgaggtcgccgccatcaaggacggcgccatcaggggcgacgtcttccacctcatctccggcgtctggatgagcccagccgagcgctgcttcctctggctcggcggcttccgcccctccgaggtcatcaaggtacgctactatgcactccccccgccatggattggcttggattggattaaccctaaccctagatgctcgtagcgattgacaatggcttcgtcgggaggtagaagacaaacggaacaaagtggggaaaaaataatttggattatgctttgaaacccctcgaatatttttatattgcgtattagtccctcaaaagaaaataaaagaatttacataaacaaccttaactagctcgggtcttcagagtgatgaagaaaaatgtcgcatgaaaaaagtttgcgcatttctaattttgatcaacatgaaaaaagtaacttatcgaaaacaatttcgataagaaaattgaaaatatataatacttagcctcactatataaaaaatgatttctattgatgccccctccgactgcattgacaatccataagggtcgtgtcattgatcgcatacgaaaacgtagtttcatatatggctgacttaaggtggccgcacacgtggttgagttaagccaactgcttgtggaatgtgataattttctacatgtgaaaattttcattggccttctgttaggggggcgattccgtcttttgcaaatgcatcctagccgtctgtaaaggaaaatgtctttttttttaaaaaaaaaaacaatgtcgatagtaaaccctattttagtttagtacttgtttataatacgaaacggagagagtattagcagcattggcaccttaattatatgggtcgcggaggcagtgaataatattcatgtgacaaaagccaaaacacacaccttgttattgtcgtttccagcaatgggtaggagaagttgtgcacttgctcggcaagctcatcataccctctccctccatggagagagctggacgacgacaacgagtagtggatggatagctagcttcatcgatctgtcgcgctcgcgcgcgtgcgagcattccccgccatcttcgcgaccgcgtgggcgcatgcgtcgatcgaatcgatcgatatatcgacgcattgaatgatcgatctgatcataatcagatcaggaaactgggatttcagcttttcaagccgggccacaactgaatccaaccaaatgttgtagaactgtacgtacgtacgtagcagtactgataaaccaacaaaaaccattacggattcaggatttacctacattcgtttcgaatctgttacgattaattgtgctgggtttttcagtgtaattaaactgctccatcgatcgcgtatactgaactgttatatcagctgctatcacagtacctgcattgacatatactataactcctgaatgaatatctgaatatctgatcactagctgacagagcaacagtttgtgtgcatttgttctcttcttttttgctcgattgcatgactgaattcgtgatgtgattaatgtgattggattgattaataagtagtaattgtgatcaatgtggattggaggggatgcagatgctggtggcgcacgtggagccgctgacggagcagcagatcgtgggggtgtacgggctgcagcagtcggcgctggagacggaggaggcgctgacgcagggcctcgacgcgctctaccagtcgctctccgacaccgtcgtctccgacgccctcagctgcccttccaacgtcgccaactacatgggccagatggccgtcgccatcaacaagctctccaccctcgagggcttcgtccgccaggtaccctaccttgcgtgattctcacacactgtctgcatcttcttctctcatgatttgatcgagctcagtaaccaaaccataccaaattaccaacccttct

SEQ ID NO: 21033 - DNA, 7916 bp, Oryza sativa
gttgcaaacaaaaactcaaaatcccttatattgtgggacggagggagtattgattatcgcactacactttccaagctgctgaacaatacgatttttttttcaagaaattatatatagattgcctagaatttttttttaataaaagccacattttaactttataatagttaattcattcgtttgtacgtcgagtatctcaagaatagtcagataatataccatctgttcatttaattattcggaacaataaaactgggttgtactacatgtttatgactttattatagtttatttgttagttaatctcctgtcacttcgatggattagttagagctggagccaatgggagaagatcacatatatttgttagtagttgagaaggttcaatggatagttcacctaattgaaatcgacactgcaatactgaatatgttcatgattaaattagataattgctgtcgcctagctaggtgttgtgtcgatcgatcgacagagaagcatatgtggattaggtttttcagcttttgaaaagcacccgactgtctccatcccagaaacgggagagagcagaggttggatttgatataaaaaccctgaaaaggctgtgtaacaaacaccacaaacatgtataatttatgagggtttattgcttgactaattgttagtttgttcatcggtctttccatgttgggtagatgtgcctggctgctcggtttttataggccgcccttcacctgctcatggatgccacaaacagatcgaccacacatttcatttcatatcacactttgcaacttgcttaattggttactgtttgtgcttagtataattaatcagccaactaattaatgatgtccacgtatgtgtaaagtaatattcctacaatgcgtgtaactagttgttgctttttttttacaattaaaatatataggaggataacttcttatatccatttgagatgcaagtatgaattaatatatgttttgtttttgaaaatagaaatgatttagttccagcctatagtctcttatcgtctatttgttttcttatcatccgcgtctaaaatataatcttagagttgaatttgcaaaactatcattcgagtggcatccttttaaaattagaaaaaaccagtgacaaatttacaaacgtccaatatttatttttacttttatatcgtggattgcacgaatatataatagttttaccatatataactccaactccactccaaagtcttcaactaactgtgcttctggatgattagctgctgattttggcatgacggtggcaaagcatcagacattccgacaagctaagagcaaggctaataagacaaccagttatttagttgtttactgtatagatctttatggtctatatctcagcttacttataaagtggttagctcttcactatagatatatagtccacctgtctgtctcatagatttttttagttttttttgcctaagtcggctgtaagcttacagtcccgtttctcatctctctctctcctttcctctctcatctatctcagcattcagtcttcttatagcgctctattatacttactctaaatagctcgtgcatgattagtagatttaattctaatgtaattaattaactggatatatgcaggctgagaacctgaggcagcagacgctgcaccggctgcagcaggtgctgacgacgaggcagatggcgcggtcgctgctcgccgtctccgactacttccaccgcctccgcaccctcagctccctctgggtcacccgccccaggcacccgcctcacgaccaccagccgccgccgcactccgccgccccccacacctgagatcaccgccgccggcaacgcatgcaaacaccgtagctcttagctagcagcttagagatatcgagagatcagaaattaagcgatcgatcgagagaggacgacgactgtgaaaccccccatggaatggatggatggatggatggatgaaccgatgtgtactgtgtttgggcattaaccctttgatgtaaacaaagtaggcgtgtttgactgcttggtcgatcgatcgagatctctgtcgataggatcttgaattagcggatcttacctcagcagctggttcatcaagtgttgatgcagctcaatcaaactttttcctgatgaaaacgcaacctgcagtcgttgttaattcgtttaatctgtaggagtgtgcatgctccctcgatcaaaccgcgtttgcaacgtgaggtttttcaagattaattttcgtttttgaaaccttcgatccgacgaatatccagcagtcgggggcattttgaaatggatgatttgaaccgattataaaagtatataacatattttggttagaataagttatctaaacaattaggatctcattgcttggtgcttgcttataagctaaaatttgcattttagaatttaattttgaatttttttttgttttttcaccctagtttactttagtgtatttgcttttgagtcgataaggatatgtatataaaacttttactgacaaatggatcttttatttgctaataagtgattcaaataagcaaatgaataaatgaaacaatgatgttgttaatgctaatgtaaaaggttcttgaataaattgtattttttttgaaacacgacacaaattatccgcatataactcatgggccataagctgaaaagaatgcaagaaacattgattttttttttgttctgaattatgtgaagctcataagaaaaataatgtgaaattcaagtgtgcgtttgaaattgggccttaatctaaattttctgggccgattatgatcgatatattactggcccaattttttagcccattaacgatctgttggtaccagctgacatggccctaccatatattggggccaaaaacataggcctatcagcagggcccaaatatattgctatgttgtctactagtgggcccaaagcatatgggccgaacccaaccattatctgtcccaaattagaaagtcatttcgtgatattagcataccaaacggagtaagcaaatatccccgttgaggaagcatccggagcaaaagcaacgacgaccagaaaaatatctcctccgctttttgcgcttttttttttctctttccaccccgatggccggcggcgagccgccggcgccggcgacggaggcggaggaggggcggagggcggcgctgctgcgggagataaccgaggagggcgggttcgcgttcgtggcgtcggcggagaaggcggcgtgcggcgacctccgcgccgcggaggcggcgcgggagatggcgtgggagcagctccactcggggccgtggagcgaggtgggcgccgcgtggagggacgcctacgcgctcgcctgcctccacgtcgcgcggctccggcggctgggggcggccgccgccgaccgccgcgccgcgctcagggcgctcgacatgggcctcatcatgggggggaacctcctccgcgccgacctcgaggccgccatagcgcgcatcgtcgccgaccccggcggcggcggcgacgcggaggccgtcgacgaggagacccggaggtggagggaagggctcgagaggaatcgagacgtcgccgatgtgagatcgctgttgcctttgtaggattccgtgtttgttttgcgcgcttttctgcggcaatgcgggttccaacttagcttaattttttaggagctcattgcagtatgcgtaattaactatggctgcaactatataatttcatatatagttagatccggctaaggaacaaactggtggcgaaaaactgttaggggtgaactgccgtatatcaactcataaattgtaggaatatctttttttctggaatgatcagtgaagatttgtagattactccttatggtttgtaccgttcattctagttaccacttcgcttactcattttctgaatttgttgtatggataagggcattcataatcattaccttctgctcatcttgtattactactgacagtactttttccaggcacttaatattcttccggcaaagtctttatcttgtaagaaggttgagaggcgatcatgcatttctttggaggaatttatatgtgattactttttacgcgagtcccctgttataatcagtggaagcatcgatcattggcctgcaaggacaaagtggaaagacatccaatacctgaagaagattgctggagatcgaactgttcctgttgaagtaaatgccttttgctctttacactagatctggaagactattatatggaaacaagccatttctgtttagttaactttgtttaaactattcgatgcttatagtttttatagtgcattaatgatcatagtaacaaattcgagcgccaatattatgcccttttcaattgaagtaaaataaacaagtgcatctaaatttggtgctaagttttattacttatttgtaacaaacaacctatatacatcaaaatatgatatttagtgaacttggccagctgtctgcaagtaacattaagttacagtagattatttttgtatcttgtatttgtctctgactcaacttgcttgtacaaaggtgcaattttgagaaatgtgttacaatgtattcttccggttgcaagttggaacactaatcttttgccttggtgatcagaacagtaggtagattgaacctattttaagctgttccgttcatatttgttggtttcagtttgatgccatattgccatggtatttggttcagtattttaacttactcatattatgttcaatgctctttctgtatgaacttattttgccgaaagatttggtttatatgattgtgtgattgtttaacatgtacagctagattaactctacggcgctcttgcatgaacaatcttttcatacatagattattattattattcacaagacttctatgtgatggaacattttcctgaaatttgatcacagtagaatagttgtgtcgtaacatatttacccattaatttagtgtctcaaaaatgctatttattcaactgaattacatggctaatccaattagtatgcagcatttattctcccgtagttacctttttcatgcatcgagtaattatgcttgctcgaagacattttatgatgaaagttcctcctgtattgacctacctctgaatacttatatagcactaatgtaattgaatatctgtcaggttggaaaaaattatgtgtgcagtgagtggaagcaggagctaatcactttctctcagttccttgagaggatgtggtcagctggctgtccttcaaacttgacatatctggctcagcatcccttgtttgaacaggtaaccatgctatcattgtggattctctagtaagtataagcccaattgtcagttttttttttgtgccatttgcagataaaagagctccatgaagatataatggttcctgactactgttatgctggtggaggggagcttcagtcacttaatgcatggtttggtccacacgggacagtgacaccattgcaccatgatccacatcacaacattttagctcaggtatagtgtgagtactccttttcatattttttccccgtttggatctgttgtcaataattttttctagagtaaatactcttttttctatgagcaagttcaactgttcacactgtttatgctatcatgttactcatcacgttatgattaggtgctgattgacatgtcatctatgtaatgtctaaatgcataaatctactcagaattccgtagtcagctaccaggtagatataattgaaacagttcttcaaacttggcaacaatgataatctgataagtttaattgattgaaataattgaaacggttcttcaaaattggcaacaatgatcatctgataagtttaattgattggagcagtcaagaaaaagctaatattagcgaatcaatctttgtaaatgaaactttgcggtgcaaaggattcgagtgtccaaacattcaaatccatctgatactccttttccaaaaaaaaatagcgatctgatacatatttaagagtttagctgacaaattcaaatgcctttctgcacatcattaatccattgatggtggacggctgacccatttgagatgtttgcatagtactatcatagttcataactatcagtactcagcagtttctttgggtaacttttatcaacagttattggttaataatatctttgctttctccttgataggtattgggaaggaagtatattagactatatcctgcttccatatctgaggacttgtacccacacacagaaactatgctaagtaacaccagtcaggtacataactccgttcgattggttacatatttggaaaaaatatatatttgcaggtcatcaccatttaatatatatggatcgtgagccaaagatttgcattcttgggccattcaattgggcagtttggcggaaattttggatgtgacccgaaatgagacaagcgattagcgcatgattgactgagtattaattattacaaacttaaaaaatggatttgtttgatttttctaaagaaacttttatataaaaaacttttgcacgaaacacaccgtttagcagtttggatgcgtgctaacggaaaatgagtaagttgccaatgagttgctgaaaagaactcagcgttagtatcctcttcttgattactcttaagcatgaaattgcaagctggatctacttatcagagcattttaaagagctaaattaggaaacaataaatatgcttgacttccattttctaggtcaaccttttcagttacctgctagtcataaccatttctcagattatttggttaaaagcattatgtccaattctgttgtgtgcgatgtgaggatacagagtgttctagccccatgataattttagcactgcctatagtttctcctaactgcccatttatcaacacagctcaaatgtttgtgcaggtagatcttgacaacgttgatctgaaggagttcccacgggtagaaaatcttgatttcttggactgtatattggaggagggtgacttgctttacattccaccaaaatggtggcattacgtcagatctctttctattagtttctctgttagcttttggtggcgttcaactgttgtaccttcaaagggttcatagcgtcacattctggtctttgtacagcagaaccggaccacgggaccttggaaaacctgacagaaccttttgatttagcatccactattgcatggatgtggccatactattgcagatgtacattgttacttcccctgttatgactaaacatgtagttgctactataccaaatgtaacaatgacgatgtaccttctggtaacctctgatcttgaccattgagcttggagggttggatttattgctcctgcaaaattcatgttcaattcctgtgggcttattacaacccatttgcaaaggggtcccattttcccaacaattatcaagtaaggttattttcagtgtttctctacatgaggtgatcaatgctgttttaaacagaagggggtcacatccctgtcctctgcatcatgtatacacaccggcaatgccatcgatgctattatgcataaattgagcgtacaatgtatgtctgccagtgagtacatttccccccttttttgtggtcttggggtatggctgtctaggggtgggtattcggtctaaccgaaaatttcggtctcggtcttcggtcttttcggtctttgaaaagtgaagaccgaatttcagtaaaaaatgtcaggaccgacaaattcggtctcggtctcggtctcagtcctgaccgaaattcaacaatattttcatatatgcaaagaaacaatagaaattttcaacacaaaaatcaaaaaaaaattcgtaagcacttctgagtaaagactcttaataggttgcatgcctagaaga

SEQ ID NO: 21034 - DNA, 1303 bp, Oryza sativa
gatgccaaaatgtgccctatcaaattgttggcattttaaatagtagtttggctagtgtttggtttgctaacaaaatgtgcctataaggtacataagttgccaaaacatttggcactatcaaattttgcctatgatttggcattgccaatattttggcatggtagcaaaaccaaaccagcccctagtacacttatcttactgtttccaactcccaagaacgacactgactgggcatccattctcttgagacgcacaaatggagtactgtactcctactacagttgcaaagaaagaggaagaaaagatgaacaagaaaaaaacaatataatagggcccattagtaacagtagcctcaaagcctgccctgccatgcgtaatagcttaaccacagtggacagtaggactgtcaagacagccattagcattaattcttttggcaccttgtctttcggcagcatcctgatatctctgtccctgaaccactgcacacatgtggccctgtttagaagagtttttgacagctacaactcttcctaaatctctctactctttcgaagagtctggttttgattcagatactaaaggttataaactaaaaggaagaggctaaaaaaaattattttggtattcttactagttgcttatcaaaatcttcagctacttaaacatgatctataatgtctgtgaggaattttaggtttcgagaaggagaatcaggagaagcaagggaaaaaaaactaacttcttgtttttagtttattttttatcccataactacaacttgttaaaatctagagtgacaaattaaaccatttaagtgagcttttaatttaaaagaaacaacaaccgttagaagctctcgtgcagatcctcctaggccaccattgtttggccgaatacggataatacaccatacgacgtattaacaaaataataataatttatagataaaactgtcatatatgtgttcttaacgacttaaatactaatgataaaaaataaaatttgatgaaaaaaaaaatcaaaaatcaactttaaattttaacttctaaattcaaaatttaacaacaaatgctgaatgggggaaacaatgggagtctctctctctctggaccaggcggcgaaaggcgccgcggaaaagaagctgcaccaaccaaacacacctctttgcgttgcaattgcaaatgcacctgacctgcatctgcaattgcatggccaccgaccgggtcgtgcagtggtgccaccgccgctgatcttgtccgcctctcacagaatgcagttatatctgtctcctggacctgct

SEQ ID NO: 21035 - DNA, 11163 bp, Oryza sativa
gacactatagaatactcaagcttcggtcgactagtccattaaaagagaaccgtatagatccgaatgttgaaacaagtttggtcggtagacagaagcaacgtatatccaccaatggagactttaaaaggactagacggcaaagccagcaagactcaaggaacagagctacaaagagatggatgtagagtttagactgcagttattaccaattacaggtacactgaatacatgactaaattcagttccacagcttttgttaaatttattctactatcaaatatgtgactttattcagtgcacctttcttccatgtatattctttttctttgtactgtgtacttttgtcttcctcttccatcatctttgctgttgctagtcctcagaaccgtagccaatattagtgcaatactccctccgtcccaaaaaaaaaagacaaaccctggacatgttcagattcatagccagggtttgcctttttttaggatggagggagtacatctctaggtgataggctgacagcctttgccagatcagcagatacagcaaattgatattctatatttcattttgatttgtgtattaactgtaattcagtattctgttaccagatacactgtagatatctgtttattctctagatctttatttctttttgttagttgtttctttattactgaaagacttttggacgttaaattacatctgagaacacatcggctgcaacttttcagtttgtccgctttttagggatcaaatacagtcagcttctttgatactatatatccatagtatttcttttaagatgcacatcgtgtaaaacgtcagttaacttcatgtccccttttctttaaccgggtgcagcagctctttttttttcttttaaaaacttggttgatacgctgaccaatccattgtttcggcatttcagagcaggaagagacgaaattggtagcttcatcctggctcctgctgtttctgtaaacaaaaaatatcgatgcaagttgctacatactttatttatgtctatgatgaaaccgaccaattcaagctgttcatcttcgtcattggtatctgctccgatgtataatatgccatttggatctgcacagtcagcgtctctctgctcttgaatctatcgctcttttttaattagtggcttaatttatcaaacggaatccagcagttcatacgtgcacatttttcctatattacttgtttaccaggtacacaaaaaattcttcatacgagttgccagatggttagatatatatactcctggattctgtccatcaggagctcctgattctttttcttccagtagtacaacttatgtgcctatgtatttgcaatttgtcgcacaatttgatacctggattgcttgccgctggcgggctctgcatatgccattgcttccaagcttcatcatcgtttatacatatagccattgggttgggaagtccacaggggcaatctgatgaagttgactccatttgggagctctccaatcgcatctaaccaacaaagtcttagcttggaaatttggaacatatgtgatcaataggaaatagtagtcaaatttacaaaggaatcagctctgaatcgattatggattatctggtttttgagataatattcaagggtgtacaaatgaataaattagctaccccaattacgtagaactaattagacatcatatggtacttcgaattatctagatttatagtaccggattaagtgttcaatctagtattaggcttctatattttagaacgtagagtactttaaaattgaaattttgtttcgttaagaaaaaaaaggtattataagaaacttagtttttgcagaactcgcaacgtttaagaagcttgcaagcatacacgtaatagtttgcaagcattactcttaaatcggtaagaggaaaagaacaggagtcaaaatcaactcgtgaccataaaaaaacggagtaatcaaaacacgccctgcactgtacgaacaacctgaacaagtgaacaggaattcaccgaatcgcattcaattcggaggtggacacatcaaatccaaaggccagataatccaacgaggcggccgccgatcccatcaatccatcaaaattccaactgtactccatctaaaagtttaaattataagagtactgtatttcttttattactaaaagtagaaaggaattcactcgtggatcatatgaaaaaaccaagaaactaataatatacatacatgtaaccaataagtattaaaataatttcttaagttatgatcaataatttaatctaattatctagaacatagatgttgtaaatatattaatctcatttgaaaaaaactaaaaaaataaaatatgcacgaagtgagcgtaacttaactgtggtggtggaatcagcctacccaggtagcaagacgtctgtggtaatagggctattgtatacgtgttgtgtgagactgcgtttatactatgtatttttaaaaatagaaaaaaaattgaaatatgcagtgacattttggatagagagagtactatgcaatacccccctctccctctgacatgtgggccacgcagcaacggatcgagcggccctcgcgcgcgcgagaggtgagaaacgaaacgaaacgtgacgcggcgcgattggtcgtcgtcgtcaaccacctcgacggcgacttgcccccttctcctctcctcttctttaacccctcccccctctcgccgcgcgcgccgccgcggccgcgcggggcgcaaagtctgcgaggagcacgaggccgcgcagagtattctagagaaagtcgccgccccacttggcccacgcgatcgttgcagaggttgatcactcgaggtcgagggcgatcgatgatggagcaggaggacgcgaggaggaagatggcggcggcggcgggggagcgggggcaggtggtggtgctggagtgcgtggcggggagctccaaggcggaggagtggggcggcggcggaggggtggtgcaggaaggggacgtggtggaggcggtccgggtggggcgcggcggcggccccggccccggcgccgcggtgctggaggcgccgttcaagggggggcgcgccgcgctgcacaaggcgatgcacgccgcgttcaagcgcggggacacctccgtcgaggtgcgcgtccgcggaggcagcgagctgcaggcctgcatcctccctcactccggcggcggcggcggcggcggaggcggtggcggaggcggaggaggaggcggcggcggaggtgggaataagcagtacgtgctgcgttccctgcacgaccccaactacgttcttggcttcgtcgaccgcctcgaaagcgagtgcctcttgttgcaaggtaaactacttcgctcactgctcatcgctctgaaatctgaatagttcatccgttttgccgcgcattttgcaattttgctgttccagacgaattcaaccaaaaaatatattactgtttcaagttgattcaagtatagaaatgttctgccgcttcagctcatccttggtgttatgaactgaacctttttgctgatcaaatcgatttcagagaagttcggtgtgttcatttcattacgagaattttttcttgtgtgtgttcattcaatgtgttggtaaaatataaacaagagtgaaacgaacgaaacaggagtatcaacaagacagatgcggcatttaatcttgttttcattttgtgcctttcttggcctctacatgtgtttttacacctgttgtgaaaaagacaagtttgctgtcaactctttgaggttcaaaacccccaccaagaatattctgataagctgatctttcagcgcgttgttgcaggcctaatttccttgcataagtgtgtgtctttctctcacggagagaaaactaatctgcctgtagttatcaatgataagaacgatagctacatgacaaaagataatggaagcaaagtggaaagaaaatagtgataaagtatgggagaatatggaagacgtttcggaaacaatgtcaggccaattgctttggtagagattggtcgtttgtctagatggtgatcaatttctagatacctcgtaatgttcactcgttttctcaattctcatatccccggggaagatggaatttctatggtggactagactttgtagtcgttataaacagtcatcgtttgtggcctcctgattagttggttcattactgttgggacataactaccgcactcttatctgattaggctggtctggacatatatggcttttgatctacctggctagaagttataactgttagtgccctggtgcaacttttctttgtcaagcatgtgcgttttcctgtagaattcagcgcttctgaacaactggtagatgcttccatccctgactttaagttttaagtaagaaacagataatctatttcgttgtgaacttttgggtaatgaaacatataatctcttttgttgtggttttttggattatctttctatggaaagtatgtgactttcccttgattcatgaaggcactaggagcacaagagtggcatcagccctgagcagggcacaacttcaggatggttatgttgcatacccatgggagaagaagatgcgtgactcgttgcgcatgcccaactccagcagctacctctcgatgctcgtcctccccaaagctctggacctgaattcatgtcgatacgagtcctttgaggacacccttgcccgtgccaacgcgtggatctactcctcgcaggtctcaggaatccccatcgagttcatgaatgtgcagagtgaggctcttctcaccaaggtgcagatacaatctccctgcttcaggctttttgcagcctaaatttcctgttgcttaactgaaccttcagtagattgaacctgagtatgaacataaaaccccagataagagttgatttggttaactctacttattaagatgtgatctttgcacttcaaaatgtacagatatctggagagacagcgtctgcaactgttaactcaggttctttgtctgatctgtctaacgtcacgaatgcgaccctgtatggttttgaggattaccatggggtagatattggggtggtgaaagcagcccgactttggtacagctccatagcagaagagatgccgctggagattccacttgaagaaggtgacacgaggctaggattcgccatcagccgtactgaagaggtactttgtcacttgacactgtacacaatgccgacaatagtgtacctgaacaattagaactacacatggaacacactgtgacacatttctttctggcagggttttatcttcatatcttcagtggttgacaatgacaaggacaatgaggcgccatcgacacggtcagggctccgcgatctgttcaaccaggcaagggaggcatcaaaactgctagttatctcaagggtgtccaatgagaaggtccttccctggatgatctccagctcaggagcgatccgctgcttcgacaccatctccctcagccaaaagctttccttgcaccgccttgcggtgcgccccatccagctccacctgctcatgtgggagaaacctagtggtcctgtagaaaggatcattcgctctccgaaacttcccccacaatctgagctacctcaagtaccctggaatctaattgagagcattgaacctagagtagatgttgatgaggactatgtgggggatttgtcatttcggattgatgatctttcagtgggaaccagctgggtgtgatcctttcatgctgcaagcttctaatgtgcatatgtatgtcttcatttacatagttctcttgggcagtatgctcagttttgttccatttaagtgtagaagcctggctagaaatgtccagagccttactaggtttctggatataccaagggcgaggctttcataacatctgaaacattatgttgtgatgcaatgtttttgttgatcatagcataccattggaggaatacataagcatttcaataattatctaaggattatcccaattatgggcctgttaagttactcccaaacatattgttcaacactgacatttctgtactttgtactgaacataaagtttgttacacttaaaccacacaagctattggtcaatgagagctaagccatgaatctcaattatgctacttatcaagttgtgagcactctacacttgagcactcgatattggacatagaaccccggcattaccatgatctttacctgacaaggattgtgcagctgctgcttgtcaggtaggatgtcctccatgtacatctgatcgaatacgcggctctcttcgacccgcatgatcgtcagcgcgggggtgaaggagaaggccaggaggtggagcagccagacgcacttggcagcgacgaagaagcactgcagcagctgctccggccatggccgggaccaattcttcagggtggacacaatgcagctcatcttctggtcgcagaaccggctgaagtcctcgctgtagtacttggtgcccttcctgagcacctcgttccagctcaggttgcgcagtgcgacgaaggaggcgaagctctcctgggatccttgcttgggatcgaggcaccgtggcgagccgttcttctggaacgtgcagttctcgaagtcctggtacattgcctggttcatcagagcttccagatggtacagcaccagctggagcaatgcttgttgtcagtgatcatgagctggtaaggttggagaagaatgtttagtttttctatcaaaccattgtcaggttcttcgacctgctggatcaatgccttgcagaattgcttcaccgaaagccgcgcctcggaggcgatctgcaagaagccttccaccatggcttcatggctgaccggccccgggagctcctggcttgctccgatcgatcgcgttgatctcctcgacatggaggatgatgatggttgagcgttgctggttgagctcgtcgctagtcgcagtgccttcttgagctccgagcagtaggcctcgaggccggcgagcttggtggtgagctctcccagggacgacctcatctcggcggcttcctgcagcgcggcgtcgcggtgcgcgttcgcgtcggcgagctctcgccggagcgagtcgagcgacagcaacccccactccttgagcagctgcgacatgttctcccgctcgatggcgctcggcgacatcggcttcgccttcttcttcgccctcgggaagagccacgagaggatctgcgcccttctgtgcttcgccggccggggctgcgccgccgccgccgccgccgagagcggcgcgccgctgctggcgaggaacttgagggccccgacgtcgatgccgtggtcccggccgatcgtcgccggccggaacgcgctgccgcacgtcgacggcgccttgagcagctccgccgtgccggccatggtcgccctccccgccgacgcgaggaaacggtcggccgacggcgcggagtgcaagaacgccgggtggaccttgtgccgccggtgatggtcggtggacgacgggaagcggagctcgctgttcgaggacgagaaggcgttgaggttgtcgtagtcggagaaggccgcgtcgtcgtcgtcgtcgccgctgccgccgccgcccaacgcgatgccgctccagttctccgaccggctccggttgtcctggcaaatgtggctgagtccggccatttgctcctcatcgtaagcctgaccaatttaacaagaaattcaagccaaaaattagccaaaaaaatcttgcaaaagaacagaacaaattcagggacagtgagattgaaaaaaaaaagtgaagaaatccaaacagaatggcacattgcaacccacatttctgcaatctgcatggagttgctactgaaagtttccaatttttaccatttaccaaggcaaagtacaggttgctgctataggttaaagcacagcaagagattactccacagatgtgtcatcaagcttctttcagaaaaaggtgagaatgtgacatcaaaagaatctgagataacgcaacttttactgttgcttaactgcattacatgtcctattaattgcagagtaatagtaggagcatctgggattagctgtcaagaagaggaagaacatgctagcagcaagaagagcatgcaagttaaggagaactaatgaatggctcaagttcatcaccaacgaatgacccttgaaaacgagaagagatgaaccaagaaggcacatcgccatggcagcatcaaagatagcagtgacagggtgactgtacgcaagaaaagctcgctcaccggagtaaacaccgggtagtcctcgtcgacggtggccaccgccgccgccgccgcccccgccctggagagcgcgggggacgcggccggcgggaggcggatgatggccgggctgcggctggcgctggcgccgccgcctacgccgccgccgccgcgctgcagcagcgcggcgtggagcgcccgcagctcgaccgccttggcgatggcggcctgcacgtcctgccgcgtcgcctgcaccggcggcgtcgacgtcgccgccgccgtgccgaacgcctcggctgcggcggccgccatggccatgtcaggcgagtcaaaggctgcttcgccttcgcttgccccaaggattcttggaacgcagagcgaggcaagcgagcacgggtgaggagaagcaatggagggggaaatgaacagtagattcttgagagagagagagtggttgttgcagaggagagtgacagattgagagagagattgaggaggtggagggaactgcacatttgaagagatttgccagtgcttgctgcaagcaaggccctcttttcttttgagcttttttttggctttcttttcttttcttttctttttgcttttagctgcattatgtagattcgctgctgctttgtgtatactttgcttgattggtaggagtaccacctcaaattcgggcctcctttgccaaaaatcttgtaaaggtgtattacatgctaccgaccaatgttaaagaaacagccgacaagttggtgattaaggttacgtttttttctgtttattcatcggcttcttgggacaaagattatcagaatctcgatccatatgctagtaccttacaatactactacgattctaccaaatcaaagcggtaccgatccacctagtatttgcattatgctttaaaaaaaatgttttctcgaaaactttcttctactgcagtgctgagtagtgaaatacacttgaaatagagttttatatttgcacaaatttccctccgaaatttttctacacatacaaacttctaacttttccatcacatcgttttaatttcaaccaaacttttaattttgaccgtgaactaaacacacctctatatctgcacaaatttcgagccattgtcactatttttcacctgtttatggctggtagttggaggtaggtcaaaaatctcaatgccaacactacctctatctgcaacaacccggccattaatggacatctctgttgcgatgccctgcaggctttcttgcttgcttgcttgccccgcggtggcggatttgctgtccaaccgaggcggcgacggcgcattaaattcccggccgtcgctctcctctccggcggcggcggccaccgcgatcgccgccggtgacacacgctgccgtgtcaggctaagctcgtgacaacattctggttggagctcggactgaacattttcttttctttttttatggttagctcagacacgagacagacattctgcttagctcagctagctatcacgcgcgacgcggacggaatactgataagcttttttttatcttttgaaagataaactattaaaaggttggacctttcgtcaggaatgcaacctggctttaactaccatttctaaaaagaatgaagcgtataagatgcagttgttgttgttattggtatttttttgggtagatgcagttgttgctgatgatccatttcctcaaaacttaaaatgtactctgaaatctctccatgtcagtataccataaagaattttacaaacattaaggtactatttttcttagtgtaaaatttagtatctttacataccttcttaagcgaatatacaacaaccagacaaatttgctaacatgatatagatgagagtagagagaaatgttgttataagattaatatgggcttaacaatgatttttattgtttataaaagaaaattgtgctgtgtaagagtagggaagaggaaagaatgtaataaaaaaatccgtatactaatagttagagcatttgttatctcaatcgttatatgatgataatctctaactgagttgtgctttaagagccacatcaggttctacatttgatcatgccctaatgggctgtgtacatccttttttgggtgtagaggccggtttaatccattatctaaaaaatttgatcatgccctaatggctttaaaaatcatagtatcctctggaacttatgaactgctgaagcagagacagagatttagatgttcctttttccttgattgtttttttaaggggaggatctcaaggagtctgtcattcttcgcattgttttgagcttagtgcaggattggtcaaaagttagctgtaaaaaggtttacaagatccaagttatacacctatcttgaatcttaaattaaaccctcagggaagtgtcaagcagagagcatactagatgtaaagctcaaggtcctagctgtacatatgtccaatccaaaaggcccaagaatcttatgccaggactcaagatatgttaagggggtaggttgatcattcttaactttatccatggaaatttctcaacaagtgatctgtgaaaggttttttgcaagagacaacacaaccaacaaaaaggtgatctatccattccttttctcctctttacacctttactgaattttcctttgtatcggagtgcttttccaatggcatctagctagatggatctttgcacattgagctcaccatggccatgcatacatgcatggaaggaacaagattggacgtctcattgtcaagttaaccacaggggctgcgtgctactaaagcctaaaaaggcactaaaccaaacactttgagcgtatcttatcttaaccttttacaaccccattgattgagtaagagctgattataaacttatcaacataataaaattatttgtgagtaaacc

SEQ ID NO: 21036 - DNA, 10595 bp, Oryza sativa
gttgtccatcagaagctgatactctccactcatatttgtcgaaaccatcgatcgttagcgtattttcggcaataattaattggctagctcattgcaacgtggaaactgtaaagtaccaatgcagtaactgttgcactgaaatataagggatatttgatttggatatcatagaggtggaggttcagatgtgcacttcagagaccgactgatgtatatatgcaactacggaattacttttttttttaagagaagggttttttttttacccggtctttatatccaaccggatatatgcagtatttttttagcatttttttaaaatatgaacttagcctatagaacagggaactagccctcaaataacccaatctaaaattcgctcctatggagatttgaactcaggaccttagggtgctactcaggtcactgcaaccactaggctacatgcactttcacactacgaaattacttaagggttaaggcaccactaggctacatgcactttcacactacgaaattacttaagggttaaggctgtgtttgttccaagtacaagcatgagaaaaacccgtcgtttttaacacgtgtgttgagttgtgatttgaattcatttacacataataaaagacagcttctgccggagcaaagcggaggcccgtagatgcccgatgtgttctttacaaaaaaaatcctatataaaaattgttttaaaaatcatattgattatttttaaatttaaaataattcatactaagttattaatcatatgttaattatccacctcattttacctatcttaatcttcttctttcccctccgttcaaactaatctatctaaaatatatcgaatgttgtataactacacactacatgcaaaggaccacaaattgcatttctgttcaacatactacgtttttttccctaaaaaagagaaggggaccaaattgttttgcttttagagcctgctggttttgtaagttgcattaatcctgatttttggagttcattttataattgttgcatgtttttttagtcgttttcatcgctcggtcttgacttttggatcactattaacgaccaaatttggcaatatcagcatcggaaaaggagattagatcaaggtggagtcgaaggcgaagattgatccgagaatagagcaagaatcggctgaagtccagatcggctacgattaagatcggctgggtctaagtcggactaagtgagccgatgtagccgattctaacagtataatttggtgtttgacattgggttgaattgaggtgcttcaagatgattgccgcacatggatagagtcttgagaaggcaattgtatctattaattaggatgtctatgtaacttccttagagatatgtttgggcaaaagtctgccgcaaagacttatggtatcttagagtttgttagagatagtggtcgtgtccggtatggacatatcttataattctcgggtataaatagaccccgagccctatgtaattttgaacacacacgttcaatacaatctcggcgcatcgccacctttttgctttggttttgtttcgacgagttcttgctttcgggttgagctgcatcggtttcgatcttcaacaagaggtaaaacttgttatgacgacttgtgttctcgtgattagcgctccatctttatgacactctaatcttgtctatataattcgtcaagtcatcatatatcttacataatccttggcaatatcgtcatctaatctataatcggctaacatctgttaatagaaggcagccgattaggttaaatagcgacgttgtcctagatcatataagatatctaccactttatgaaacgcccaacggcttgattgtctaaatattgttcttcttttcatacttaatgctgcatcagttgagtttgatctattaagtcgtgcttagaatatcaatctctagcctgttctctggttgccgattagggtagtatcggagtttcagccgatcttatctgatttaaccatattcgatctatatgcttcaatgacatgttaaatccgccctttatgtcaggatcttattgcatttaagtatattaagcttttgtttggtatattatatttgttttgatatctttatataaagtagtatcggagtattagccgatacatgctagatctatctgatcggctatgctataaacatatataatcctgttattaatatatatttcgatctaagtgatttatactgtctcggcatggtgaccgatccatcccaatcacttgatttaagtatatattaatataagaactatatatcgttaatatctacagccgatcgaatagatttagctccttactatctatttataaccgccgatcgattcatatatgacatcggcttaaagataaatgatatgccatcagcacctagccgatcggctatcatttatagatttaaccacgaattctttgtctctatttcttgttgattacaggatcaaatcaactggcacgctcgtacatttgaaggcgagctttggacctacactggagttaagcagatctcccaggcctcatgttttctgtcaacaatcacctataatataagtgtactagtactaacccaaaattaatttttattgcatcgatcatgtatcttccgtgtataagcaatggtcatgaggaattcctatcaaatgggcctaatttctcccttccaaaagtcaactcaagtacagaatattttttgaatagctaagtactactacatcacttatatttaatgaatcacttatattaatttgatggtctctaccatgattatattcctttgatcattctttaaccttgctctgattgctttgatgccttgacttcagattctaagaacctaaccaaatccagccattgactaatttaggagcaaaacagcataaactctagtgatcaaagatgactagatgaggacctcaaatgacgtataaactctagtgcctggatggttgattttcggcccgaaaccaatgtaatcttccgggtttattgagcccaactacgaaaattctactgccttctttttaaagtatatatgacgctatttttcgtataacatttaaccatttattttatgtaaaaatttaatataaatatataaaagaataagttaaaattatattttatttaaagataaaacaaatcacaacaaaataaatgatgcttattttcttgtaagatgcatgataaaacgttatgtcaaaaaatcaacgataccgcacatttaaaatggaaggagtaatacagtattttctccgcacgagtactatctcgatcctgcctcccagtccctagcattgatccgctcaaccagtctctgttcatcgtcaatgtccttggctagtgctctttcggcgtcgatccgcgcggccagtcaatggcgagcaagagccagcaaacaattcatcttcctcaaggaggtcaagaattccctctttcccctccgattatctccctctgttaccgttcaaacaaccttgcaagcagataggaaaacatgtgtaatggttttacaggggaaaagaaatacaaatttcccaagcaaggctcttagtattaagcagtaaccatgcgctgtcacaccatcctattacctccatcccataattaaaaggattttgtgtgtgtatctcacacatggaccctatgatttttattatttttcagattgaattgccacataagcatcacattaatgacacgtgggataaagactttcaaaggagccacttcaaccaaaaccagagaaaatattataaatctcgtttgcactgattttataagtttgaggatacgttgtatctggttatgtggtctcgggatgcatttcggactcaacaaaaaatgggggacctagtgaacttgttcttattgagtaggaataagttcatctgaggtcccttaattttacgcaaatccgattttcatccttaaaccctaaaaccagatataaccggtccctaaactatcaaaaccggtgtaaatgagatccctcggcggttttgaaggcggttttggctgacgtggcgtctacgtggctggtggctggtttgactaggtctccgtcccacatgatattgacgtggcgcttacgtggcaattatatctaaaaaaataataaaaaccatgggcccacctgtcagctaaaaataataattttaaaatagcgtggcccacgtgggccccacatgtcattccctctcccctctcagctctccctcttcctcatcaagccatctcctcgcgccgcggcaccgcctcacagccggcaggagcatgccgacgaagcggagaagcggcggcggcggcggcggcaggccgcggggtcggtgcctactcccgcgccgccacatcatgttagatgctgcacagcggtgaggaggagaggcggagttcgagctcagtacagcgaggattagtgtacagatcgagctaaacagccaacaggattagtggcaggcaccaacaagcagttgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcacctcgctgatggtcgcgtgcagccgtgcaggtagtgcatccgcttcagctcgtcgtatccgtcgcagtcgccgtcttctccggcgtcggcgcggcgagcgtccgcgtgccgcgacacctcctcgtgcacgcgacgctcgcagcgcgggttcgcggcgaggagccacaagagccacgtcagcgcgggtgctcgtgctcgtcctccccgcgacggaggcgctcctccgacgccacgtcggcgggagaggagggagcggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcctgctcttcccttcgccggacgccgtcgacctcgcttcctggtgccgatacacgcctccgcccgcgcgagccaacccgacgctgctactcctcgatgggacatggaagcatgccaaggagatgcaggccgccagcctcccgtttttgtcctccttcgtctcgtccccgtgtcattgctcgtctactgcgatgtcggcgccggcggggtcgaggtggtggaggatgacgacggtggtggaggcgggttgcggcggagggcgtgcgctgcgccctctctgttgcgcctgagagaggagatggggagagaggaggaagaaggggaggggagtgagattgacatgtggggcccacgtaggccccaccattttttattaattcatgtgtgaaactgacatgtgggtctcacgggtttattatttttcttagatcgaattgccacataagcgccacgtcaaatgaagaacgagtcaaattagccacgtaggcgccatgtcagtcaaaaccaccatccaaaccgctaagggacctcatacgtgctggttttgacagctgagggagtcgttgtatctggtttttcggttggaggatgaaaatcggattcgttgacaagttaagggacctatgataaacttattcctattgagtatgacaagcttaccaccaatcgcattgtcgattccctacagcccactaacctggcccaaggtgatggaggaattgaggcctaactttgccggcccacccaacacatgcctctagttgaacacggcctacaaataatctagcccaaccaaaacgtagatccaagcccagatccacctgcagtacaatgcctgccacaatgtacaaactattgtacaaagcaaacagtcagctacttgtattcctagttggcacattgccgtaggtttttcacctcaactaaaccatcttaaaacaagcaatgcaattcacagtaacaaaataattacacttcaacgcaacatgtcgatagatcaatgaacaatggtcagctcacgctgtgcacgtaaaactccaccgcaaaaccatcaacgagacttctctgacgcagatcgctgaaatgtattccctccgttctattaaaaactactaactactccagtaacatacatctgtacagattcatattactataatgtgttacattttattctagattcgttttttatgaaacggagggattatgtccgtcagtagtatggtttatacgtcagtaagtcagagaatcgctgctacatgttgtagccttggtgacacggttgccacccttgctgccgcctcgtcgccgcggggggagccatcaccagcgccgccgccgccgccaaatccacgcgctcgccgcagcagccgcagcgaacgcactgttcgcccgagacgttggtggattccaccacgggcacgacgcagaagttggacccgcaccgcgcgcacgcgccgcgcacctgcgcggccagcgccgactgcacccggcggcaccgcgcgtcgtcgtggtggcaacccccgcgcgcgcgcagctccacgtactccgcggcgcggcgcaggtgctccgccgcgcgtcggcggcgcgccatggcggccgacacgggcgccagccccagcgcctcgcggatctcatccacggtggcgtcgatgccgtgccggagcggcgtcgcgtccaccccggtccacggcgcccacgacgagccctcgccgcccgcgtcttcgttgccaccgcgccggggcggcgtcgcgtccaccccggacaacggcgtccacgtcgagccctcgccggccgtgtcgccgttgccaccgcgccggggcggcgtcgcgtccgccccggaccacggcgtccacgtcgagccctcgctgcccctgtcgccgttgccaccgcgccggggcggcgccgcgtccactccggaccacggcgtccacgtcgagccctcgccgcccgtgtcgccgttgccaccgccaccgccaccgccaccgccggaatccatcgtcgtgtgatggcgagttgcgtctcacacggagtaaacggagactcacgatggtacatatcgcgccgcgccacgaggtgttcgacacgggaccgaggcgtgtgtccgtgtcggagaaggattctcaaccagaggaaggagaccaagagtcccaagacaggccccgattacctttctcgtaatgttttccagtacgtaccgatttcaaaaaccaatttaagatgaatccgagattaaaataggtcaagtaaaacacatcaattctcccagtttatggagttctacaggtagtggatctcttcgggtgttttgaattcatggacacatcaggctcaacgagaggaaattactggcctaatcagttacgaattccctctccatcctgaaaacctaaatggcaatgttaaggagcacaaaactaggctgcccaatgttccatgtctcttggcatgaaggcgcagtgacggtggggaagaagatgatcaatggtctctacagagaccagttcatggcattggtggagtggctgaaggcgccgctgccggagccatgctcggcttccggccggttggacggggcacctccctgcagtgcgagctcgagctcgccggagaaatggccgtggtggacagagcccggagggacctcgttcagcacaaccccgtgcggtggcggcaggtgcacgttcctggcgccgtcatggccccggctggagctgttccagccggggctcgccgccatgtagttgcttgccatgaccgagggcgacaccgggttgttgccgcctccgaaggcgctggccgttgacgacattggcggggaccggttgtggctgctggtgctttgggtagtatcccatggctgagttgacagaagagagagagcacagctggagtcggtggcgactcccgcgagacatccacctgaggtgagctcaaaggctgggtggtggagcattggtgccccagccgctgagccaccatggctgctgaacgcatggtgatcactgtatcccgcaactgcgctgcggtgaggatggagttcatggcccccttgccactggattgaaccggacatgcgatcgctgggctgaatagcaggccacgcatccctcacactgcttggaacccttgggtatgagaaatctaccacaaagcttctggacctgcctggctcttctgaaacaaaagttgcaggggcaacaagtcaatacactcatctgaagttcagagtaacaggacaaacatgagccacattttaccatgaaaggatgcagcaagccggccatagcgagaagaaagaggtccaggtgtcggcttcctccggcgttcattgtgacctgcaaggcgtctgcggcagctttttttttcttgatcaaattcaggtaattggtggaacctgtgatttgaagtggccaaaatattagtgaattaccacaagcgtagtgacactgcaggatataattgaatacaaggagttttcctaatgaagaatgtcatgctataaaaaatactctacactgacaatgaaaagcaataatcaatttaactcaataaaaaaaaagcacgctgaagagcatttttggtggggctattgcttattgtagtgaccttactttagaaaattgcaagcacatgaaaagtaggagtgccaactctgtaatcaagaatcagctacccctgctgcttatcttaatacggagcgtgcatcagataaataaatcaaaccacatgccatgtgaaaagctgcgtcgatgcaagcataacaacttttttttaatcctagactaatgtgtatttgttctaagtagcaacactaaccaaagacacgcctttcatgattagatacacatacaccacgaccgggaaaataaaaaggttacctaaccatgtggacagagcacctgcaatcattcccatagtactttagcacaaacaaaggctttagttagtacatcaaatagtcaagagatgttttatctacggcagagcagatttataaataacacaacagtcagaaccttctattttccggtaatgcatatgtccacaactccacaagccaccaactatgaaatagtatgcattttttccaaacaaattgttggatgcaatatagcagatgatgttatttcattttgatattttagattatgtagcataagcataagtgtttgtgttctagtatctactatacaaaatgaaaacatataggacaaaattagagtaagtatatgggatttctgatgaaccaaatgagaattattggttagcatgattgaccaacttcgttattgctgggcatgttcaaaggtagaacccatatagtcttttaaataatacatgtttattcagagactatgtccttacaactgttgagatcgacaacaaagactttatttaaacaatgcattcataaaaacaaaattattactattatttccttgttaaaaccctcatgcagaaaagtttccattctatagaggttaagagtcgttgctaagcggttgtttaatcgaagctaccatgtttgcatctccttgcttctctctcatccatgtcagcaaacattcctaattagcaaggttttgtagttactatttcatccgatttgttttccacctcaatttctctgctgccctacttccattttagggcattaaatagtgcatagtagtacagtgtagtaccttactactaccccatatatacttcatatcctaccacattccacatactactagaatagaaaaaaaggagatctagacttactatatgtgtgctcctcagacaagatattctggatggacacttttatgtcccttactattctagtcaggttccacatgtcctaaatttcacattgatcgctactactatcaaacccagcagcagtacactacacacagggcatgaaaatctctcaatctggccagggacaaaacggcaaaatttaatttgcctgaaatccaacgttgctgctacgtttttgcaagttgcagaggttgtttcttttttcttgtcctaaaatcagagcttgctgaggtagccaaatctagtggggagtttttttgaattttggcaggaaccgtttgaaagttgggcgaatcacacggtggattggtgagtgtctgtcacactcacgcgctcacaggtggaacagtagagcagcagaggaagcaggggcaatggctggacgacggcgacgaggaggaggaagaagaagaagattttggttttggtttttggttttttacctgctgcactgttggcagaagcgctgctcgaggccggcgacgacgacgatgggctccttggcgtgcatgtagcacaccttgtggcggcagtagtacggcttgacgccgctcagatccacgccgcaaccctccacctggcacctcggcggcagcggc

SEQ ID NO: 21037 - DNA, 8538 bp, Oryza sativa
gccgccgccacgcccttccccttcttgccgcctccgcccgacgacgtcgacgacgactccaccgccgccgccgacgccgacgccgccgcgtcctgctcgaagtagatcttcttgccgaacttgagcccgtggacatcgtcaccaccacctccacctccgccgccgccgccgctgccgccggtcgccattgcggcaggcggtggtcggtcccttcctcctcctgctagctgcctagcctctctctctctctctctctctcttctttttattgccgctccctcactctctctctctctagctagcgagcgtgcgcgtgtgagtgaaaaggaaggcgagctgagctgagctgaggaggcgacaacagtggtggcacacccctcttttaaaaggagtagtaaaataaaagctcagctgctgctgctgctgcttgtgtgtgtgtgtgagtgtgacgcactagtgcactactactactaccgcttcacactcccagatgctactgctagtactactactccgagtagctaccaccttcaaagctcaaagctgcctactagtggtagtaggaggaggaggaggagtagcggtttaactcgtgtgttgcggggtttctgggggtgaaagtgaaacttgggttggcggctccaccccatatataggcgccacaggccggtgtggaacagcggcgcgcgcatgctctcgtggaaattttgtgccgtgtcgggggctcggccgcggcggtgtcgccgatgggggaatctcgcgtatcgactatactcttacttctaagagcaaggacaatagcagtctataagccagctgtaaacatattttaagaagataaatgaagagagagaaaagcagcgggctacagatttctagtcagctataacacagaatttaagacgcagtgtgtatgacagatgagaccaggtattaattttgtagtatgtaactattgtatgaggcttccatccaatggtccaataaaccaaaaaataagccaaattttgaattttcaaacttaattttgaaatattttcaacgtaattttttttcaacattggcttttaagttacaaagaacacatatataaaagttttacctacaaatttatttttattccctaataagccgttttggcttattagaaaaaaaaagtcaaccgatggaggcatgaatgagctattagattgactatagataaattggagctagtagttggctatactattaaacttgctctaattagtactccctccgtcccgtaatataagagattttaatattttatttacactgtttgatcactcgtcttattaaaaaatttatgcagatataaaaaaagttatacataaaatactttagataataaagtaaattataaaaaataaataataattttaaaatttttaaataaaatagatggttaaaaatattaaaatctgggagggagtactgcggtagaggagacggcagagaacaggagcacggccacggccacggccacgggcgagagcgagtgacaagagcagcagcaagcacagaggccagcagtacgctgtgcatcccgctgccgcgctggacggacgctgggccacagtagctgacgactcacatcgatgtgacgatggagccaacccgctcctgcctccgctcccgctacgtccacaccagcagctgcagctgcagctacattgggcgcgggacgacgaaggtgggggcgcgcgtcgatggcgattggtggtggaacgggcggttccgggctattggggagacgtgcttcatcacaggttggaaggggggaagaaccgaacaagggttgggcgtgtaaaaaaggtggctcttttccggaggtttccactcaggttggttttgattcagtggctgctttttagcgtcctttctttctttttagcacaggtacgaaccataggttattcgaggaagatatgagttgttctatgtactactacatatcagagaaagatctaaacggtatcataattaggtggatttatatcgtttgttgtatatgtttgtcgctattaacgtccggagaaaaatcataattttatatcaactttcaaaaataattattcttagaaaattatcaagaaagtatagaattatgtcaccataaaacaacgtgataatccaaacaatgctagcatataacccattaatcgagagtacttgataaatgtagtgctaggtatacgtggtttgcttcaaagcactagagatgtgttagtggatttgtagaagcatgtttttcctagtgcctacaattacgcacatgtaagtataatttttatggatttacttctgagtcattagcctgtattaagagtgcacacccatgtgtttgtgagtgtggtgtgcatatgtagtgatgtcgctacaccaagatataggtacataaatactttgatctgttggaataagtagcttttagtggcaaactatctgttgggaaagataaagtggcatagtataatttttttctaccgacagacaattgtcttctttttagtgttgtagtgtagtgtgtgtgcgcgcgcataaaacatacacatatagttctagctcatgcatatgtatcttttgtttgatgcatatgttgggttcaattccattatctaagtaaaaaggcttgtatattttgagaaattatttgtaattttaagttgtatgtttgactaaatttcgcataagtgcatatgatatgatcaaattataacaaaattacgcatctaatattgtgggtatatatatttgaggtgatgtggtttacgagagatgaaaaacaacttggatcacagattaattatcaaatgtaaaaaaaagaaattgaggtgacgtggttctataaaataagagagaaaataatttagacaacagattaatcaatagtaaaaataattgagattgtatgaattaacaagcgtgaaataaggtaacagtatttcgtatattggtatctgccatattcttttctttccatatccaaggtactccctccgtctcataatataagggattttgagtttttacttatactgtttgaccactcgtcttattaaaaaaatttaaaattattatttattttttgacttactttattattcaaagtactttaagcataattttttgttttttatatttgcacaattttttttaaataaaatgagtggttaaacaatgcaaataaaaactcaaaatccgggacagagagagtagtactacacagattaaaaaaatggtgttatacaatgtgttactagcaagcatgcatgccttatatatatttttatactagtgtactgtacttaccagtacaaggataagagctgacattttaggatttttgattccttaatcactttaattagcctcagtggtctactggtactaggagtgcctcccttccctcaagctaaaatcatgtggacaaataggggctgcagtgttgttgggagaaatggttgaaattaacgaagcgtagggtttcatgcgtggaggcatggagcatgcacgtgcttgcctgcttaattggtctctagccttccacttttgagttggacaagacggctattgggttttcttttaaccgttggtcctttgcctggggccgagttacgcctttggcgtgttaccattgctgaagaatctttcgtcttgagcccgagtttccactggtggtgaagttttggaattgcctcggaattcattagggatgttaattttcacacatgatactcacgcacacgctctcatctgtcgtctctataaatttagaccgtgttttgtcttggtgggactaaaacttttaagtcactatcacatcagatgtttggaaattaattataaatattaaacatagactattaataaaacccatttataatcttggactaattcgtgagacgaatctattgagcttaattaatccatgattagcctatgtgatactacagtaaacattctctaattatggattaattaggcttaaaaaatttgtctcgtaaattagttttcatttatataattagttttgtaagtagtatatatttaatactctaaattagtgtctaaataaagagactaaagttaagtccctggatccaaacaccaccacagtcgtacgctccgaaggcaaggggacgtataaacaacaaagacatgtgtaaaatgctctaaaacacaatgcaaggacaccactaataacaaaagttggcagttttaatttagttttgtgatgatgtgtatattattaaagttccgatgcaaaccctcttgtcgctacccagatgttccgtttcaggacaacacattctagtaagggtcaaaggttgtacgcattttgatgatggctagttgctttagggctcgttattttaatgtaaaataaatcttaccaacttttatcaacaccaaaatttagttaatttgctacttttgtcaaatattattgtattatgtgaagaagtttctagtaatcactaaatatttgtacagtaggtatggtacagtatttggaatttagttggattgctgccttattaaaatttacaaatgctaaaatttgacatagttgaaaatggtagcaaacggataaacgcccttacctcccacttgattgaaaatggtcgatcccgtcgaccgccagcacagacgacatcacccataaacccacttgactgtgtgttcggcgaccccattcttgttccactggggaatggatttgtgtcgggtcggtttggaagttggaaaacagatgaaaaattgtgtgtggtaaactccgggtacatggacgaagggacgatgatgacagaaaccgaaaagcttttgcatccccacggccgccgcaaggtcgttggctgggccggcaggagcagatcggttagttgacgagggagagcggtagcgaatgcagccgctgcacaggtccgcccgcaattggcctcgcgatggcgcatagctgattgcgcaagatctccccactgcgaacaatctgaaaacgaaacagattctagtgcacaaattatttggcccgaacgacagacagaacgacgcgcgtgcttcggactcgtagggggtgtttagatcaggtgtaaagttttgacgtgttacattgagtattatataaggtgtcgtctgaggtgttcgacactaataaaaaaaattaattacagaatccatcagtaaaccgcgagacgaatttattaagcttaattaatccgttattactaaatgtttactatggcaccacattatcaaatcatgaagcaattaagccgaaaagtttcatctcgcaaattagtcgcaatctatgcgattagttattttttagcctaaatttaatagttcatgtatgtgttcaaacgtttgatgtgacatggtaaacaaggccgaagatgacggacgagggtgagtacgtatacgacagaccaaatatttttggatgacgaaagtaagagtatcaatgtttcaattaggtagagatagaagagttgcggcaggtgggaaaataaggttgagtccatgatataggccattcacttgtgagaatactgtattagtcatagtctgtagtacatattaatggaaacatcatatccagtttcctcacaacaaatatagtgtttgggtttacgtgtgtgtgagtgagacatcctggtggtgggcaaaattaaaatcaatgtaaaaattatctactctctctaaaaaaaactcaaatctctaggatttatttatttttttgatacagaaagattgtggccgtgttaagattcaaaattttttcttcaaacttttaattttttcgtcacatcaaatatttggacacatgcatggaacattaaatgtggacgaaaaaaaaatcaattacatagtttgcatgtaaatcacgagacaaatctttttgagcctaattaattagacttaataaattcatctcgcagtttacaagcggaatctgtaatttgttttattattaatctacgtttaatactttgaatgtgtgttcatataattaaaaaaattgacatacgaaataaacacaacctgtgagagtgagtaaagagcagccaaaagaggaagtatgtgcgagtgagtaaggagcagccagcagtaagctactgaccaaggtttgaagccaggtgctcaccgtctcaaaaataagctcttcctcggaattcttatacatattttaagtttacttgctgctcgtatatagtgtcggggtgtgcattttaatctagtgctcgattttttacacactcattttttttagttattcaatattccgtactaagtttttccgttggtcgttagagttctttctagaacggtgcatagcttagccgatagagagctactagcgtagtcacttacatgggttagaattcatatgagctcaccacctactaaaattaaattctagacaggattagtgttgcttattttttgataaaacaatgcttagggtctgtttgaagtagtttctagttgatacaactcctccaaacaatccctccaaacaatcctttttttttacagattctgagaaactatagttgtagaatccagacaataaactactccctccatccaaaagaaacttaatctagaaagggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagttctggatgtaacacaacaacattttaggacagatgtgtgcacagtacgcccttccgagaacatcacccacgcccttctaaaaaacgcatatgctcctgttacaacagaaaactagcagaactatcgccccgacgtactacacagctacccgactcacgacgactcccaaacagaagccccccactgatcgacttgacggactgactgagggtctgtttagttactaaaaagtttttcctaaaaatatcacattaaatctttgaagatatgtatgaagcattaaatgtagataaaaaaactaattgcataattatgatggaaatcgcgagacgaatcttttgagtctaattagtctataattagccacaagtgctacagtaacttatatatgctaatggcggattaattaggctcaaaagtttcgtctcgcggttttcaggcaagttatgaaattaattttttgattcgtgtccgaaaaacctttccgacatccgatcaaacgtctgatatgacaactaaaaatttttatttcaccaaactaaactggcccagactaatcctatttgcagggacgatcgacatgtcgtgaactcgtgatcctccggtttcccggccgtatacatgctaccgctagcaagcatcaaaactttctctccacagtggtgccatggcaggtgtacgtgcgatccctactttgattggctactcaccgtgacgtcgtctacaccgacgtaatacggcgcgggggagtgcagtgccggggacagcaccatgcacacgaatcttggccgggtcgccggccgtcggcatcggccggatcgcgaagtcgcggctacaggagaacgtgacggatcgccgagagagcgagagcgagtactccactactactcgagacaggccgacgagacgagaggaggaggccgtgggctctcgttggacgctggtgctcccccgaactgttgctgatgctaccggtgacacgtactgtgtgtgagcagctgctgctgctgctgcgtgtgtagctgtgtatgctggcgacggacggggtgagtggctgtgagactggagtatgcctgtgagcagtgtctcccactgtgtgcctgtgactgtgcttgctttgcttcttgcttgttgggccgagaagctgtgacatggctcctgcagtgactgtatccctcacgagtactgtagctctgtgacttcgggttggtttggattttgataggccgagagttttccactgataaatgcaagagttttttttttgtttgatcaggataatcttgtgtaacgtttcacaggctgagaattcagcgtacaacagtagttgccgcgaccacgaacatttaaggacagaccatgtgtgtgagaggtacttttgggatttccatcgtccttcacgttagcctcggcgctcgctttctccaactcacgaacgatgtttacgtgccagatagagataggtctaacacaagtagcactctcttaacccctgttcgtgatgcgtacatccacatgtgtagccagatgatcccactcctcccaatctcaatcgtcgtgctgagcccggcggcgcccacgacgcggacacgtacgccacccaccc

SEQ ID NO: 21038 - DNA, 14619 bp, Oryza sativa
gcgctagctgtcccggctggctggctggttggttgggcttcccatttgcagtgatgctactgcgtgcgtgcgtgcgtgcggccggcccagcggagggcggctggccggggtccccatccactactgcggagtactacggggattggatggcacacggaagtgaaggggttaccggttcggtcgcatttacagttgggctagggggtacgtgcacgtactacgtgtgttgttgtttgtgtacgttttctgggctgcgtgttttcttttcggtctgttactcctgttgggcctgtaccttgtgggaggacggggaacagtaatagtagcagtgacgggagcgagaaggactccgtcgtccatccatcatcatgctcggcctctcctgaacttatgagtttcactgttttttttaatggaaaatcgtttaaagttggttttgtgatgttgagtttggtgccaaaattttgtcaacagggagagaatgtataaggcgataccattattccgatagggcgccatgttttcaaaggacggataccgaacctttgctggatcaccgttggatcacagattaccatggatgagtcgaagcaatcattgaataactgaatctctgggcaaggcggaacggcacaagactagttctcacaatcaacgagatgctttgctatggagatcgatgcctgttgcgtcagggtcggcatacatacaaattaagcactgttcataggatcaaagactttccggctatgccaatctgagagaaagcctacttgactagcgcctcacgctgcaggttcacttgggctagttgcacgccgatgatctgtgacaaacgataggatgagaaggagaggattacctaatctcagtaattgcatactctatgatcaacaaaagaaaaccatccgccacattcttatagcatgctcgaaatccctctaactttggtggatcatactaggatctatttggggagtgtttaggaactacaacaacttctaccagaatctccacgtacttcaaacagttcatattctcgcccatattatgagaatatatagttataaaattttaatctaaaaaatctaacttatttagattttcaccaataagctagcttcctttggtgcgacaaaatgaaaagaaaatattgccaaacatatatggcatcggctcccgacatagtggccatcctcgcaacttggtcgatttctctctgtgtttttttagcgtgaatatggtgctctttactggtagtagaaagtaatctgaaccgttgatcttatttaatcaaagatttggatctacttttactaccaccccagttagcggtagtagaaatatgaaggggcattattgttttaaaaaatatgtgtgaaaagggtataatcgttattttgcattgactaaaccttattcttcttatttttagctttttcgatggtaaattagcgatgccagcggaatggatgaccacgatagacagaagaaaaacgtaaatgacaaagctactccaaatcactgttaaaagttattttaataatgaaccggttcggatcattaacagagagcactacagcaccggagcatatcgatctcaaaggaaaaagggacaacagattgttcaatcggcaacaacgatcctggcgcgaagaagcgagcacggctgctgaagcgcgtggaggccaccatcacggtgctatagtacattgttggtttgctgccctaatgtatgtagtagcttggtcgtgcggtaattagccatatgttgtaatctttgtgtgtcctttttttctttctttgatctgtcgttcctgtacaaaactccatgtccatcgaatgaagtagcccatgtctggacaagcccaatagcctcattgtttgttaatgtctttttgaaagaaaaagcttattgggtctctgaactgttgatctcaggctttttaagctcgcaccagcatgaagcggcttggtgcattggcccaattggtaaaggccactagatcagattgcccaaatgtaacgtttttccatttgctcctcttttttttttctctgaacttactgccgtgtaaatgcctactctatgatctctatcacttatatacctacatgaatgtgaatggtagtatcaagttgtatgcaccgaccagttcaatccaaaagcttaagatgatgaagaaatccgggcaattcactttatattccagcacttctcatgcgaggccgtctcaagcctctagcgtggaatagaagtgggttgcaacttttatttaattatgcattagccatgattctaacttgagtcctttggctctgataccatattgagttgtatgcaccgatcagtttcaacacaaaagcttaaactgataagaaaatgtgggcaattcattttgtattgcaatagatagaaaacaaagtaaacaaacggagaaaggcagtttaagaagtgagatgtggtggtttttcttaagagactaacagaaaatttcggtcaactctcctaattatcaacatatttcttctctctttttgcatggtttccaatactttgattattaatttcttttataatatattatcaacaattacaaaattactagatatgaaaatattttcaaatacgagcataatgatactacattttataatatgtttttagtttaattattagtcaaaatgttcaaatattgactttgtggaaaaccaggatgtttttttagattatattttataatagagagagtactatgcatagacctatggatttacgaaacatcagccctagctgaactttacgatttgtgaactattaatatttgatcaatttaggatgttttggaagtcgtatgaaccgacatttaaaagaaaaccgctagcgaaagctaacttgtaatgtagtcatcgataaaagctcttatgtccatggtacgcacaatttacctattttcactagatctgattaaaacattctctccacaaacaacatcaagaatgatatatctggtagggacttttctcctgtgttagacgacgcaacatgcaacctggagtgaggcgatgcaacatcctgtgaccatggagaaagggatgttacgccctttctcgacctcaacgacggtggtgatgatgggtggttagatttggatttggcacctatatctacagaacgcacgacagggcatagacctcgacgatagtggtgatgatgggtggatggatttggatttagcgtccaaccctccacagcacgcgaaggaggagagaggtgggccatcgaaggcggtgtgagccaaatccttgctaggcaaggacgggtgtgcctggcccctaagatgatatggttgatggcggtttaggtggcggcggtctacaatgtcaaaggtgatggaccaaatgcacgcgtgaggagagcgatgtgctcggctctaccacgatttggcccgccatagagcgatatgatggttcctgttggcaatgttgatgttggcatgacacaccaacactggggaagggtgcttgtggtcgaccctcgtgacggttcaagctgcgatatgacggtggtggcatgtagggggtgcttggcatgcaaagataggcgaaggctagctagcggatgagtgttggtgtatcggtgtcttcacgccaacagtagtggatgctagtggagcaatgtggcagtgtctatagagggtggctaggcgacagctgacaaacaatagcctagctcaaaggacttcttggctagcaatggcaacgagtgccatgatcactctttagagcgttgttgacggacctcactatcttcttagcaggacattcacagtgaaaaaccttgttaaattttcaagtcggacgacatcgtatcctttcgggaggcgttgcataggaagtctcatatctacctcttctgtcaattgagccagcactttttcacagcggtgggttatacaaagaataagtggatcttttttccaatggcgctctctctcgcacctcttcttgcaagtggtgtttggaaggctagtttttcagctttttggaggtttattttttaaaaaactgaagtccggtggaaaaccatctttgactaactgcagttgtggttttcttttgaattaaaaaacacagtcacacagatgccgtgcataacaacgaacatggaagcaaccaatctctcaaggtgaagtcccttcacaaaattaatgggggatgctatataccggaatcccgttcaaaaacgggacgattctaataccgatatgacatcgctctgagcaactgtcatccgccacctgcgtgcattgcagcaaaatgagaatgacgaccagcgcttgccaaacgccggcttccctgcatcttggagaaacctcctcggaagcgctcgcctccgcgcgcgattactcgcttcctcccgccagcgcgcgcgccatccaccggcttctccccatcatggcgaatcctcctagaaagcgcgcgattcctcgcttccttccaccgccgcgagcatcgtccatcagctcctctgcatcccggtgaaacctcatcggaatcgcgcgccattccttgcttctttccagcggcaccctcgccgtccgtcggctcttctgcttcctggtgaaacatcctcagaatcgtgttttgcaaggatatgatcttacaatcaaaatagtacaaggtttgacagagaaagcttgcatcaatgaacttgacaccagtgggaggacaacatgctgagaaggcccggtttaagaatcgaggtgataggcagtaaaaatctgtgaatgagagtaacaccatcaagacagtgagtatcttgactgctatcatggtgcctgcgggtttcattgatgatacattagtagaatcatgtgatacttgggaggtttcacgatccttctcggtatcatgaaacctgaaggtttcacgcatgatccctcgctaggtatatatcatcttgtgtgatacctgaaggtttcatacatgatacatcaaaagtatcattatgtgtgatacttatgatgtatcacatgatcctacttagatatcatgcatggtatcatggttcctacgggtttcacgtatgatacttgaggatgatcatgtgatacctaggaggtatcacatgatcatgtatcatgtatggtatcatgtatcatgatcctcctcagtatcatgtatggtattatcaggtttcactgatgataccttaggaggatcatatgatacgtgggaggtatcatgattctgctcagatatcatgtctggtatcatcaggtttcatagatgataccttagaaggatcatgtgatacgtgggaggtatcatgattcttctcagatatcatgtctggtatcatcaagtttcatagatgataccttagaaggatcatgtgatacatgagatgtatcatgattctgctcaatatcatgactggtatcatggctcctgtgggtttcacagattataactaagtacgatcatgtgatacttgggaagtgccatgatcctcctcggtatcatggctggtatttactccacaaaaagtctacacccatgtaatacacttcatttgttcatatatggggaaatgatatttgcttccgtcaacttccagatcaaatatatgtacatggagtggacatggataagttcatatcatttgattcgatcgatgtatcgtctgacactgcttagagcaagaaaatgaagaacctcctgttgatggagactgtcaaccaaagaaaacgcggtgggtgtcagcgtcggcgccaccaccacgctcacaccgctctcccgcactgacctcgtgtgcatcggcggtgacactgaagaggtggagctgccaccaccacgctcacgccgctctcccgcactgacctcgtgtgcatcggcggcgacactgaagaggtggagctgccgtcgtcggcggacgcgatgtcacaccccaatctgataccgccgtacaacggcacctgacaggagcgtgtcgtagggaaaacggcgtgaaccgcttcctacgaaaccgcgatctcggtaccagtcccaggacatagtgttggtacccacggtgacaaatatgaatcataggaatccttaaaatagatagaggatttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcactttatcttctcttcagggcggaggaactatatatatatatttatatagagcaagggtgagtactttcgtactcagcaagtcacggaaacttaggtgtttaatgcaagcttggaagagaggcaaggttgtttagcaaatcttttatttgaagacattttgaaatcactaagtgatttatttcttcctaagtttgggctgaaaagagacttacgtctcgattcgactttaagggatgtttttcaacagctcatttagtaatgtaccgacctcccgagtcagatcattacttctcggctcccagagccattccacttgattaatcggctcccagagcctttttcattttctcggacttccagagtccagctgcccagcagcacaacaatccgcttccactcgggaagcctagtctatgatgcccgcagacatcccgaatcacacagattcgtttctgactactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccaacccagggttacctcatgccatatagaaggatcaaatcctcacgtaagcataggccattttaggcattcacaaatcaactccaaccaccttgatcggtaagtgagcaagcttctcgtccttgccttaccaggaacccggtttgtccgacctcgccccggcgttcccaactattggcatgcgaggtttccctgaaccgactagttacctagccagggtgtcccattccaccttgtggttgcactttgattatgtttgatgagtttcccacaggaatcggtccttatatgcgaatacgggacagtgccacataggcacaacccccgcatcgtgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtggtacaacctacaggaattagtgcgactactgggtaggtccgtcggtttggcatgcaaaccgaggccaagcaagttaaacgtgagtgattctaatgatgcaagttgcaaacaaaataataatgactttccaattataggagcaattgatcaaagggtgacttgccttgctcaaggtcttcacgaagcttcacgaatcttcgagaaaacccgcgatcgacgaaaatccgataaccgccactatacgcaaacaatcgaaaacctaaacaaaggaccaaaagaaagatcctatttagactaattagtagtgccattaaatagatctcaatttcacggaattactggaagtgaaacggagtcaatcggacgagcggttggggagatatgaattttggaagtttaattggagtttctggaataggagaaatggtttatggaatttatagaaataatattctcaagaatattattgacagtcactgtcatgcgggaccaaaggaaatgttttatggaattttggaatagggaattgatttatgggacaaaggaaaaaggatttatcaaatccctggaaaaagaaaaggatggagggatgttaattggacttgggccgagcgaaggggcgcggcccgaagagatgcgcgggcgcggccgaggcgagcgggccggcgcgtgggagggaggcggcccaaggccgaacgaggcgcggcccacgcgacgcaagccgatggacgcggtccaccgagtcgggcgcaaggcgggacccacaaggcgatgacacggctcacgcgagcggggtgcacgcaaggcggcgcgttggatcggtggaccgggagacctttgaccggtctccgcggggccgggcaggtagatgtggcgtcctcgtggacagccacgttggcacggcgagagaggaggccgggcggccaatccgacggctcacggcgtgtggcgagttccggcgagcggcggcgaaccggagtgggcggcgggcaccggaagtgagagggggtcaaggtgggatgattcaacggtgcggatgagggagaggcggcgacacggcggctgacgacggcggccgtgcggcggcgggatgggtggcacggcgcggccgcagtcagcgaggcgggcggccgcggtggcgcgccggggaggttcaagaggacacggggtgggtcacggcgcaaggaatcggcgagagaagggccgacggcggcagattgcggcggcggccttcgccggcggagagaaggggaaaatctcgccggggcaacgggagtccaattcaccggggaaggagcttctacacggctccgggaactcgtttcaagccacgggcggcgacgagctagcctagggagtcatggcgacagcgagcgacctccggggcagagcaagagcgcgtggcgagctatggcgagcggcggcgggcgcggcgcatcgcgcggcaggaggagtattatggtggggatctcaccaacgaagaggaagcagcgttggcgtcgcggtcggtgtcgcggcgaggtggtcgcgacgccgagacggcacggcaccgagagggcgcggccggggaagaagggagggagaggtggtgcccggagctcctcgtcacgcgtccacgcacgcaccggctcctccggtgctcggcaacggacggcaacggcgagagcgggacgagcagcaacaaggcggcgacggtggttcggcggcaatggcgcggtgggtgtgaggactgaggcgagtgaaaacgagagaggaaggggataggggtggcttggttttatagcggaggcgaggtcggtttggggaggggagaactgaccttggcggtcaagtgctcggctggcggtagcggcggtttcgtgggcggtgcgaaagcggcgacggtgtggatgtgttgagcggcgaaggcggtggatcgagcagcggaaatcgaaccgctggagcgcgggctggcgcggtcaaggagatgaggcgggtggcgcgagcggtcaagcggcgcagaggtggtgacgccggcagtggtcgggaaagggaaaaagaaagggaaaagggggcttggtcccttgccataatgaggagagggagagtgaggaggaggaggagagggagagcagctgcttctcccactcttggacgggtgcggcgtggagtggcgggggccaaggatgacgtcgacgatgacggcggcggtcggtttggcatggagcgggggcaaggcggcagcgcatggcgtcggcggcgaccggccggtcggccacctcgcgaggcgcgcgcgggaatgggcgaaggcggtggaggttttgggcggcgacggcgggaaatcggctaagcagcggtgcatagcgcggcgagaggggagagagaaaggaagcagagagagagcgaggaaagatagaggtagaagagaggcgatgcctctctctctcggcgcgtgcagcgcacgtgcggggggggggaggagatgatgggctgggaggggaaatgggccgggggaggaaaatcggtccatccaaaaatacagggaggtaaagtagacttttacagagaaaactgatttggatagaattggagagatttagggtttggattcgaattctattttgatattcgaactcgagggtttagggatgtatcaagggaaactcaaggagaagtcatggaaaggattcaaaaggaatacttgggtatttgttctcgggaacatagggtggagtcaaagaaaggattcgaggcgggatttgaataattctggattcgtagaagttggcgaggatttcaaaggaaggatttgaatttcagaatttgatttcagagactcgaatcggaaaaggaattttcgaggtggaggattttgattccgatgagagggaacaacgggattaaattgagatccctggcacaatttagactctcacacaaagaacggaaattttcgcaattaggattttgccgagttagtttttaatgactcacgaaaagcggagcgttacacgcgagcaggtgccgccgccggctccaccgccgcaaccgccgccgtcggcgccagcgagatctcacgcgccatgcccacggtgagagaactgtgagtgggggactcggataagcacaagaaacgttgtgtctctgttgagagcgggactcggataagctcgtgatgatttctggtgattcctagaaaatctgtcccgtcccgaccgtgcccaaacgggataccggtgtttagcatttccgaaattaattgatacttcctccgtcctataatatagtaacgattttgctatatatttgtcgacaaatttttccccaaaaatttgacagatgtaattataggacaatcgtaatgtaattacactgtaacttacatgtaattacactgtaactatagtgtaacttgtatttaactttcaaaaatctctccgtaacatgttatttcggtaaaatggagatcgtgggaacaaattctttcacacatgtgtgtgctatgatttgttttcttcctcaccaaaataaatcttgtaatagatctaacgattcaaaattatgtgaaacttacatatatgttacactgtagttacgtgtaagttacagtgtaattacatataagttacagtgtaattacactacgattgtactataattacatctgtcaaatttttggggaaaaatttgtcgacaaatatataggtagtccctatagtaatctaataccggataagacactttatagtacaatgaatttgaacatgcttcttgtctagattcgttgtattataaaatgtcacatccggtaataggttgctatattatactaggacggagggagtacactagtacttaccatttaatatagtattgtctgacatcaaagtctctttaattcatactgtcaaaaaatcttaaacactaggactaagctactgaattttaggctaaaccgctagtaaacaaactaggtgctataatatatataactacctactgccattaggcagcttatcattcgcacacattctcacaagccatacatacatagtactagcatgttggtgtgcgctaatgcagagatgtcaccatggacaacttcatctacatgtaacaaatggtgatcaccgatcaaagatttcagaaacttccatcacttgcaccccactccggcctcggcggctctccgcggcgtggagttcttccgccggctcccgtgttgccggaacccgttctgctgccgcgacgacgacggctcgccgccgtccttcctccggcgccgctcaatggcggaggcgctgttgctgttgctgttgtcggagccgcgcttcagctgccgccgcctcttcctccccgggttctgagctgcggccttggacgaccccgccttgctggcttgtggcgccgccgccgccgccgccgtcgtcttcgcggcgtcgtcgtcgatcttggcgatgtcgtcgtgttcttcctcctcctcctcctcctcggtcttggcgacgctgtcgtcgtcttcgtcctcgtcgtcgccggcggcgtggtcgtccttgaggtggtgatgcttctgttgttgtggccttcccctcctcttgtacgccgggatcacctcctcgccgccgccgccgctgctgctgccatcgtcggctttcgcagcttcggtggatttcctgcctttcccacccctcggccttcccatccaggcgaaccaaacaaacaggggatgaggtggtggtgatgtttaagttggtaactgcaaaataatatgataaacaaatcgaagttaggatatattttttctctctctacttatctgtaatatgtgtgctgctagtttcaactagtcacaactcacaaactcaaatagctgactagatttgcatctatgctcgtgtgaaagaatacgaagaactgattcttacagctaaaagctgcaagcctataagcatcacatgtttgaggcttgtggggtgaaagatttgagccagttattattacagtgggaaaagaagtttgtttgatggatacaaaaggagaaccaaccacagaaatactattggaagtttggaacaacctaacacaaaggcaagaaccatgtgaacagactcattcatgtcctgtaatcttctatccactgtctagaacttcaatccaaagtcataactacctcaagagcatgagcatcccgagtactaactaggtaagtagagattggaaatcagaagaacgatcaagaacaagaacaaaaatatgtactgacctgttatgatgtctggcaatccgaaaacttccctcgacaagccttttcctccgggattaataagagggtttcagtttgcagcaaagagatcttcagagactagctagctgagctattctacgattgctatcaggcaagaaccaccaaccaggacatgaacaagagagagagaaagaacagaggggattcagatatcaagaagaaggcggcgagatcgagtcgagagcttgagatcgtgcacaagactacacgagtttgtgcacacagaaaagagaggaaccaagagacagcaggaagaagaactggctacaccatttctgcagatagagagagagagagagagagactgtaaagagataggagaagtagaaaagatggagatgggagtttgcttgcttgcttggtttggctgccggtggtaacaacgtgcagcaggaatgtacggccctcaggtacagcaatagcacagtgaaagcatttctgatgctcgcttactttctttctttcttttttttttgggagtggaatctctgtttcaggttttttcctgttacaaccaggatgaaattcgtagagctccagtgtctggccctattaaactattgatgatttactgcgagatgtaataagagtacaagtgtgtgtacaatggcgagttctaacttatacagacacagaaattatgaaatgcaccccctggctcagtacatatgtacactgctgatacacctgctggtttcttgtttggtgaaagggcgagatcgatgaaacggtgaagaaacagtagctaaccctggcatcttaatttggtggtactagggatgaaaacggtcagaaacgatcggaaaacagcctcaaccatttccgtaaccatattttttctcggaaacgaaatcggaaacggtaaagtcagaaacgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctatgggtcaagtatagacatgtcctataatatcgacatatttagaatacggtaattaccatattataagaaacgataatttccgcgagaatacggtaaatacggaaacgatcggtataacagcaaaaccattttcattttcatttccatattttttaccattttcatttttgtttcggtcgattaccatttctatatagctcggccggtagaaagtcgaaaaccaacgtcggtcggccggtaattaccgttaccgttttcacccctaggtggtacacacccaccaaatgcatgtgccgtaagaagccagttaccatctctgcccgatggacgaatcgaatcggtgatggtttcgagcaatacctggtgctgctacaaaaccgggtttattgcatgtatcacagacctgtgggccaccttgtgcagccacacagaaacaccagtgtactgtgtaataatgcactggtgcaggtacactggctgtttgcaaattgcatgtagtggaacttatgctaattatgggccacttttttggctatttcttggtgattttctctgtgaatgatgtacagatgtgcagtgcagtgatacggtgtggttagttgatggtcctgcctgtcacggaagatgaaaatatcaacggaacgaaccacttctctccaacacccgaccaaacgcgattccctctcgcatgcgagtcaaagaaaaaaaaaacgttctc

SEQ ID NO: 21039 - DNA, 17611 bp, Oryza sativa
  unsure (1)..(17611): unsure at all n locations
gcgatgctgctgctggtgctggtggtggtgcgacggtcgcgtccggcgcacggaaagacgccgccggtgggcggtggcttcctcctcactcactcgctgcgctgccgagcccatgccgcggcagcagcagatgcactcattcatttacgccgctgcctgcctgcctgccatcgtgacatgccaattgaaacatgctgcagcgagaggtacaggggcagcagcagcagcttcagcttcagctcgtgtgggtgtgggtgtgggcggcgctggctgctgtgacgtgctttccctttctcgcctccgttaggaacgatcggcagataaacgatgaataacaacagattaatcacataagatacgagatttaacatgaaaaaccattctaagataggaaagagagagccatggataccagccagcaaatcttcactatatcagatgagattacaacgttgaacggcgacttacaatatatatatatatatataaaggtaaaacctctaaaagtatgacgatacatactgccgtgtgaaaatgaatttggatcctgactcaacagcctcgcagaagatatcgagaacgtacgtacgagtctacgtaggtacagcgaccgagcgagcgcgagtggcgagcaaagcaggcaagcggcagcgttggtggtgttggtggtggtggtgtgtctgcctgcctgccgcgtctgctggcgccgggccggccgacagcctcgtgccaacgcctgcagacgcgctcgtcgcgcgatcgccgattcgctttcccggtttcaaaccaaccatcatacgcgcgcgcgcgcgtacgtacgcgtacgtgaagtggtgtgggtttgctgctgctgctgctgcggcagcgcgtggccgcgcgcgcccgtgttcgaacagtggaggaggaggggagggctccaatgatctgtcagtttggtcggcacgacgacagtggggagaggaggggaaatcacggaggagctagctaatctctcgtctcgtttcttttgcagtcgtcgtcgtcacggtcacatgcggattcaggnnggtnggggggggggtgaagtgaaaggaaggacaggatcacaggaatttactgggggatgattcatgaagcccatgaggagggtccgacaaagctgaaagggcattgggcttccggcctacaatgtccccatgggcctacatgtaggggaaccacgttccttttcatttttatggtatactcctatcttttaaacacagttttttttggcaaaattttataaactatcacaattatcactctagtttgaattttttttctttgaagcagatctcttgtgtttaggcgatccatgaagagtagccagagaaatacttcaagttttgcagtacatttactctttcagatgtgtgtcattggtatttctggctgtagatgagcgaagaggagggaacggaccttctttgatatttttttcgtattgctccaattgtatacccattgatcgtgattgctggttagagaggtgttcggtatgatgcaatgtaactcagaccactaatgtgcagcatgagttgagagagggaggtgaaagagctcagatatgtcgtgtgagttaaagagtgcagacatgtcgtcttcttttgcaaaatagaataagatttgaaattgatcttgtggaatatgtccatgccatttgtttttccaaagtgtatcttttacaagcaagaggctaaaacctataattatgtgataagggagatactcaatctatagtttcgtgagataagtttgttttgtgatagatttgtgcaaaatacatgtaattttatgaaatttattctttttatgattacatttgaaagtttcttttaaaagaatttatggtagctttataagatagtcgcatagtttttgagagagaccaaaagggagatatttaactatttatcactcctacaagtggcaattaataatttgtcactggattcacatgttataggcatataggaacccacatttcataaactatgaatggcaaattcttaattgccagtttgccacatcttaaaagtggtaaaaagttaaatgccccaccgaaagagcctccgcgttggggtgagtctactatgtaagtattcgcggacgacgaacggtttcaacagccacgtttgggctttcctatcctaattgatcattccaaaaagggacatttaacttcttgccgcttttaagatgtagcaattaattatttgtcactcactgtctatgatatgtgagccctcatgtgtctatgacatgtggatccagtggtaaataatttagcaccaagtggcaaatagttaattattcttccaaaagcacagaaacaaaagcagtcgacaagttcagatataacaacagccagtcagcaatggacgtacaatgcctgtcacactgtgtagatcgagctctaccatctctctgactctctactctctaaactctacaggccgccgtcgcagcagggaggcagcggggcaccacacaggcacctgttgcgagcgtagcaatccgcaccgtgcgccgccatgaacctccccgccggaatctcgccgcagagctcgttgtcgctgacgttgaggtgctccagcctgacgtccatcagcgacttggccaccttcccggtgatccggttgtggctgaggtcgaggtacctgaggtggtgcgggaacctcaccccggtcatgtcgaacgccagctcgttccacgacaggtcgatcttggccgccggcgccgcgatcccgaacaggtgcggcgacgggtcgccggtgaggcggttgtgcgagaggtcgacggtgtccacgtcgccgtagcagcgcggtatctcgccggtgagctggttgtgggagaggatcaagaacctgaagctgccgtgcaccagccccggcgggatggcgccggtgaggaagttgccgctgaggtcgaggtaccggaggttggggtggtcgccggcgagggacggcgggatcggcccggcgagcctgctgtcggcgatgacgagggtacggaggttggtggcgccggcgaggtaggacgccggcaccgggccggagatggaggtgccggtgatgtcgaggtcctcgagcagcgagaggttggcgaaggagggcgggatgggccccgacatgccccggacggacgcgatctggaggacggcgagccccgtcagctcgccgagcgccggcggcacgggcgcggcgacgccggcgagggagaagagcgccagcccggtgacgcggccgggctcgccggagcagaacacggcgggctcccacgcgcagcagttggtcgacggccgccacgacgacagcctgacggggtcgcccagctgcgccttcaccctcagcagcgcggcgcggtcgtcgccgttgcactccaccgccgacgagacggcggtgcaggcggacaggacgacgacgacgaggcagagcagtggaatccacgacgaggctactactgttgcattggccattttcttgggtttttagggttttttttggcagcaatgcaagctactgtgatgatctgcactgaacttgaccacctgcatatatctatagaaatcgccatgaaattcgtgtgctagcttctgcatcagattctcgtttattcacttcatgtaaaggacgttcttgtgttctgcattcaacatgcatgtgttagcagcaataaaaccgctcaaatccgtgcaggattctgcagagattgcctcaacatgtgcctcaaggtacacaaaccagaattcagttagcgatcagttactgccatccagagatcaattggattcatcagataataagcagtgcaagaacaaaattcttttctcaataagatacagattttggtggtgtttaaaacttatgtaggtgagatgaagatgaagattaagtgttatacacaaaatgaggtggatctcacccaatccaaatgtgggtgagatcgaaaaggccaagaaactttcgcaagtgagttggcttgtctgttgttatgcagttttctacagaattatgtatgatggagaaaagctccttatagatatccttcgtctgagagttgtgaggtcaaatggttgtccttgtaggaccaggagcagtcattactcgatgctatagccagacttgacgatgcatcagatagtgaaagtggtaagttactggcagactctacttgcactgttaacagtatctttgaagggtgatgagtattagccacattagtatatttggttttataatgcacaaccaaataattagaaagagtgaaacctggaacttcaaattctgcccaaacattgagaaattttggatgtgactcagtatgttttgatcgaaaatttgtcagtctttcgtagtactggccacccacttgtgtcgtccttgtctgatgcctcaaatttgttacagctatcaactattattctaactagtcattgtatatgacagaagatatggctgtcggggcccaaatggtttctgctggtgatcacatgggcaggaacggcgttgcttgttggtaacaactggcaaagtgttggattttgaagattgtgtttgtgaagcgcctgtgtagatcaccggtcaaaggaaaatcatcgatggggcattggcaatttggcatgccaaaagtggatgtactgaacatgtccctgatagggcctcttctttaggctgcgaaaagttcaggtcacaaggcgcagagcgcttttccttcggtgataacggtggctgtatttgccccctaacagacttgaaggaactctaatctgactattaacattccaaaactgttaaaccctttgccaccatctccaatcttcttgtctctctagtgcaggatttgtaaactccacctgaatgcaacgtgaaaacgaagactgtatcttgctttccagtgatcaggttgtgataggtaaacaactatagagaccatatttaatgcttagggcacatgaatgcggggatagctcagttgggagagcgtcagactgaagatctgaaggtcgcgtgttcgatccacgctcaccgcatttaactttcttttccttttcagcattgcattttttttctttcttttccttttcagcattgcattttcttttctgcattgtgcatagaactttcttttccttttcagcgttgcatttttttttctgaattgtgttctttgaatgcaccatttatttttttttccttctcttttcctctcatcttgatttcaacgttgcattttttttaactgcattcattcaatgcaccattttgtgtttttccttctctcatttaaagaaggataacgaattgcattctcaaggtgtgaatatattctcctttataagataactaaaaattatcttccagtaataaataaaaaaagtaggtcgactttcacaccaacaaaaccgttagcctactcccatccctgcgtgggcgcagttgtccccgatcccctcccgcgaacagtaacaccttcggagagcgggcacgcctaacttgtggagagctgagaagcatggggttatggatttcaattttaaatttcttcatagggtaactgttggagccgatctttaaaaaaatttctaaaatttagcaccttgagattgatggagtgggagggagcaaccatgactaaactcgtagagagcgagaaatatgaatgtggttgtggatttcaattttgggcatacggaactgttgaagccgatttgtttttctttcaaaaaaaaaacccaaaattttgagattgagaagggaataaaccaaacgatgtgagagtgagaccctggtgatgggtaacgatcaattcaaaccatcaatttgtaagtgatcaatggtgttgcttcaaacacatggtgatggggaacgacaaattcaaacagcaatttgcaagtgatcaatggtgttgctacaaagacagacgatcagttagtcgactacggaatgcaatacattagcctccaaatgctgcagacgcaaaactacgtaatttactcataccttgaactatccacctttgctacttgctacaggtcacatctgttctactagcttacactacactgcccccaaattggcaaatttctacctcctcccaccccgcttcgccgccgtcgccgtcgccgccgtcttctccgaccggttcaccttggccctcttcgacggcggcggcgtcgttgcggcggcggcacctcgcttcgacggtggccgccccacgcttctcttcggcgtggcgctcttgccgcccttcttggagccgccgcggccggcatccttcctgccgggccccttacgcgtcttctgcggctgctccggcgacgtcgccgccgcagcacgcttccgtgtccccattggtgagcctttcttcttcttcttcgacggcgacgagccctggtttagccgtttgaggaagtccacggcgttccgcttcttggcgggcgtggctgcgtcggcggcgatcttcttgtcgggcttcttgcttccgtcggtcgctgcctccgtcgcttccgagagcttggccattttccggccaccgacgctggccgagttcttgccggggccgcggcctttcttcgtcctcaacccccacgccttgtccttgctcgctgacgccgacacggagaccttcttctcgccgtcgtcgctcccctccccttcctcggcggcctcacccttctccgcgctctcctccttcttcgccgccgccgcggccttcgcgatgggagctccgcttccggcaaacgatgagcggtttccctcctttctcgatcagcgacccgacgatgccagcgccgccgccgccgccaccggccggcgacgcgtccagcctccgccgcaccatctcgatgtccacgtggcgcctgatcgcgccacggtacgcgtcgctctcctgcaagtggattttaaaaaaaatgaaaaaaaagaaaaagaaaaaggaaaaaaaaaggagaaaatatctgtgggggcatctggctggaaggcaccccacccgcccaactgattgctacgctgcacccaaccaaccacgcagaatgattcaaaccaaaaatcgaacaaaaaactaggaactttcaaattcaccatgagctaatccgatttgaaactttcgcgttcgttcgaaggacacaaaaaatatgaggtgtgcacatgcgtctcacctacctaccacacaacaaaccaacccgaattcataagcaagcgatgacgcacacgaatttttctggtcacgtaattcggattagtgctagtgctatgtcatcatgccacatgcgtggccctaatctaatccataataatctagaggacccccgttaattacggatgggtcccaccctctgacatatcgtttgaaattcccctctttacccctcccctaacttttgaccggcggcggtaaaaaacaaagggtaaaaagggtaaattgtaaatgagcggtaaaattcatttttacctggctttcgtgcagccgctcgagcaggggaccgaacctggcggcgaacgtgtcgagcagcgcggcgagcggctgcgacgacgacgacgacgacggcgactgcgagggcggccgcagcgcggaggcctcctcgccgtcggcgtcctcgtcggcgccgggcttgtacgagcggcggcggcgcagtctgaccgagctccgcaggtcgctgctctccttggacgcggccaccgactcgccggaggcctgctgcttcgccgccgccgcgtcctcgtcttcctcctccgccttgacgctatggtcaccggcgcgcgccgcgggtttcagatctgtggaattggactccctgcacgaccggccgggctcctcgctcgacagccgctcgtcgccgttcgccgtctccggcttcccctcgccgccgccgccgccgtggatgctttgttctctctcctctctcagccgcttcactttcgtctgtagcgttctgagacatgaaaataataataataaaatagttatttatttatttaataagaattcaataattggagaccgagagatcagcatcagacggctcatgaaacgcgcggtttagaggctttttgaaagagaatttggtgattagattttttttttcttctggtgttttagtgttttttacccgatggagagatcgcatcgctcgacctcgcggcggagctcggcgacgcggaggcggcggagctcgtccatccacccgtccgcggcggaggcgtcggggccaccctcctccgcctcctcgtcgtcgtcgtcctcctccgccgccccgccgacggagaagcggcggtggaggtggcggaaccggaggcggcagctggtgggcgtgaggcccgggcgcgcggcgagggggctccgcgtctgcacctccatggcgacggagtcccagctccccgtgccgtgcctgctcacggcgcaggccaagagcagctcctccaacgtcccccagatctcacctccacctcctcctcccgccgccgccgccgccgccggagacacgtcggggccgtccgatccgtccgccatgtgctctcgtcgtcggcggctgcttcccccctttttcttctctctcgctcgcgcacgcttctttgttcgatttttatctcggagagatggatgggatggatagatagcctctgcctctgtgattcgagcgcgcggcggcctcgcgcacccaaaagacaatttcgcgtttctcaggggggtgttttggagaaggcgagcgtgctgttttcaaactggggcccaccttctgcctttctttttattgtacgatccccatattgcccctgattgcgcatactattatcccgtactatatatgagacgcaaatgtcgcaacaaaccgtgtttatttgttaggccttgttccattaatccctataagtaagggattagaggagatttatttcacatctattgtggcgtgaaattattctccctcaatctcctacaatcctattcaatcccctctaaattgaacaaggccttataggagaaaattcttgctctaattccaaaccgcaaatttgatacgcagtactctctctataaaaaaaaactcagcatatccagatttgttgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattcacagtaaacgtgtaaacgatctaagcaaagtcagaccgtgcactttctttcttttttgacacggacggcaacaaaatgcttgatcctgaaggtgcatgatcctataaagtatgccaagaattcatcaggatgcggattagcccgtgagctgacacgtgggatctgaataattttggcccggattatcggctgcgttggattggtacgggtgaactgtttgactgggcctccttgatgattcgccaatgaacctgtccttgcttccgtgctgaacccgtgtcttcactgtgcggttacaagaaaaagatttgaacgaacagggcatgccactcgtcagaattcatagtttcaaactagtattccctaaattctcaaattcattcatgccgaatgcaaaagctggcactctgtttatcatcaattttttgtttaggaactttgatcaaaggtacaagcacagagataatgatcatatggattgaaattgtaataaggatgatctggaaaactaaagcgtttcatacatctcaatggagctgaaacttcaactaacaaaagagcgagtttatacatggcgaattggagataaataatactactagtagcagtctagcacaagcaacggcctggaaaataaggcgagattattacatcaccttatgagaattccatttgcttccctggggaagcaaactgcacctaccaaatgtattattgagcgcaaaattttaaccaagcagccatgtcaagttgcagtattgcagggggttgcaatttcagcaaattctgatacttcttcacttccggcgagcctccagtgccttcttcaactcctcgctcgcctcattcgacaccggcttcggtccactgtccaccatctccttgccgttcccgtggcgatctggcttcgccaggaatggttgtggtggtggtggtgccagggacgacggcatccttcgggcgtcgcctttaccgggcattgaggcggctctatttccaccgatctcggcacgcaggtcctccacggtacgccgcagcatgatgctctctgcattgagcacctcgagctgcctcttgacgagcgagaacccttcagtctgaaattccggcgcatccttcttcttccccttgtcggcatcggaatgtggaggattccgcagcgtgtgctcaattgtgatcttgttcatgaccagcagcggcaacttgttgatggccaggttacccgccttgcggccgtacccgtcgtcggcgagggcggccttcagctcgggcggcacgcgcagcccccactggaaccgcaggctcgccttgctccacagcggcagcacgctcctggtcgtgaggcgcatcccggacagcagcgcgccgaccccgccgccgctcttccccgcggcggccacgttcgcggcgaacccgttcccgctgaacgagaacgccctgtggtcgtcgccgccgttggcgaggtcggtcagcttgtgcgacggcggcggcggcggcagcggcggggccggggacgcggacgcgggcggggagatgacggagttggcgagcgagaagtcgccgatgcggggcttgaagaggagggagaaggccggcgggctggaggagaggaggttgaactcggcggatatggcgaacggcgcgcgggcgggggacccgagcgggccgaggccggtacggacggagagcgcgaagggctggagcgggtcgttggggcggtacgagaggcggagcgccgggccggaggcgaaggcggtggagaggtcgaagcggagatcccgcgagtcgccgccgccgccggccgagacgccggtgaggaacggcagcccgaggacgccgacgggcaccttggcgcgcaccagcggccggtcgtcgtcccggaacttgatcgacgccttcatggccggccacctagggttagggtttggtcgatgggggaattcgccggatttggtgaggttgcgggaggatagcggcagtggaggtggggaattttgaagtgcggaggtgagggatttgggggatggggcggaggtcgtcacgccatttcggaggagggggcgtcggcggcgggattgaattgtggggaggaagcggaaatggaagggggacggaattgggttggatggctctctagctggatggaccgtttttactctccttccttactccctttcctacctgtaataagtttatttttagctcctatgtttatttaaaataaatttatttttaaagcaattattgctctttacatttatttaaaataaacttattttaaagtaattattgttcgttacatttatttcaaaataaatttatttttaaaataactattgcattggagtttaggaaagtatgaagttattaaaattgaaaataggtaaaatgagaacatgttgtattgggatttgataaaattgactgcccaaactactcactctagtgcaggtttattataatataattcgtccgtttcatataagggtttttatgtttgtttaagttaaactattttaagtttgattaaatttagaaaataacaataatatttatgttattaaatgaaaataattattgtgaaatatatttcataatttacttttttatatagcatatgataatatttttctcaacaaaacctggtagcacttataatagtttgatttataaaaagagaaaatccaagaaatgttagtgataagcacccaatttcaagaaaatgtaatcgataagtatgagttctgtaaaatatcattgtataagcgacttttctcagaaatgtcatcgtcgaccatccgcgttgttaaatacatcattcatcctatagcacttaacggagggctaccaacggaatcctaatgatgatggtatttatagaacaagttgtttgtacgatgacatttcatgacactcacactcgtcgatatcatttcttgaaattgaatgattgtcaatgacatttcttagacttttttttctatgaaaaagatatagaatcttttatattttagaaacatatatgttcataatccaccgtttgcgaagcaaattcttgttttctcagaagattattttcgtaataatccacatgtgcataagttaattgtttagtttgttgttttggactctaccgtgcacatcaccaccttcttagttcgtgagtacatccctccatgatggtctaagaaagcctaatgacaggtccagtcattaattcctgatatggcctttaggcccaaaattgtactctcaaatagtcaaatctaaatctcattattatttttttccctataaaccatccatttttcaaaccttggccatccaactgaattttttttcttgggtgaaaaactgaaaatgcattacacggtgcagtcaaaactggcctaacatcctccaggaaatcaatcctaaacaaattatccaattgctaagcataagctacatttacaaagggatcaacaattcagagttcaaattatccaattgctaagcataagctacagttacagagggatcaacaattcagagttcactgggcatggcacgatcgcggcgtgcctgcacgccgccaacgacgacgacgccaccgccgccgccgccgccccggcgctccagaccacgccctcctccgccttccacaccccgtcgtcaaagttgcgcgcgtagctgtccgagtcgtactcgtacctcgccggcgcggcgagcctcctcctcgctgcgcgccgccgccgccccgccgcgcagtacagccccgcggccgccgcccgcctcaccgccgcccaccacgccctcgccgcggcggcggccgccgccaccgccaccgccaccgccaccgccgtgccgtcccctcctcctcgccgccggctctcgcacgccgtcagcctccggtacgcgatcgcacccatctccaaaaacgcgcctctcctcttccgactcgtgcgcgcgtgttttccattttataaactcttcacatcatcataaatgtgtttttccggaccagctggcatgtgggacccacccgtcggggaggaggacctgttcggtgctactccagctgccaggtgggtccaccaccagaggcagtttaataattttattgtgagctctaatccgtgttagtactactgctaaaacaaaagatttgggttgagtttagttcacatcaaaattagaagtttggttaaaattagaacgatgtgatggaaaagttaaaagtttatgcgtgtagaaaaattttgacgtgatgaaaaagttgaaagtttgaataattattttggaactaaacacggcgttgttatccgagatgggaggcatattggcattgtttccggatgcgtataatcaagctgggaaagagcagaagtacaggctgtttgattgcatttggtgacctgatcaaatcaaacctattagtgtgccagttgctgggcttgatctttgttaggaacaaaaaaggctgggagatgaataataataataataataataataatatagtatcagaacaagttcttccaaatcattggttatgaacggcaatgctttggatttcagaagttggcatctggtaatgaggggccatgacagcttcttaacagcagccaggattccagactacagagtgctggaataccgacacagtatcacaagactagttctatgttctggccaattagacaattagtacccataaacggatatatagctgctctaattggcaatcacctgttaacaacatagtagctgggatttagtagtaggcatcaactggcaaagcaagcttccatgatcttaacctgattgcagctgttaagggaactacccccaaaatgcatacaaatatgaaagtatgaaaggcatgtagccaaactactatggatattttactgagtttacgcacgtttcagaattccctgtacaaaagaatccaatttgaaacaaaataaggttttaccattaccatgaatctgtcttacacaactacttctcgatgcctaagttcatatctcatttctttgccttagagaaacgaaggcacctgtacttttcaccgctaacagtgatctcgagggcaccgtcttggttgtcctgattcgaagcagtgcccatgagcacgctcttttccttctctaagttctccttttccatcttcagccttgcctcttgccgcgcaatctcagcctgtgaaacatgcaattggatcaagtcatgctgcaggtcaagcatagttcactctatctgtcaaaacaagtttgtcatttcatttgcgaataaataaatatgagtaaaatcatcaagcatagttcactcttatatgtgaaaacaagtttgttcaagcttcaaaccatctgaaagaggaatgtgttctcaacttattatttctactaatctggcaaagatataatggtaacaggtcactctgcactaatacagggtccaaaatcactcggcatgacaaattgacaattaaccagaatggaaccaagtgattgttttggataggcaagaatcaagtgactgggagtttaaatttcccctatcaaataggattaccttattacagtcagaacaacaacatttaacaaatctcttaaccaacaacatagccttccatacgcaaaacatttatccaaatgaattaagatcagaatccgccaacacagccatattgcttatatctcaatagtagtctctgaatggaactatgaaaggattcagccatttttgggacttgctgacacaccataatcgatggacaggaggagggtaacatactgactactgagacaaaacgacatgataataggaacgccaacaaaacatgtaaagaagaaacaagccaaaatgtatgcaataaacttcggttgacataatataattcatgtaactgtacatgtcatgtgatgaagcaggtatgactattgaggaaagatcccaaatgtaccacgaactaacccacaggtctagattatctaggaaagattttgttctctcacaacatgattcaaacctattcatccttaaaaattgaaaccttgagaaggtattcataaataatacggcaatcctactcatacactctagtctacatatgcatattcttcacatttggcagcagttccaccaaatgaaattcttcaccattagcagtgtagtcagattcctatcggcataggagctaaactactgaaaaaaaaaatctaataaggcattacatccttgtccgcttagttgtttgacttgtttttaagccaaaaactgagaaaagaaaaaaaaacaaagaagaaagaacaggggcggatttggagtgatgggggaagcaaaggaaggggatcatcaacatcagatcatcaccgacctcgcggcgggagagctcggccttccaggcggcctcccgctcggcgacctcgcgctcccgctcctggatgtagctctgcatctcccgctccttcatgacgcgatcctggatgtccgcgtccagcgcctcctgcagctccttcacgaacctgtccaccaccgccttgatccgcaccgacatctccctcccccgcacttcgccgcctcgccgccgctggcgccggactccggcggctgggctagggctccgatgcggccgcggcgcggcgaaattttcgtgggccgctcgtttcgtcgtgggagagagcccagcctctgctgagtcagcaactctcctgggtccgtacgctttcgactgcgaaagcccgcagaaaacgtattccagaaaaccgtaatcatcaagtgaacacgtactctttgtaaacttgcaacaagccagcaggatgaaaacggttgggaaaacatcttcgtccttcgaccattttagtaaccatacttttctcggaaacagaaatggtttagaaaaatagaaaatatcaaaaaatcaaaatcacatatttaatttaacatggctatataatataaccacataaattcatttctatttttaccattttcattttcctttttcttttaccgtttccgacggtttggtaggtacaaataagaaacgggctttagtcggtcggttgagaattttcgtgactattttcatcctacctatgacctcctttgaaaattttcatttttgaggattttggtagaaattgagctaatttctaatgttccaaagaatccaaagtatcagcatctgagatgcggcataaaagagatgcctcttctgttggcatgtccttgccaaccgaaaacacatgatctcccaacttcacagacagtcacacaatgcaagacatacagtgacaaatgggttagcatcagcaacagagaaaaatgaaaaatgtgcagaacatttttcagcttcacacagagagagcataccagaaggtaaaagaactgagccacaagctaaccgcaacatgccaacatagttacatagaagcaatgagctttttcatcggtgtctggaagataaaaaaacaatttaaccacctaaataacacattgagtctagtctccaatagtaacagcacctacaccagaagagctagctagagatgcaacggctacagttttcttccctgattcaggttcagacattacactagataggggggctagttaggatccatggcgtcgcaccggagtacctcgagtaccaccgccacgacatttcctttcgcaagttctacggcggtcagacgggaccaaggtctggtcactgatgatgatgaggaggaggagctcacttccaggataagctgggtagccctggctggccatggttgctggccgtgacaccttggttcagcgggctccccgggccgcccgatgattcactcaatgtgccccttgatggcgggctgcttggccccgtcccgctcatcggcaccatctttagcggtgcagacattgggtctgaaggagcatgcagctttggcccctttttcccttcggtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21040 - DNA, 1739 bp, Oryza sativa
tgtttttctggtgcaaaggtattgagaattgtaacaaagtaatactgaatcaaattatactacaatcctacttattctgttttaaaatataacaaccttcgaaattagtcatagatattaagagaatatgtagaattaaatgggaaaaaattcaaaacaaagtataagaagaaattaaataaaatatggttctgatcaactaaaatgtgagaatagatgaataaatcattatattgtaaaataatttttgaattctagttatatttaaaaccgagtaagtaggaaatatatatagtactactctttccgtgtttgaaaatataactacttctagtatttaactttgccttaaaatatagctgctcaacttatctcgtcatattaaacaattacaatattctaccatttaatttatccacctacttagcatgtacaatacatcacctatacatcacctatgtactaactctagagcattgccgtcaacaatttcattgtttttgttttttaaaaaaatagagataatttaaaccgtagatcaatcatttaagaattagaaataattgagaccatgtgacttaacgagagaaaagagaaatatcattaactatatttagtgggatgaactttatagatatataggatttgcattggatttagactcctatgcctgttaattgtatctccacaggaacggggggatggaggatcatccccgtcccgccaccgccagacccaacacggacgtgttttcctccatttgattactcgtaaccatctccattctttcatcctcatctctaatggagaatttcccgtggagaatcgggaaacaagccccattcccatcctagatgtgttgtatggtcttggtttacacgcaccacaaattaagtgtagtttaacttattagacttttttttttggaaccagtcaactcgggttcaagtcatagtggtaggcgacacacacatcgataatgatatgaccatggtgatttcgtcaatctcaatacatgtcggtctgatgtatatgcttctatgtttgaattgtgttttgagaaaaaaagggagcattttgtaagttcatgcccttattgcattattcagtagaatttatattagatagagacatgttagcacgcgcctcatgtgtttaataaacaattcctcgtgtggatttcggcagcgcctgttccatcttcttcctcatcgatcgctattgtgatgaagtgagatcctaattacgccagcttaccatgtctgcagagaaaacactacactgaattgatggagtgtctcctgccagcacgcagtatggtccttagtactccctccatactaaaggagtcgtttagtataatgtttaagtcaaaccttgaaaatataaatcataaatagctcttaatttcttgagtttgaaaatgtaaaaattatatgaatgtatttgtcttgaaaaatactttcataaaagtatacatatatcacttttcaataaatatttttatagaaataaagagttaaagttgtgttttgaagaccgtgtcgctgtcctaaacatcgggagtactccactactacccctcccgttcatcactctataaatacccgttagagctgcagctactggaggcaattcagctagctcattctgaaccccatctctcgctggaatggggatcagaatgggaaggcgactctcttcaccttgttcttggagctctgttctgcaatggcgtt

SEQ ID NO: 21041 - DNA, 2627 bp, Oryza sativa
ctctggaaagcaaatacggaggattcctcagtgaagacatagtgtaagttctttcttgcttactgtactttcacaaacattcttgcaatctctcgagaaaaaacctttaattcccgagtgattttacaatactatttagagaaattttatggtccttaagaaaataccttgagataccaaattttacgctagaaaatatagcacctcacgatacattctcaaggatgatagtatctactgatagtattttactattcttactatcagtattatcaccaccaatacaagtgatctcaaccgttgattttcatttagttctaatactaatagaaaatattattattatatatcaatagttgagatgatattataaataggtaatattattattataccatcattagagataatattataaatagatatgacccattatattagaaaaatataaactatctttcaattgattttaatattagaaaataccactttaaaacacccttgctcaacatgtgcaggaaagaatacgtggacttcgcggaggtgtgctttcgcgagttcggcgaccgtgtcaagtactggaccacatttaatgagccattcacatatagcgcctacggctacggcaagggcgtgtttgcgccgggacgatgctcttcatatgtttccaagtcatgcggcgtcggtgactccagtcgcgagccctacctcgtggcacaccacatccacctctcccacgctgccgctgtccagctttaccgcaccaagtaccagccaacacagaagggacagatcggcatggtggtggtcacccactggttcgtgccgtacgacaactccgacgctgaccgtggcgctgtgcaacggagcctagacttcatctatgggtggttcatggaccctatcgtgcatggtgactacccaggcaccatgagaggttggctcggcaatcggctgccagagttcacgcctgaacagtcggcgatggtgaagggctcctacgacttcatcggagttaattactacaccacctactacgctaagagtataccgccgcctaactccaacgagctatcctacgacctcgacaaccgcgccaacaccaccggcttccgtaatggcaaacccatcggtccacaggtgcgtacgtgactacgtgtacacatatacccacatcgatccatccattttactgaggaattcaacgtacgcgaatccttgtcatgtctaggaatttacaccgatcttcttcaactaccctccaggtctccgtgagctcctcctctacaccaagaggagatacaacaacccgaccatctatgttacagaaaacggtaagaacatataatctttcaacactggtcctacaaaattcatccaaaattaaacttaaatataggttgatcgaaaagaaccatatcctcaattaactcaattaacatgtatatatactaaatcgttcgcgaacatcgaaaggcgtaaaatttgtgtgcaatgtgtacaggcatcgatgagggtaacaacagcacactgccagaggcgctcaaggatggacacaggatcgagttccactcaaagcacctgcagttcgtcaaccacgccatcaagaatggggtgaacgtgaagggctacttcacgtggacattcatggactgctttgagtggggtgacggctaccttgacaggttcggcctcatctacgtcgaccgcaagacgctcaagcgctaccgcaaggagtccagctactggatcgaagacttcctcaagaggcactgatccagccccacaaaatttcggattgatcacgagatcgatcggctggccaccagatttgtgtttcgtcagtctagctttcagctggttaatttgtgatttgtgcatcagtggtgatgaccgatatgatggcgtgatgaattatgctgcattactattgaatgtgtacctcagtacctgtgcatcattgctggctgatcccattgagccggacaataataagaagaaacaataatgctccctgtcgagcagtgttgggctggttcaggcttaattaatatcgtcattgatgagatcaactgaaccctcctccaatcatctttgaataattgatgctatatactctgctagctaaacagaatactcgatatctcacacaactacggtgatgtttttttttttcctaacgaagataaaagataataaggttagagcaagtaaaatagaaaaaaccatttaacatataggtgtgttcgtttgtgctgtatattacagatgttgggctgagccagctgtattaacaatacaagtagcataaaatttactgcacaatttgtagctgttgcgctgtgcagccacaactatctcctccaaacacatccatactccaaacacatccatagttaattactccatccattttaaaatatagcaatctagcactgcacaggacatacatcctatttcaaagaatctgatcataagtatgtctatctagattcgttggatttaaatgtgtcttatccaattttggtttttaattattataaacttaaaaaataaatttatttgatattctaagtaatttttatataaaaagtttttgcacgaaacacaccgtttaaccatttaaa

SEQ ID NO: 21042 - DNA, 6206 bp, Oryza sativa
taaaaaataggcaaaatttactacagagcatctaaaaaacgtgtaattagcttgttggacaccgtaagattgcgaatttgctatagggcaccatcaaaaagtggtaattagctggtagacacttagaccattattttattatttttagaggaaaagagatgagagaatttttgaattgccgagaatgcccccggtggcgcaccacgttatcccgatcggtccggtcgaaccagacccagtcggtcttgccgagcggcgtggccagagcggcggcgcgacaagtggccagcccgcgatggcgtcaaccgcgtctcgccatcgtcactgcggttgtagctctcgcttccgcttcatgtcgcgtccagtagcgggtagtgttcgatcgcgagcgtctcgtctcctttttctcctcgcatcgcacgagcggttcgctttgggctatagcgctctctcggcgtggacgcgacgacaccgagtcaccgacgaacgagagcacgcatgacgccgacgctgacgccatggacgagcagagagttgctgcttctgctgcttacttgctcgccgtgctggttttgagcctcgtggtgtccgacttgtcctctgccggtgtggcgcccacgccgccggaggttctttcttccccagccgccgccggcgaaggtgctgaacacgaaaaaaagaaaataaaaaaattctttgatcgcaagccgtgtcttctcatcttgtttcatctttgattggtttcttagctcataccattctttcttgcttgaatcatgatgataaaagttcttccaaatatatcaatcttttcttgatatatttcaaatttgcaaatgaaaattttcacttcttgctgcactcacccggtttttcttgctgcattcgcgtgcgccttgcagcggaggcgttgctggccgtcaaggcagcaccgcatgacacggccaacgtcctcgctgactggaacgctggtttcggcgtcagtgacggcggcccgtgcaactggagcatggtagcctgttccgaggccggccatatggacgggagcaccgggatgccgaggtgggcgtcggcgcggttcttgggctacgacatcgatctctcccacgccggcagcgacgacctccgcgcgctgagacgaggagcgggtgatggtgttcacgacgcgccggcggcaaggagggcgtgggcgcagctgtattgcagccgggtcggctcgaccggacctagtcgggataacgtgatgcgccaccagggcattctcggcaattcaaaaattctctcacctcttttcctttaaaaataataaaataatgtcttgagtgtctactagctaattatcactttttggtggtgccctacagtaaattcgtgatcttacggtgtccactggctaattacacgtttttttggatgtcctatagcaaattttgcctaaaaaataagggtctgtttagttcttaaaccaaattattttacgccgtcacattgaatgtttggacacataaataaagtattaaatgtagaaaaaaagattaattacacaattcgccaggaaattacgagacaaattttttaagcctaattacaccatgatttgatattatggtgctacagtaaacatttgctaatggtagattaattaggcttaataaattcgtctcgcggtttcctgtcggaatctgtaattttattttgttattagactacgtttaatactttaaatgtgtgtccgtatatctgatgtgacatgtagggataaattcttttgccaactaaacaggcttaaatcgagaacgagataacgatatactccctccgtactcataaaggaagtcgtttagcacggcgacacagtcttcaaaatacaattttgacttcttgttttatgaaagtatttttcaagacaaatctattcatataatttttatatttttaaacccaacaaatatttttaaacccaacaactagagagttattcatgatttatattttcaagatttgacttaaacattgtcctaaacgacttcctttacgagtatggagggagtggagtactctttgtagtttgtactatgaatcatgtttatttttatgggatggggaaagtacataacgtgttactatctattttgtattataagtttctttgaatttgttctgatcaccgacacgatattgtcttcaggaatgaacccccgtgccttcaccgactgcttcgccgctgcatggatgaagcaaccatctaggcggaaagaattaagaactcggaacgctttgtgatctctgcttgcaaacaagctttctctagccctactaactctaaatcaatgtaaaggcacgatgctaccgttcctcaggctctgtaactcccatattttcacctatcaatgaaaaattcaggaaaaaattattatttttttaaaagaaattaattaaatatatagaaaaatatagcaacatttctaacactaaacaaacatattattaaaatatatttaattatttttaataaaactaatttcatattatattgtagatgtcagattttcctataagtttgataaacctaaaatttagctttaaaaaagttaaaataacttataatatgaaatggagggaagaactaacattaatgaaaaactgatctttactcggatggcaaaaaccacatttgtcccggttctaattggatccgtactaaagaatatctttagccccaattcaaaagcccaatggcaataccaattgggactaaaaatcacttttagccacagatcaatagctgttaggccttgtcaggcccctaatgatctttaatcccggttggtgttactattccggactaaagatgcattaacacggactaaatattgatctttagttctggttggtgtcaaactaaagatatttttagtcccaattggtgttaccaacccagactgaagatgtctccagggttagtttaaaaattaatatttagtcggactaaatatatttttagtcccaattggtgtcaccaatctagactaaaaacgtttccaaggttagtttaaaaaaatcatctctatcaaagtcaaatatgtgtagtaggtgggatggtaacgtgcgtaaggaatgaggtgagaaatcttgagtttaaatcccacacccacagatttttctgacttgctatgcatctttagtccatgattagatgttccggttccctgaaagattactaaccgggagtaaagctctcttccccagcaatgtaactgggtaagtttaatgtgggtttgcgccgacagatcgatggaaggggtgagcgatgagccgcgtttcagtttgctgcacgccagtaaacccatgtgttcctgcattccctaatgtggtgtcggcgtcggtgtgcagtgtgctgaacttgctgtctgctgatatcttacaagctgggggccggataattgaaaacaaaacaggaggaagatattgcgatctagtataatcatgaatcgattattgcagaacagtcaattgttgttagaatcgctgctttatcgtaccaatgccacgcaacgtacagtgttcttgatagatctgagaaactccagcctacgtacgttggttggttcctgtcgtgactaggttaggattgattcgattcctcattcggttagagtttgctttggatagtaggtgataccacgtgagttgcagcgggcacataagtgaatttgaaaagatatgcaagctaaagaaaaagggaaattgattaaaatcgggcgaccgggggaggtgggaaaaatcggtcgctccccctcccccatgcgcgcgctcccttctccccatctggacccacccacttatccctccctttgttacacaaaagatgtttcaccaagtgtacttataatgtttcactatgtatagatctaatgttgcagtgaactgaaataatctattgtaacaaaaaatccacatattttgtaaaccctctatcaagggaatttggtttatttgttgttccaccgaaagatgtttcacctagtgtactcacaatgtttcactatgtatagatctaatgttgcagtgaacgagacattccattgcaacaaaaaacccacatattttggaaaccccctattaagggaatttggtttattttttgttccaccaaaaaatatttcacctaatgtactcacaatgtttcactatgtatagatttaatgttgcagtgaactgaaatattctttcgctatttgttgaaacattatttttatataaggtgaaacaacactcaatttaaacgagtgaaacatttcgatctagttagtgaaacaattccgatatacctggtggaacatcatgcaacatttaaaaataattcaataataagctattttttcgtcggaatttatccatgtgtggtcttgttttgaagatttaattgcaatgaatttaatggtgcaatcgaattatgatttggataagtaatttaggagaaaaatcagtttaaagtagttttgcacgtaaatcggacgctgacgtcagcgcccgatttttcttgaaatcatcggacgcccgagccgtaaacagccccaagaaaaagggacaaaaaaaaaggataaaagtactgatttttcggttgcatgatttaggacatcaatatatatagtcttcagttaaaagctgcaggaaagaacatcccgtaattacgatgatgaaatgcacttatgaatgtgaacagaagagaattaaagacagtttcatatcagctgagatcttctcctagccctttaccaagatgatccaatgatcaagatttttttggtgttgtggtaaacgtatgttgagattttggttcaagtatatatgatacatagatagatatagacatgaatggagttgattactaggactgagatatacttaggatgtactctctgtttcacaatgtaaaactttatagtactctatatatatatatatatatgttaatgaatctaaacacatacatatgtctagattcattaacatctaataaatatagacaataatataaaatcttatattgtgaaacggaggaagtaccgtatagcggaacaggtagaacaagcgatcggtgtaagcggctggtaagtataaccaacttaaggtcgatgatactataatacactataactaagttagatttagagagagacattcttgtcgtaccgtggaactcgacaaggctaaaggactggcatcgctcatccaccttttttttccctgcatgcattttcttttcgtgcttagctcatcttaatttctttcctttgcgagagcatgccaaatctaatgtggtgtgggaatacgatgaagacagatggcccacatgtttgttttattttatttatttatttgcgaaaacaaatttgaatatgttttatatatatatgtaaagtttatgtgtagaccctttctatatgtttaaactttttttgtgtataaagtttgtccccacaaaatatatatttataaattttcacatataagttttagttcctctgcttcataatgtaaatcattctaacatttctcatatttatattaatattaatgaatctagatatattgatgttaatgtaggaaatgttagaatgacttacattatgaaatagagggagtacatatataaagtttttatatattttttcaacacattgcttactgagcttgaaaactagtagactcaacagtccaaatgcaagcatatatttgggcacatgcggttgtgggctgaacgaggaaaggatagtacgtgggctataatgcttcatgggctgaacacgtgtcttcggccgcacgtaggttaatttttgtcatgttgcacgctgactagaggagcgcgaacgggcgccctaatgtgagatcagccgcgcggtcagtttctgatcctatagtctctttcatatactacatgtatatacatacgtatgcataaactttaggaacctcccgaactattgcgacagtacgaattacccccgaaccacaaaaccggtatattacacctcaatctattgatatcggttgaattaccccccccccccgactcaataatgagcggttctgctcctacgtgacatacacgtggcgtccacatggaaatccaatccaaaaaaaaataaaagaaaatacagggcccacctgtccttacctctcttcagtcttccccctccccc

SEQ ID NO: 21043 - DNA, 12809 bp, Oryza sativa
ccaaaggagaagagggagagacagtgagagtaatgataggtgggccctatattttgcttttttttactgattggatttccacgtcgaacgccacgtgtatgtccatgtaggagcaaaaccgctcagtattgagtcagggggtaattcagccggtatcaatagttttgaggtgtaatataaccggttttgtggttcggggggataattcgtactgtcgcaatagtttggggggtaaatcgtactttttcctaaactttatatataaagtttatacatatgtgtgtgtgtatatatatatatatatatagacacacacacgaaaaaatatccgtgcgttgctacgggtaaaaacatttttttatcctatatggctcgtttagttggaaggagtttttatgagggattgagagtttagagggatgaggctattaagtgttttatttggttgggagatatgagaattttggtgggatggggaattgagtaaggaactccctccttttcaatacctgggtaggggaaggtaattggaagggaattcctcctttagtttgtctaagcgaatctcagccatccgtttttattaatgaactaatctccaactaaactccctatcaatttccatcacctctaccaaacaagatattgagattaaaaatcaaattcccatcttaatctcatcatcaattccctcgtgtaaactcccaatccccttcccttgagttaccaaacaagccgatacattatactcccttggttttggaccggatgcttctttgtttttggaccggacattcattccttccttccttttcagctctagtcctagagtagtccactacatctatatgctcggcctatctctcttcggctcagcccacaagtggagctgtagccctagctcgaacagtcctgtgcctggcctacctctcttcggcttagcccacaagtgcaactgtaggcctagctcgaacagtctcatgcccgtgccatgacggagccaatccacccatcaaatccagtaatctggtcgagctcgcatagtaccgtgtccgtacgatggtggattcgatcctctccgtcaactcgtgcccgtaccatgacggagccgatccacccatcaaatccggtaatctggtcgagctcgcatagtaccgtgtctgtacgatggtggagtcgatcctctccgtcaaatgcggtcgaatctttctcgatctccaaaattgttgagagattttgatccactcgattccctttttcgttttttaccaaaatcaaagcaatccgtaaaacttggaaaaaaaatgacgaactggaagagaaattcaaggggaaaatgataagagagtagtggagaatcggtttttgcaatcaattggatgaggaaacacataaaaatgcaaatcgatatggtggcggcgctaggattcggcccaatggaaaaacagaaaaaaaatagcgaaaccagaaaaacggtgaaagaaaaaacggcgcaaagaaaataaaacgaaaaaaaaagaaaacggacgaaaaagcccggaaaaacggtgaaagaaaaaagcggtgaaaataaaataaaattggaaaaggaaaaaaaaaggaaacggacaaattttttttttggccgtgccgggcttcctttttacaatcgttttttgccgcacctttttgttccgcttttttaagtaaggataggaatcggtcagtttttttttgccgcactttttttttcgccccgggctttttttaattacaatcggacttttttaaaaaaaatttattaacagaggaaggaaacatcttaaactttttaagtagtatatataagtagatattctaatatgtatatacacatgtataatgtatgtatatggcatatacaaagtttgtatacgatgtatataaagtttatatatgtatgcatacaaaatataccaactttatatacgtatatatatacaaagtttgtacatctatatataaaaaagtacacatatacgaagtttatatacacgtatacaaattttgtatacgtatacaaaatttatatacgcatatacaaaatttgtatatgtttgtattaaaaaaaccgaaaaacaaaaaaatacggaaagaaaaaaaaacagaaaaaaagccatgcgccaaaaaaaaagtaacgatactgaaagaagaaaagaaaaaaaaaaaaagaaaccgcgcgtataaaaagagaaaaaaaaaagaaaccgcgtgccgcctagaaaccgtgcgaaaaaaacaaaaaaaaaaggaaagaaactgcacgccgcccacgcccccctctccacgcatgacacgtgtccagtcgcacgccccgcgcgactgatcgtctattagcgatttcgagcgcgaacatgcgcgcaataaatccacctcatgaaaatttatcaaaaatatcgtgcctttaaatgacttatctagaatgaatcttgatcttatagtgttttccatgtttgtatatagatgacgactgtgatgtcggttttatatcattaccttacgtgtaaggatcaaatgtctctcccttaatccacataggaggtatattattagtatccaagtgagatataaaaaaaggaatagttgtattgattataatataagtatagtgtgtacttatattataatcaatacaactatttttttttaataatcaccagagaccagaggggagaggtttcccaactaaatttccattgccatttgaagaggtttacaagtacagaggtcagttgtaaccagcggcacgccattacatgtgaagagaattaattgcggtgttgaaaatacatttccagttatagcaactaggcgatcgtcgtgcgtaagtcgttatagcaactattccttttattgcaacgtacattatatatttatacaccattcgtaccaatcacaaaatactttaactaaaaattataggtggtgcgtcctcttcagaagaatgagaacgaaatcagccgctatcatatatacattctatatatataaaaaaaaactgtacttacatgtctcaagccttgagcagttgccctctcgtgcccctcatgctgaactaaacaaatcaatttcaacgtcttcttgctactgtagatgacaaattcaaccggttaaaatcaaatataatacgatatctcttctcgaaagtcttgaggaactcgatctcggaatagtgagaattgccaatcagggaagcaacgccaacacatctgctggcctatgatctgatccgtttatctgcatcgccaactcttctctataaatacccttctgaattatgcttcctgcagagccactgcccagctaagctgcttggcttgatcagttccagtttcgagatggcctggctcggaatcggaatgggaaggcagattgttcctgttcttgttttcgttgctgtactctgcagcggtgttgatgcatcgttcaacaggtacagcttccccaaggatttcatcttcggcaccggctctgcagcgtatcaggtgatccatacagagataaatttgtccaaaactcttacatctgcaagaatggtttgaatcaagtgcaatgcacatggttcttggttagttcctgaacaaattcagagatgtatccttgcattgcttaattacttgcagtatgagggagctgctaaggaaggaggtaggggtcctagcgtcctagcgtgtgggacactttctcgcacatcccaggttattattattattaagtgttaacctcccactattatatatatagctggcatgtaaaatttaaaataggtgattaagggaaactattttcatgcctgcaggaaaaatcttaaatggtgacaccggcgatgtggcagatgacttctatcatcgctacaaggtagattctagtttttcttttaagtaaagtcaggagttcttgctcttgaaatgcattcataggaaacacattgttcggtattaacgcagtctttggaatatatatttacacactgtataagccttttctacagtaatttccccaaaaaatcgcagtctttggaatgcaattttaatgactaatttttgttatagtatactccagcctctagtaaaaaaaatatttgacattggaagaactaaactcagttctcccaacgtcaaataaatttgaccgaagtgagcacattataaaaacctgattttactatgagattttacccatatgatttccatgtgtcagtctaattatttaaaaagatattaactcaaggttttaatctttgacttgttgtatgtcaaaaaataaatgttttcatgacttgatggaccgaataaaaagtttatcttggacaggaatcttcttgaactgatcattcatttcttttgttgaaccttgaaaatgcaggaggatgtaaaccttctcaaagacatgaacatggacgccttccggttttccatttcttggagccggatcctgccaagtgagtgaagttaattctaccatctccggactgaattagttgacgttttagacagttaagatgacttgaacttagtatatggctgtccagaacgtcaaataattatgatcagaggaagtatttgagaatgggcattatatttcctagatcgtatcagcgcattcagttgcatttcagttttttgaccgtgaaattttcctttgtaaatgcctgttgaatgcagatggaacattgagtggaggggtgaacaaggaaggagtagctttctataacaacctgatcaatgaaatcatagccaaaggtgagtaaattttttcagttatgtcctatttacaatcatgtgttactgttactacaaaattataaatatttttttggtatttttaagtagtaaactttgaattaattacaaaattttcataacagggatgaagccatttgtcacaatcttccactgggacacaccacaggcccttgagagcaaatacggaggattcctgagtgagaatatcatgtaagttttttagatagagacaaagaaaatccataaacctgttaaaatcactcaacttgttaagctgatgatgaggttgattaaagttaggccattcacctaagtttcaaaagaaaaaccagttagatagaacagggtaggtaatttggtcatctgaatcaaaataaattgcttgtcggttctgcaaatttggctagaattcatcaatgactcacattaaaatttgtcgattatgcaaatttggctgtgtgcctgtcgaaagacaccggagatgtaaaccattaccattatcttaaaaaaatactcatattagagatttggattgtcaatattttcagcaaggattatgtggacttcgccgaagtgtgcttccgggagttcggcgaccgtgtcaagttctgggccaccttcaacgagccatggacctactgctcccagggctacggcaccggcatccacgccttgggccggtgctccccctacgtctccacctcctgtgccggcggcgactccagccgcgagccttacctagcagcgcaccacgtcatcctcgcccatgccaccgccgtccacctctaccgcaccaagtaccaacccacgcagcacgggcagatcggcatcacggcggtgtcgcactggttcgtgccgtataatgacacggccgctgaccgccgcgttgtgcaacgcagcctcgacttcatgtacggatggttcctggaccccatcgtgcacggcgactacccaggcacgatgagggggtggctcggggcgcggctgccggcgttcacggcggagcaggcggcagcggtgaggggatcctatgacttcatcggcgtcaactactacaccacctactacgccaagagcgtgccgctgcccagctcaaacaggctctcctacgacaccgacatccgcgccaacaccactggcttccgcaacggcaaacccattggtccgcaggtacgtacatagatcgactcctcctcaacaccaacgcatgaacacaacatcatgttcttgattttcttgagaccgatcgatcaatccatcaatccacggctgattaatttcttccaacattttggcaggagttcaccccgatcttcttcaactaccctccgggtctccgcgagctactcctctacaccaagaggaggtacaacaacccgatcatctacgtcacagaaaatggtaattaaataaccatctttgttttcattacacacgagataaatacgtgcactacactcacccacgagtacgcacacttctagcatacgctcaaatagacagggactaatagcttatcctaagctccactaaattcctattgaaaatgtactcatgtatgcataatattcatgagcattaggatttataccgccgcacttcccaattaaataactttctcattgtaatggctttaacttctttttgatatactagctgaatgcttgtgcattgcaacaggaattaatatacggctttaaaaccacaaatattaaaataaaattatccccattataaatcattccacattatgtttttcataattttgtatctcactttaaaataagttttccttgtttgatggcttctggccaaggaagggataaaagtccacctatctcagtatttaggggacccatatggtagtggtggtgggtggtggcagattcaccactcaccattatcattagggtcttttaaaggagtatagataagtagtacactctttatatagattaatttgaacttgaagttgcatgttttgtgggctgatacatttgaactacattctcattttttttgctccaaaactttttcacaactatttggatgacatggaaatgaaaaaaaaatacgaggggatcgacatcctgcaagatgactttcatgtgtgattgcaggaatcgccgaggggaacaacaagagcttgccaatcacggaggcgctcaaggacgggcataggatcgagttccactcgaaacacctgcagttcgtcaaccacgccatcaagaacggggtgaacgtgaagggctacttcacctggacgttcatggactgcttcgagtggggcgacggatacctcgaccgattcggcctcatctacatcgaccgcctcaacaatctcaagcgctaccacaagcagtccagctactggatcgccaacttcctcaagcggaagaagtactgagtgagctaatggttctagctaagctaagctagctctctgtgcgattttcagtttcagagtgattggtgaattgatgtactgtacatgcttgaccaccgttgccattgttgagtgagggggaggggataaagctcattgttgcttgagctatttgatttaccaattggaattcgtttcggttgtttgttcgtcgatctggaggaaaataaaacaaattctcgtctctttgtttcatctcgttttccactggaataagttcactttacgtcctttatctagttgttgagttcgaatttcatcccccaaacacaatgccagatataacgtgtctctcaacttataaaactgttgtagccgagatcccaaacagtataatgcttggttttagcttatgtgacgagtgagccccacatattaggcctatttctttttggtactctgaaaatatgcagacatgtggtcagtgcacaggctcaaaagacaaaatctgcaagttcattttttgccgaagtatcgcctgtaattcgatcattctgatgaacaaattcggtatggttttgacaaatctagctcaaatcaaaagcaccatggcaattttttgagaggagtaaatgcaaaaccatactgacctgcaggctgcgctggttaaggcgcttgacggcgcgcgaggacgacgcggccgccgccaccggcgtccgcgcgttcttggcctttgctcctgttgccgctcttgaacgcgaagcaccccatatctgatgggctagcaaattaaatcagagaagagacctcctgcttgttgattaggatggatacatccaaaaaataccaacaactctactaaaactaaaaaggagagatttataattttagttagcaatggcaggaggttggagaggacgagaaatatgcctgacatgtgagacccacctagtcatgttagttaaaactggacactatactgtttagaatctcgggtacaggttttgcaagttgagggactgccccctcgttgttgtacgtggtattgtggttcgaggaccaaagtcgaactcggtgataattcaagggacctaacctgaacttattacttttctactactgctcttgttgtgttccggcctgaattggctctcggcccagattgatggacaaggcccatgagaggcccgctgctgggtacagtgaatctggacggcttcctcggcacctaacgagggggtccacgttcaatgaatctgccctttcagtgaaccttagcaaatggccaaaaaaaaaccaccaaaggtgccatgcacgaacaaacaagctgctaccagcagtactcctagaatactaccagtagggctactatcttatccataccctgcaagtttgtgttacttgtataactttgcttaatcttattttttgttttgctaaatcaaactccttgatccttaagaaacgtgtggctctgaatctatttgacctcaaacttaagtagtgttagtttttatagccacttgacgatgacacgtctgacgacgcctctgccagagtacaaccacgaggtctttcaagtttcatggtcaagacgacgaatgcctgacgctcaccgttcgcagcgccgcgcgccgccgccgccgccaccgccgtagaaaggatggaatcgatgagagggtggggtggttgagacgggcggtctccgggatggggagtggtcgtagccgagcgagaatccgagattccgagcatgggttgacgctggaaaacggctctacggaagcaggaaaagtcactcaaggaaggaacgtacacaaacacaagcttgggggtgtccagtgaacattgatgcatcatggctgaccccttgagatcgggatcctttgtggagaggaagaggtttcacatttctgtgactgttgggttggctgagttatacgggctgtgttgttttggaagggttgggaaccctccctttacacgcaaaatgaagcaacaaatgggttatagtggtgctacggccgcggctaaatttgagcgtgttttaggagacacactcgtggatgtgggagtagtgtgcgtcttttgtgtaataaaaaatgatactcccataaaaaaataaattaactctctacgttaatgtctagatttaggacaaaagttgatttatcttgacacagagggagtatattatattctaacaacaatgagaaaaccactatatttgaaaatcacgaacaaatcttcgcatctttctaaacagcttaactattttaactgtaacttacgacaagtagttggtaaaaaatacatattctaacccagctatcatctattataaattaacttgataaatgaaatttatgtgaaatgacacacactccaacattttttttttcaaaaaactagctaaaacctgtgtgttgcaacatactccctatctgcatatttcataggtataccaagaccaagaaaagctaataactctctcatactatatttactctagcaacaaactcaatgcatacaccatccccactattttctagccaatagcaaatcaagatattgcatgtgggttataaatgcttgtgtgcatggatgcatgcatcaatatctatttactccaatgtacaaataacgaatagtcctaatgaatgaacgcaaatatgtagatcatttaggaataacttaaaaaaatatatatgcagattaatttggaatggagggagtatattttgagaaataaaagcaaaagcaaaaaaaaaacaagtttatagcatggttagatgattaagcatataatgtcatctccaagggcagccacactgaaaaaatgcttctagatcacctcgttttatcctctccgactatgttcacgagtcatacggtcggatcatacaagattggagactcttataattcatttgttggtagaaggtgaatttgaaggttttgtacgtaaccctttacaatttctaaaattagtaattctggatcatttacgtgtaacatcatttaaagtggtatatagaattagctttcccaactcactttcctcgttttccgtacacatgcttaccaaattgctaaatagcatgattttgcataaaaaaatatacaaaagtttctttaaaaatcatattgatttatttttttaaaaaaataattaattcttactaatggatagctccgttttacatgtttggaggagagttcccaactccaacttactccctccgtcctaaaataagtgcagttttacactattcatctccaacgtttgatcgtttgtcttatttgaattttttttatgattactatttttattgctattagataataaaacatgaataatactttatgtgtgactatttttttaaaaaaatttcataaatttttcaaataagacgaacggtcaaatgttgaaaacagatttccatgaccgcacttattttgagacggaggtagtcctagacaacacagggctgtgcacagagtggaccggagcaaatgggatctgcgagcctttctttctttccttccctacccctgctcccttcctcctcagcgctagcctccctcgtgtttcctttccctttccccttttattttttctaaaaaaagggaaacacggaagagaagcgaatcttttccacctccactgggcaaaaaaaattaaaaaaataaataaaattccccattcccccgaacagattgattcgcttcgattcgagggaggaggggagcacagcgatttcttctctctctttcgccgtcgcattcgcctcgcgccgcgccgcgcacaatcccatccgctgctgcccaagtacgcgcccgccctgctgattcctccgatttctgttcgttgtttcggtgttcctggatgagtcggggtggatggatggggttttggttttttggtggcgttaatcctgtattggtcttcgccttttgcagggcttgtttcgcggattcggattggtgctgactcgctcccgattggcaccgggaggtatgaattctcgctaggatttcggtgggcggattgctgacgaggagagggttgggggggagtggagttggatgtgatcgggttgtgggaaatccctagtttgtggtgttgtgatggatcatctggctatcattgcgacggagttgggggattcgtcggacttcgaggtggagggcatccagaatctgacggagaatgatgtcagcgacgaggagattgaggccgaggatctggcccggcggatgtggaaagacaggatcaagctgaggaggatcaaggagaggcaggacaggctcgcccttgcgctgcagcaggctgagctggacaagtccaaggggaagccgatatccgatcaggccatgcgcaagaagatgtcgagggcgcaggacgggatcctcaagtacatgctcaagctgatggaggtgtgcaacgcgcgcgggttcgtttacgggatcatccctgataaagggaagcccgtgagcggcgcttccgacaatattagagcttggtggaaggagaaggtgaagtttgataagaacgggccggcggcaatcgcaaagtatgagtcggagaacttggcgtcggctgatgctccgagcagcgggatcaagagccagcacagcttgatggatctccaagacgccactctcggttcactgctttcgtcattgatgcagcactgtgatccaccgcagcgcaagtacccattggagaggggcactccacccccgtggtggccttcagggaacgaggattggtggattgcgttgggccttccgagggggcaaattcctccgtataaaaagccacatgatcttaagaaggtctggaaggttggggtgcttacaggtgtgatcaagcacatgtccccaaacttcgataagatcagaaaccatgttaggaaatcaaaatgcttgcaggataagatgactgcaaaagagagcctgatttggttgggtgttctacagagagaggaaaggcttgttctcagcattgacaatggcatgtcagaggttactcaccacggtgctctggagtacagaaatggggacacacacagcagcagtaatgagtatgatgttgatggttttgaggaggctcccctttcaacatcatctggagatgatgaacaagatctttctccggctgcacagttgagcgaggagcatgccccaacaaggagagaaagagctaaagtcaaacgccctaatcaggttgttcctaagaaggcaggaacaaaagaaccaccaaagagaaaaagaccacgccacagtgtcaccgtaattgagcaggaggtacaaagagctgatgacgcatcagaacattcaaggaatatgattccagatatgaaccgactggaccaggtagaaatccaaggcatggctaaccagattacaagcttcaatgaggaagctaatacgagtgaagctttgcaacacagaggaaatactcaagaactggcccatcttcctgccgattttaatcactatggcaatgcgcaggcaacaattgctactcctgtaagcatatgcatgagaggccaggctgtaccttatgaaagcagtgacaattccaggccaaaaactggaaatatcttcccacaggattctgattcaggctttaacaatatgcctagtagtta

SEQ ID NO: 21044 - DNA, 952 bp, Oryza sativa
ggacacaagcgcgcgggcctccgcggcggcgccgcgctccggcccggcgcgcgggtaagaagacgagcgcgttggcgcagagcagcaggaggtcgcggtagaaatagagaagcggaggcgccaccgccgccgccaccggccggcgacgcgtccagcctccgccgcaccatctcgatgtccacgtggcgcctgatcgcgccacggtacgcgtcgctctcctgcaagtggattttaaaaaaaatgaaaaaaaagaaaaagaaaaaggaaaaaaaaaggagaaaatatctgtgggggcatctggctggaaggcaccccacccgcccaactgattgctacgctgcacccaaccaaccacgcagaatgattcaaaccaaaaatcgaacaaaaaactaggaactttcaaattcaccatgagctaatccgatttgaaactttcgcgttcgttcgaaggacacaaaaaatatgaggtgtgcacatgcgtctcacctacctaccacacaacaaaccaacccgaattcataagcaagcgatgacgcacacgaatttttctggtcacgtaattcggattagtgctagtgctatgtcatcatgccacatgcgtggccctaatctaatccataataatctagaggacccccgttaattacggatgggtcccaccctctgacatatcgtttgaaattcccctctttacccctcccctaacttttgaccggcggcggtaaaaaacaaagggtaaaaagggtaaattgtaaatgagcggtaaaattcatttttacctggctttcgtgcagccgctcgagcaggggaccgaacctggcggcgaacgtgtcgagcagcgcggcgagcggctgcgacgacgacgacgacgacggcgactgcgagggcggccgcagcgcggaggcctcctcgccgtcggcgtcctcgtcggcgccgggcttgtagcggcggc

SEQ ID NO: 21045 - DNA, 444 bp, Oryza sativa
acgcctctgccagagtacaaccacgaggtctttcaagtttcatggtcaagacgacgaatgcctgacgctcaccgttcgcagcgccgcgcgccgccgccgccgccaccgccgtagaaaggatggaatcgatgagagggtggggtggttgagacgggcggtctccgggatggggagtggtcgtacccgagcgagaatccgagattccgagcatgggttgacgctggaaaacggctctacggaagcaggaaaagtcactcaaggaaggaacgtacacaaacacaagcttgggggtgtccagtgaacattgatgcatcatggctgaccccttgagatcgggatcctttgcggagaggaagaggtttcacatttctgtgactgttgggttggctgagttatacgggctgtgttgttttggaagggtcgggaaccctccctttacacgca

SEQ ID NO: 21046 - DNA, 404 bp, Oryza sativa
ttgctcgatcgatctcttgatttgtgttgtgctcatggatgatgcagagaccctcaacatcttcccttcccagcccatgcatgtggagccatcacccaaggtatttaattaattttacttactttcatctgaatctcacattggttatgtcatttgtcttttcaatgtagcactcgtgtgtagtatatatgaaatcaaagatgggtttaatgtttgtggatgtgatgattgattgattgatttggcagggagagattagtttagtgctgtccccagcagctgtgggaaccaagatggcgaggtcacctgatcatcaccaccaccatcagcagccaagcagcagcagccatggaggatttggcgacagggagcaggagacaggatcaccaccacctgcagcacca

SEQ ID NO: 21047 - DNA, 538 bp, Oryza sativa
  unsure (1)..(538): unsure at all n locations
ctttgtttaggttttcgattgtttgcgtatagtggcggttatcggattttcgtcgatcgcgggttttctcgaagattcgtgaagcttcgtgaagaccttgagcaaggcaagtcaccctttgatcaattgctcctataattggaaagtcattattattttgtttgcaacttgcatcattagaatcactcacgtttaacttgcttggcctcggtttgcatgccaaaccgacggacctacccagtagtcgcactaattcctgtaggttgtaccaccctgattccttgtcgctccacccttgtggtacctcggtattcgtgctctctgagcgcgtataccaaatatcccacatacaccgttgtttgtcgaaaacttgggaaatgggtttgtgaagccttcaaaaacccgacattgtgtggtggttccccggggggtgggtggttttnttgagaaaaaaaaaaaatgaattgtgaaaactcacgatgcgggggttgtgcctatgtggcactgtcccgtattcgcatataaggaccgattcctg

SEQ ID NO: 21048 - DNA, 3856 bp, Oryza sativa
agggaagcttatcataaagggcttcgacaaggggttctattcgttctttgagcaaaaagataaagatcggatagattcgaaccgcaattgcaaaggtaattactactatgccagcctaaatcatgatcttcaccaacttggatttggttctctcgcgaaaatcgcgagttgcagatatgagaacctttatgtgtgactattttttttaattttttcataattttttcaaataaaacggacggttaaatgttggatacggatatccacggctgcacttattttagaacagaggtagtataattcaaagtttataaattatcacctgatcaaatgatatgtctgttaatggatagaaccgaacaaccagtccacatgcgcatccgcaaccaactaacaaaatgtgaattatatattctcaacttgagcatgtcaggggaatgtttttgtgctggagcacctagctagtactgtatataatttcggtgagctgatcaaatttagaggtggatttggctgaattattgaacatatatatttcgtcaaaaaacatataaatttatatcgatccttatatatatgcatatatgtaagtatgggacaacctagagcttacaatgctagtactagtctgcaggtatacctaaccctaaccaatcagctaatcaggtcgatggttgcaccgtcacatccgttattatacagccaccgtacgtacgtatgcaaactcctactacatgcctgcgcatgtgaaatgccagcatatatacactggcctctactactgtacgaccgtcaattgttgcctcagctgcattttataggtgtatgcatgtactgctgtacagggggtgtttaaatccagggtgtaaaatttagacgtgtcacatcgggtattatatagtatagagtgtcgtatgggttgttcggacactaataaaaaaactaattgcagaatctataagtaaatagcgagacgaatttattaagcataattaatccgtcattagtaaatgtttactgtagcaccacattatcaaatcatagagcaattaggcttaaaagattcaactcgtaaattagtcacaatctgtgtaattagttattttttagcctatatttaatactttatgtaggtgttcaaacattcgatttgatagggtataaaatttttgtggggaactaaacagggccatagtcatatatttatgctggcttctacttcctccttcaatttatatatcctctttacattgatgccatacatatgatctcttcatctgccgagccatttgaagtggatatacatattgacatggaataaataatttatatgctcgctcgccgagaaggaaactgaaacatatatttgttagttaatctgagccttggatgagcattaattcatacatgtataccgaaggaagaactacatgaaggaagagttgtgactaatatttatagactgaactaaccgcacatgcagcttaatgataaacaagcactagcttagctagctagctgcattacaatccgtgtatgattagtttgtttcatacatacatacacatataaatgaggggaaaaataaaatctgttcataattttgtcctctcattagaaggcttaattgctggctggttatttggctaacgaacccacatgccatatgaataagtggtttaatttttatctgattgcgcaggttgcaaccaaatgctcctagattaattatcaccaacagataaggtgaggccagcgggataaattaactacttgtgaggttgggtatgttgagtcttcagaagtcgttatattttgagataaaagttaaacttcagcggtatttaatttatattttggaacgggcgagtaattactttgtggatatatatgcttaagctaagttaatttgtagggtcgggcgtacgtggatggataagattataagagagggacctgagctgatgctgcagatgataggggccacgaaaatgaaatgtgatacatatatagcagaggggagagactatgtatctagctgcagcctgcaggtttatatcaacctagctctggagaagcagacagagagacagacatacaggcatcatccttgatcccatgttacacgggggtctctctgtccgaaacctgaatgtccttgcattgcgttgcattgcattggggccttctgaactactactctaattaatcatgtcgtccacatgcatgtgcttggctgaatgagcagctgcagcttgttaattagtactccagtttgctaacccggccgtcaacggatatgggagattattatcccttgccatgttcagacaacagatatgtttcgtagccgtgacatagaaactactagttcaaactgcagatatatatggataacaactctgaaatcgtaatcaatcgccttgcatggctgctatggcagtgggtcaatgcaagcaagaaagaaagattaattaacttgtatgtgtagtattcgcacagccgttccaaacaccacctaattagttgttaataattaataatgtactgaactatcaagcaaattaagctagttccatgagtgagtaggagtacgtcagtacgtggcccgtgacggtaggtaaggttccctttctttccttgtcaatcgatcaatctgctttcccttcctttcatccagggaattcaaggatccaagaatatgtacactttgctagcacttgcctttaatccatcagtccaactaattcatcacacagttcagttattagggaattatataagccaccaccacaaattaattggttcacaatatgtgtccagctaattaagatcaggtaccgctaattaagatcaggtacccaagtatagcatatgtttagtccaaattaaattaactagttcatgaggactacagcaagtaggtagcttaccaactctatgggtgaaattaaacatatgatctttttgtgtgttttgagtgttagttttcgactatcatgtctgcttgcatatatagatttttatcgatcaaattttgtgatgagcagagcagtcactgccgtgctagctaataactaacctgtgcgtagtgtgtatacgtattttctcataaatgatttgagatgaaaagaaaaagcagaggagaggagctagctaattaagcttgaattatatagataagtgcagtacacgtaagtacgtgacagggagcgatggagagacgaaagacggcgactgcacaacagatgaattgatggagtatgtatttaaaagcctcgctggcgatcgatcgattatattgactgaagagtaatctctgatggatcgatttttgaatcccaaaattaaacgatatgatatgatagagacatagcctgtatccaagttattcagttatacaactactaactcctgctgaacaaacctcatgaaaacttttaagccaaacaagtaattaatcatgcatctcatgagctcacaaatattatatgacgcaaccaaagctagcgtagctagctactcttgaagtggaggaaggaagaatatacatgtgcatatgtatgtatggtatgataaacttgactaattataccattggatcattgttaaccagaaatggtataaagaagacgcatatttttctttctcttgcgacggtgggcatgacagagacgcagcatatatagatggatggcatccgaccaactccaattggcgacgtcgtcttccttctctttccgcccgccacttcataccgccctctactcttgttgcttagctacctagctagctagctttcctcttcactccatccacccacgcacctcaatcgatcgatccttcatggcggcgg

SEQ ID NO: 21049 - DNA, 5065 bp, Oryza sativa
tacgtacgtattactagcattcattctagctcggtgatcgatcaaaccatgcatgaattgatcacgatatatgtattgattgctggtgatgcatgcagctgtctaatggagatgtgttcgagaagacgcacgacgagctggacttcgagttcttgggcaacaggtacaggcacgagtggaagatgcagacgaacgtgtacggcaatggcagcacggaccgtgggcgggaggagaggtatctgatgccgttcgacccaaccgccgacgcccaccgcttctccatcctctggcactcccgcctcatcgtcttctacgtcgacggcgtccccatccgcgaggtcccgcgcaccgccgccatgggcgccgactacccctccaagcccatggcgctctacgtcaccatctgggacggctccacctgggccaccgacaacggcaagtacaaggtcaactacaagcgcgggcccttcaccgccgtcttctccgacctcgtcctccgcggctgcaccgcccgctccgacatccgcctcgccaccaccgccgacgaccaggacaggtgcgccgcggcggaggaggacctcatggagagcgacgagtactcctcgaccatggccatgacggcgaggaagcggatggcgatgcggcggttcaggcagcggcagatgctctacaccgtgtgctacgacaccaacaggtacccggagccgttcccggagtgcgacgtcaacatggcggagcggcagatgtactggcagtggggggagtccaaggtggttcgcccccgcgtccgaccacgacccggccgccgctccaagcgccgcccctcgccggaggccacggccatcccgccgcccgtgctcgtctccttgcagcaagctgactagtctttgattagaatattctattctatgatgaggctctagctccatcataattctttgattaattttgcttccttcacatgcgtacatcgatcatactgtaattagtaccccctgatgatagagattaatttattgttactgctgcttcttcacgacgaacagttataaccgtggtcttaattaaccattaactataaatctatcaataggtaatcctttgttggtttatcctatttgatgtcgatctggctatctgatcattggtacaagtatgttgttagttggattgatgcttaattagttagtgatggtgcgatgatggattgatgagaagaaagcagctgcatatacagaggtactccagttgcttatttggtcacaattgaattacgtgctactactaattaattgcggtggttaagtgtgcatgtgggagttgagagtgagccgcgcgcaggcagtctgcagtacgttcgatccaactcagatcagataatcgaaatgcgtacttgttgtggttgatgaatgatgatcgtattcgtatagatatagctaatatattccagccagctctgccctgtaaagttaagtagaggagataatgatgatgatgatgcaaattcatcccatcattattggcagtattaagctataattaggcagctgatgctgcaatgcataatgcttgttccaacttctccatccatcgtctgcatgcgctggtgctttgctgtcttccatttccacctccttttccctcaaccttttgtttttgtttggctctgcctcaggctcagctgggttggtattatgcgcaccgaaagcaagcattgcaagggcattgattcaattaaagacaactaattatacattaatccccaggaccgtgcatattattccatcgcttcccttcatcccaaatactacattacatatgtgttgtactatactataatgatgattccataatgataataatgttgataggtactctacatggggtttgtaatctctgtcccagcaggcaggcattccccttttgacaaaaatctgaaaccacttgcggtttaaagccccctttctctagtgtctagtctggaccctgcatatcgtccaatccatacacagattgataatccccgttaattttctcctaacacaatactaccacatagtatatttcttttctgtgcattccaaacagcccaaacaaacccctgtttgtagtctattctacctgccctcgttgtatgtgtgggggcgatgttcattccccccttttttcctctgcacgaaaatgttggctgggtcggcacctaataaacatcctttacgaaaaaaaaagagaaagagaaagagaaaaggaaaaagagagaaacgacgcgagtttatcttatcacaacagggtagacaataaaacaaagagcatgtgacgactgcttacattttcccgacataaagtacaccccctgtgacaaacaaatcaaactagcccagcatttcactaatcattcaatcatttttttaatgcagtatcaaacaaatactaatccacaacttttactacttaccaaaacattgacccacgcaaagctcttactcctaccaagtcaaaaaggaaataaaagcattgttgaaaacaaaggcacctcctgatgaattgcccatgctgcttttcccaatattataccaaaatgctggaaaatggactctaaaactatacagacaagaaaaatgcaaccaccatgattcaataacaatggcttctaatgctaccaggtcagtgcacagatgaacggcttgtaccacttaaacatgacattatcagttgcaagaaatgcttcaatcttatcttgtgcaagaggaaaaatacagcagaataaatgcaaatgtgttttcaaataacactggtgaaaaggacttcgattgattcaacctgtcttattaagcatatcatataagttgctgagttcagtgaagttatgagaagtgccctcactttcccgttcggctacaccggcaggaatcaatcaatgccagaatctgaaacagtcaaagttacttaattttggaatcaatacagtgtggcagactgccagtactaccagaagttagttgcaatcagatagagcaggcaagaacaaaaaaaaaaagctatcagtagctacaacacaaagtagctatcatacagatttgacaagttaccattgatcaattcttacgcctgccaaacctagatacaagcaggtaaacccctcgggtaaaccgtgtttcataggtggaagattagtatcctcccacatatagggtgacgtttcagtattgtttcagcaaaatgatagaacataacatagacataagggtaggtgatgatgtgggagtttattaccgagatcccagggtaccttgacaaatggtggctaagtatgtcctattgtacctcatcatcctgtatggtgtgatgacaggaggcccatctgttctgtaaggttagccatgttttcagctttggtccatccattcccctgttgtgtttccttttggtctagtacacctgaatcgacttcatcattatcaacagatagagggctagccaccaggaactgttcccagaaagaatcaatgatagcaggaagtttctgggtgtcatcgttgtacaaaatctcatcagtctcaatgggaacactatcatcaccttcttcaggcaaagagaatacaccctcaggaccaggcatttcaaagccccctccaggaatatcaacattttcttcagctactatatcttgcaaatctgggaattccagaatattgatatcagttgggcctggagccacagccttcggaacagaaggcaccgcactcatgtttggaacttctttgggtatgccgttgtccaaaacaactgggcactgaatctgaggagtcgaagttgaacaaatagctgaaagtccagagcttgtagctacatatggcaaacctgagttagctgggacctctgcaagggtaacaccagaattccgagttgatgaagagctgtcaagaccttgaccatttggcatataattctcaagaaggaaattatctgaattgcccatggattcaaatctatgtgaagaatctagctttaggatcttccttagcatcgctttggctgcttcattgatcataggttgatattttactatttgtccatccaatgaagcactttcagagtccaacgaaccatcctgctttggtagcctcctctttttgttactagcaactattcttcttctgctgttttcgttttgctgtacaaattgtgctaggaagccaggactatgcattgccttagccaggaaagacatcatttgttgttgccgttgctccattccttgaagacgcttgcccaaagtctgcagctgatgatctgttgtctgctgttgttgtctcagcctgacaagttcctgcattaaaacatttttatcccttttgagcatctcaatctcttcttccatcccaaacttccccacttctacgcaagcaggtacaggagcagctggcaactgaggctgctgaacttggttgtttccatgagttggtttccttctgttgatggtcttcagtagatgcttttgtcctctaagaaaaccttcgtttgcaaactcccacctatatggatcaactttcctaaatccctgctcataagtgcaccaatgagatcgttagaggccggctaacgtacatggcacagtgtatctgcccggtacaagtacttctgactgaggtgtatatggattcagaagttagtaatttctttagaggggttaatgtaaaaggccaggttatttgtttgggttaagtgattttgagtggattagcagggtcaagaaaggatggacccaagaaaaaacaggccaggccaccagtaccaactgtccatgattcacttaaaactgtttgtagttcacaaggaaacagctgattggccacattagggaagaaaactaccacaggatgcacaagcagtactggtgtaatagatatatttgcaaatgccataaaggccccagccaactgaatagggccaataaaatggtagttgcaaaagcacataataaccggggggttggttaattcagcttgagaaaaatttatatggccaagaagaaagttatctatcttgcctggtaataaagttc

SEQ ID NO: 21050 - DNA, 6596 bp, Oryza sativa
aagtaagaaataacttcccaaagcagctaaagcaatagtggagggatccttgtgtattttgagtagagtaggaagaaagaggaatgggggggggggggggggggacctacgtaggtgttgagctgcctgacgaaggaggagaagttgctgtgcttgaagtacttggggaggaggtcgcgcgcgaactcgggggtgttccacacaacgaagctgttgttcccggggccccatgagacgacggcatcggtggccgggtcgtccaccatctcgtacgtcttcatcaggaacggcggcggcgcggtcgccaccccgttgctgaccgccgcgccgggcggaggcgcgaccgccgtcgtcaccgccccggcggccgcagccgcagcagcaacggcggcctccatgaggcgatccgtatggggaggcgtggtgagggtcaggggcgcgacagcgtgagcatgggtagggttagggggaggcgtgggatcggggcccgtgggtagggggggatttgagggtggggaatttgggatttgggttgcgggcggcgctaggttttttgggggctcgtcgtcggctgctagtgggaaggagacgagacgagagagagagacggcaggccgcagagaagaaaccaacccatccacaagaacaacaggggatgggccttttcttttcttttttctccgacgagggtgtttctgtaattttgctcttctttgctttgccgctgccgctgcggctgcgactgcgacctacctaacggcgctgccccgtcgccgtcctccactccgccgtaaacatatctgtatcaatccttccgtttgtttgttcgcacgcccatgaaaattatccctccaaataatctgatttttatcttaagaataactttttattgttttccttgcggtcaccttttcttaataaaaaaaaactttttttataacaaacaactattgtagaaaccaacctataatacaaacatgtatgacacctacacctagctagacatatgtcatacgattgatacattgcatatacgcatgaaagcgaacttcaggcaggcaggggtcatctcgccactatcctacttactcatagccttatcctacgtattctctccgttcccaaaaaaaataaataaatcttaacacaaacatgttcgtttcgttgtaaattgtaatatgatatatcaagggcatttttagatccatttgaaatagcaaatagcaaatagcaaaagttttggtggcaaaagttttggcattgcaaaagtactagttggtgtttagatgcatcctaaacttttgccattctagcactttttagtggagagagagaggtcccaaagcactttttggcacaatttgctactatggcctagcaaatggtaaatggcaaatcgccaacttttgctactagtgtttagatccaaaatagcaaaaagtgctccaaaatggcaaaaggatctgaacagggcctcacatttatgcgtaggtttgtttttgaaattgatgaagtacttactccctttatcaaaataaactaacctcgtccaagacatgaaacattctaatacaacgaatctggacagtatgtctagatgtgttcagattcgctatagtagagtgtgttacatcatgtacgacattattttttttatagagagaggacaaccttagcttaactatacagagagataggactagacatgtgatgtgtctgtcccgagaagatatgtcagtggacttcatctaccaaaagcatcctccttttgagattgtgaatttggattcgtctttctttaatcgaaacacgtttagattcatccaaccctatctgatcccactcaaaaaaattgctattgtgctatcttcaaacatgggttttgccacatatgccattctgcattttagcttcgttaaattgccactttcaaatagatgttacatgctatagtgtccttgccatatgaatggacggaaatgccccttgtcctctttttctctttcaaggcttggaccgttgtcatcgcgtgctgctggagagggacatagacatgtgcattgtatctagccagcccgctgttggcaccccattgtcgagccgcgcgtcgcccggctacacagccatggttcttctaatctttatcgctcctcctgcatcagcgcgacggcgaaggccgttgaagaaggacacggacgaggacgaatgtacgacaacggtggttgtagttaggtggcatgacagaggtttggcgggggaggggggatgaaagtggcggtacattaagttggtgacagtggagcgtaggccgacgtcggtgagccgggatggtgagcatgacgtttggtggccgctggcaagcacctccaacatatgttaaagggaagggagaagaagtctaagatcatgttcttttctccaataagagttggatgaagattaagattttcatggcaaacttttcaaactgctaaacggtgcgttttgtacgaaaactttctatatgaaagttgctctaaaatatcatattaatcaatctcttaagtttgtaataattaaaactcaataaatcatacgttaataccacatcgttttgcgtaaaaaaacttaatctccatgtttatctttgagagaaaagaaaaacacctaagggcattatcgtctgcgatgatattctagcgcaacacctaaggagtagtagatatcaattgacagtggcaatttagcaatttactcgatcgccaacttcatcatcgtcttccttggccgccgccacattctcttcttcactttaccaatttccttgggatcaatcaagggtcagtgagcagatagatgggcatggctcacgtcctcagcctcctcgtcgtcatcctcgtcgcaatcccctcttctcgctcgcacgccttgccgtcctcctcatcccccttcgacgccgcgctcgccacgctccagaaccagatcgcctaccgcttccatgccccggacctcctgcgccgcgccatgacgcacgcctcctactcccgcgagaacggacgcgcgctcgccgtcctcggcctcgccgcctcgcagtccgccgccgcgctccgcgccctcgcgggcgaccacgacgcctccgccttcgccgtctcccgccgcgcccgcgacgcgtccggggaggccgcctgcgtcgcggccgcggcccgcgtcggcatcccctcgatcgtgcgcgtcgccgccgggaccaaaccgaccgccccacccgtcgtttgcggcgccctccgggccctcatcggcgccgtcgccgtcgacgccaacagcacccacgccggcgaggagtcttctgaaagctgcacgtgctcacccgcgcatcagccaaagccgcaatgtgattcacaaatcagactgatcgttaatttaaattagtgctaatgctgctgcctgctgcaatatcatcacactagatcgttaaatgtactcctactacttagtactatcaactagtagtatgaactgtatcagttgcttctaatttccagtttgaactggagtatattagattatgtaagttggtattatgcatcctaatatccagtccacgaatgtgcatctgcttacatactcgagttattatctggaatatatgagatgaatcatggaacaagacttcatttttatcagcacctgtaagcgcttcagcatcggttttacagtggatgttccaagtttgcatttagcagcacttatacacaaaatggtacgtacctaacatcaaataatttgacaatttaactggaatgctgtagaaagctcatgtccaagcatattgatgctctcacaggggacaactggacaaggttggcacatatgcagcaaccaaagctaaaatgcaaatatttcaatcaaaagcagaatgaatgatatcagtgcacgatgttacagggaaaaaacaacattaatgtcagtatacatgagcgcaaactttaatttaagtaatacagtactacgaatttgtatcagccttgcatttcaagatcactcttgcatggggtttaacaatgtcaggagctcattttgtccaaaatctgactcaacccccttgtacaaagacaggatgacaatcttcaagttaaggatggttacttctttgcttttttgctccgatgtgtattttcaggagtttgagcatccaacttgcgtttcttggctagttgctttgccttccttgctgcaacagcagggcgcttggctttttgagaactagcatcatgtcctgtctcactagtcctgccttgctgcttcccctggtaacttggacgctggctcaccttcgccttcttcaccacaccagatttgcttgccctaaggccttggtatgacaaagttgacgccttccgtttggtcttgtcactgccttcatgggatttgctgcttggtgttaaagctgtcttgtgtttcgatccaccctttgttttgccagcatccgtcgtcttctttggtgttgcatcagctgattttgcatgtgcaagcctcagaaggcgatctctaatcttgaaatcctgttttcttacgacagtgtttgcagcctcctgcatggcagatattaaaatggtcagcataaaagtgtatgattgagtcgtcaactggctatcttggttctgaatacataattcagcaaggaagtctttctgttatcgtcttcctccagtactagcatttaattgtatggcatggttaatgctaccatcttcaataaatgatgttcaaaatcacgtagtacatagtaaagccatttatcgacaaacatattatacatcaaatggacttctgggttttgacttatttagtgggtcacactgcaccagatgaaataggaaggtaaaagattgtacccttgtcttgaacaaaacataggcgataccctttcctagacttgtatctggatctcgaacaacacgtatagcttcaacatcaccttctgaaccactggaaccacagaacttttggtacacctcttcatcctgacatgccagtaaaaaaaataaatctgaccttttcttcaaaagaattacacagaccatatacaatactgaccacatgatactcacctttatatcaaacggaagattaccaacaaaaactgtccgctttctgtcataaagaggtccttcgcctttaagtttcttacgaggtggacatgccatatcgacacggacatgattgccatcaaactagaaagtatcaaaatcaagaaaaactatcttatcaggcacaacatagaagtttttgaattatataccagatatataaactaatcatgttttcagttctaagaaagccaactcaccagggccatattatgagataaagcagcacgtgcaccctgctcatctttgaacacaatataggcatgtacactgcaaagggtgaaaaggtacagacaaaatgagtctgagaaacattaggcaaacaatacatttgacatatgcagctgctcagcacaatcaattacattttacaatcaatatatagtccttgtgcattgatgggcgtctaataactgggatatatattgaatatcagagttgatggcatcagatcatgaaaaatacgaaatatcaacaaaatgctcttaaaggaactatacgaagcacgcgcctttttggtcttagtacaccattatatatttgggtaatcatgtcacttatctcctcctttgcttcaaacagcacagaaggtagaaaccaaaatgacaaagtaaagggctgtggtgattttagttgatcgaggaaagtattccatgcacgcagaaataattacataggcacatcagtaaaaaaacaaagcacgcgctattagaaacaaactgcagaatattgactcctaagctacaccaaagttgtttgttatatcactaaataaaagttgtgccacaatcaacactgttgagattcagaagttttctatactacattcaactagcaatccaaataggacagataacttgtatatatcaagacagtagttaaaggaaaacactttaaggtgaaatgtggtaaaaaaagagagtgaaaaaacagggcatttaaccatgtataacaaatggtagagaacttaataaatgttcagggcatagaagcgaattgtaaagctataactaatggggaggagataggataggaaaagaaagaagtgtgagcaagcccatttcaatcggtgtttcaatgctaatgtcctaattgcaaccagctgtaatctgttcatatgtaatccatttgaaattgcaagcataaaggataggggaaaaaatgcatttcgtagctatctctgccatctatttaagcaatggcataaacaatcgtagttgatactagacaggcaagaatgcactcacttgtcgacagaatcattgatttttccttttatgacggctcctttccttggaatcttggtctgcagcaaagcacaaatcagcacagataagcatgaggaggacgaagatgaagaccaagcacagggcaatggtgctcacgtcggtgagtggcacggagcgtatcctgacggactcgatctcgccgaacgccgcaaactcttggtgagcgccttcctcttggtct

SEQ ID NO: 21051 - DNA, 13719 bp, Oryza sativa
gtcattcttcagggataagatctactcccttcccatgctgctatggctattgctttgcatttgttttgttctacctatacttattgacaaattgtgttagaatcattgctcttgtgttgtgccacgcaagttgactgtctgtactctcttgtccctgctttaaggacgctgattgctacaaaatcttcattgagtttgcttactgattcaagcttgctatattattgctgacttattgtcaaacttcattttcttagcgtgccatatcaagcgtactttaggtttagtgcatcatgccactgccttatatcgttttgcctttaatttagttatccttttgtttgcaggttgtgggcaatgatggttctgtatccttttgccgtaatgtactacttagtattgtttctgggtgccttttggattatgaacattgtacttgatataggaatgatttcagatttttggctactagctgcagtagattggcatttgaatttaatttcctgtatctctgtgaatctcataagctaactgctaatttcagctggttgtctacagttaggataagtggttcgttgttttattcctgaattctttgcctcgcaaaatgtttgttttggccggctaatataactgacttgtgatgagaaaatgccaagtattgatggaagtccctggttccatgctttttctgagtagtcttccaatcaacatactgtatacagcgtgctttatatgaatgggcatggcctgctatagcagatatcaacatgtagtatgttctttgtaatattcacagattcttagtatttcggtcttcaagatttcaatcaagcacaatccttgactaagtctagcttcttccatgtgcaattaatgcttgctgcgcagcccttgtttttgctggcatccccttgaaacatcttgcaggtaagttagtaatctttgtatgctcattgatgaaatatatctcataagcttttgtgatgcagttgcaattggttgtggagtactggaggatggtgaagtgattttggacacaaacaaagcagaagagcaggtagaaatttctcgttttgattaagtcctctgcactaggaaaggaaagaacgaatttttatctcgtttcttccctaaaaaacatcttagaactattggttcataattcgctctttaaacttgtggacaacaagtacatttttaatccctctactctgtggaaagttatcatattggtttctaggtgggtctagttgtcaggtatcatcttctgaaatgttatgttgattgtgtatagtcttaactgttgaaaatctaaataagttaatgctgagaacatctttaggagtgcatatgcattaatgttactgtttgctgtcatctgcagcaattgaaatcatttgctcatttggtgttccccaattcacgcaagtctgctagttcaaaagaaccaaaccagaaagaggaggattctgagagaggattgataacttccattacccatggagtgatgtccggtatggttatatcttgtgcctcagcttgatgtgttcttctggacattatagatatagggatgcatatattgtggctctaaacatgtcccctttctgtctcatgtaaagaggaagattatttcagctgcatagagaggggccttgctgcatcgtcacggatctcggattttatgaggacaacattgcagaagcaggcacctggagatgtctgagaggaggcaatcatgcgatagaaaacgcctcaacattgcagaagcacaaggttgtagcagctcatgttttgaatatgaaacgcgtggggactcttggtgcattattgatgtttgaaattggctcatagatgtgcatggatggtggagcgatccggcaggaaatatgtagcgccttgttcgcattttttgtgaatgttgagctgctttggtagtgactagtgagttcgtttgtagtactagtagcgagggaactgtcgtttgttgagatgagcaaggaagaaatgcctttttgtaactcaggaagaagtcaaagcagttgtgtaacaaaccactttgccatgttgctgcacatttttggtcgccctgtttatgatgaaggtgagcaatacatgagaggaagaattcatcgcttttagttgattcaaatcacagttttataatggaatatgtttaggattaggaaagaaacaagtgtgtgagaatatgattattattccacggtattcacagtgctgaatcctagtactactacatctgtcctaaaatgttgctacacacatcctaggataacgaatctggatagacctcccatcctctgtccagattcgttgttttaagatgggtaggtagcaacattttgggacggaaggagtatctggtaggagcagtgatagtagtgatgagttggaaggtgcatggttgatgagagagagactggtagagaggcaaaggacgaaagcagaagagtgaagtttggtagcgggtcttggaatcgcaccgactgggatctatgatgaggcggcacggcaggtcatccatccattcatccaagttagttgttgatgcctcgtccaaggcagctagcaggagtacgacattatcatgaatgaatacgtaaaaatagcgtgaggctgtgtgttgcacagtgcatatgtgctggctggcttgtttttactgtgcttcatttttagcgaggggcggtgaatggaggcaaataataattaaggtggtggtggtcaaaaaaagtaaagggggaaacgctcgcgaggagggtcagggagggagactaggagtcagcctggcgttgctagtgttgaaggccagccagggaagaagaaaccattgataatttgacattcacaaagaagggaaggaaggaaggttccttcggcttggttgcctttgcctgacggtgaattgggttgggttgcgtcgcgttgcgcgcacggtcgtcggctcgcgctccgcctaattggttgacgttgctctcctcgctggtggtattgtatatagcgagccctacctactccacaaaaagagtcctctcctctcctctcctctcccttgccaccaccaaactgcaattaattgtttgtttcgcaaaacaagcatcctcgcctcggcgtcccagatctctgctgctgggctgggctgcctgcctgacaagagaggcagcagccatggcgttcgacgccttcaccgacaagaacgccgtcttccgccgcctcaaggccaagcccgagaacaaggtaacttcctcctctcagatcttcttcttcttcttcttcgcctcaagagtcagatctcatgtactagtattgtcgtgtgcttgttaatttcccagatgtgcttcgactgcagcgccaagaaccccacctgggcctccgtcacctacggcatcttcctctgcctcgactgctccgccgtccaccgcagcctcggcgtccacatcaccttcgtcaggtttctttctacccccccttcccatcccgatccacgccccctcccctcacaagatctgcaatccgcccacgccatcacatccgattcctttcctcatctttccatcaccaaccaactctaagcccatcacgactcctaggaactagcgcagaccagctcaacgatctcaataatacttccctttttcttctttaccccccaaaaaagcgatatggtacagcgcataggtgcctgtggttgctgggttgggtggatttggcagagcttttcatcaaaaagaaaaaaaaagggtcttatttttggacaggcccattggttggggaatgcaccggaagattaaggttttggggcaatcaaggtcaaaccttgtttaaccctttcatccaatgggcattggcattcccaggtaccccattttggtcaaccggaccaaaaggggcattcccggtaattcccttataatttggtaaaattttttgccaatgaccaaattgacttccatggtgggtgctaaaactaatgttcgcactaagggtaaggcaccatggtaccccttttaagaaggtggcaggttggtctaatggggtggtttcgcccccccaaaaaaaaaattcataaaatcccttgttttgaccttccgcaaaagtactagtattgtgcgtgccaaatgtcaaaactgtacccattttattttcactttttcttatccaatccgtatgtattttgtataggtcaacaaacctagattcatggactccagatcaactgaagatgatggctttgggaggcaacaatagtgcccatgctttctttaaacagcacgggtggacagatggtggcaaggtcgacgcaaagtacacgtcaagggctgttgagctgtacaggcagatactgcaaaaggaagttgccaagagttctgctgataacgtcttgccatcgtcgccagttgcagcgtctcaaccacaaaatccatccgatgacttccctgagttcaagctaccagaggcaccagcagagaataccaatgggaagcaggaacctgatgtcaccaattcgcaaaaagcacctacgcagacaccaaaagcccctactcatcccacttttgccacttctgtaaagaagtccattggtgcgaagaagattggaggcaagactggagggcttggtgttaaaaagctcaccacaaaggtaacactgtggatcattagcgctatgtatgcatgtgtttggttccttcccacagttaatatttaatatacctcctctcttctatctatatgatgtgaacattaaggactgacctttgcctttatgttgcagccaagtgaaagcctgtatgatcagaaacctgaagagccaaaacctgctgccccagtaatgactacttccaccacaaaaagtggcccgtccttgcattcacgttttgaatatgtggagaatgagccagcagttgattcaagaaatggaggaactcaaatgactggccacgtagcaccaccaaaatcatcaaacttctttcaagagtacggaatggataatgggttccaaaagaaaacaagcacagctgccacaaagacccaggtaaatattgaaccaatgtttgtgctatgtcaataagtaaataataaatagattgacttttctgatcaatacataagtttgcaaagtttactttctatgataatgtaaacactgcactagattttgctgcatccactagcttgacttgttttgatttcatgatgtcatttccccttcctttatttgctgcatgcttgcattctgctgtttaatcaccagtgaacatctacaaatttcacagaataattaccttttgaactttggaaaagtcagttctctctatgcaagctggtgttattgctagcatgttcttattatatcaaatagttttccgcttgtagatttttgttatgttaataagtactgacactggacgtgaatacctttcagattcaggagactgacgaagcaaggaaaaaattctctaatgcaaaggcaatttcatcatctcagttttttggcaatcaaagcagagaagagaaagacgctcaaatgtcccttcaaaagtttgcggtgcgtattagtttagcatctctttgtccgaggaccattacattgcatctccttcgaacttgtcgaagcattcttaacttcattccagacttgaaatttcttgtctattgtttatgtttgtgctagtacttcatttgaatattctgtagaagtttgcatcttttttttcccttacggttctccttttttttccccctttaattcagggttcttcgtccatttcaagtgctgatctttttggccgccgcgacatggatgactcgaatctggatttaagtgctgcggatctcatcaacagaatatcattccaggtagttattctgtaaataattgccagccttttgtcacctcttgcatatttagtttttaagcaaccgagcatgcaaatcattactacactgagttactactgaattattcagtacaaagattgatccttgaaacgcacaaatatcttacctgctgggattgttgtgcaggcatctcaagatctgtcttccctcaagaatatggctggagaaactggaaagaagctgacatctatagcctccaattttatcagcgacctcgacagaatcctttgagtggttgatggggcgagatcattagcattttttgttttggcaaacctgcacagaataccgtattgagtttaaaatgtggtgcagctcagagaagcatttgttgcacagctatgtagatgaaagtagaggattggcaattatgcgtctgtattcttttttccttttttactattgttggaaccctgtccgcatgaagatatttttattcgtttcttgacaagattgaaacatacgatggtattcattccagttagtggtatagctgggaagaaaaggtatactttgatgtgcctgtgctaaatggaaccagtcatgttatttcttatttctcacagtgatctgtgccactgccagttagagttcatcttcctattataagcagataagctattgcaaactggctggttgttccttttactgacgtctctgtcgatagcttaaatgttacaggtttattataatgcaatcttgcagggtggaaaaaaactgttaatttgtgaaggcaagattcagctaaccgtgtatggaaactgaccaaatactggcagtcgagtatgatagattcagcttatcgtgggaaaaatggtactttgcgaacagccgtctgtcgacatcatattatatattgcaatggcttgttttgctgtgattttgagccaccaatgataaacacaatgcaagttgctgtcttgccgggtgtatcgttgtagcagagccgttcaaagtgacgtggactccaggcggtgccacgcaagactgttattttgtctcctctcttttctccactttttcgtcgtcaaaaatgctggaacgtcaaggcccgcccgttgtgcaaatggttgacagtgacactgacagtaacagattcttgatgtaatcgcattagaagaatcttgcacaaagcaaattctctttgttcttgtgttgtgtttgtggcttgttattctaagcgagtgacgggagcatctgtgctgcctttgccaatttgcaatccacgcaaggctcgtctttagattcattcgttcattttatttccgagtcaactaagatatcgtgtattgtctgaacgattcaaggcagctgtaattaattaagatgacagaaaattcagagcagagcaggttatcttgaacacatcaattattgtgaccagaaaattatggttttgaatttgcgtcccctacaaccaaattcaggatggttgtgttatctttgggttgaagaagagtttttgtcctcaacattttccagctaggagccggcataccacagtaaaagttgaagccttgatcgagataactgatgaacaggcggccggcaaatttcacagccaatgatcagtgagtctaatggaaaatcattctattttattacaggaagatggctgattttacccccacacaaacggatgtgatactacagatcacgcgatcagcgatagcctgatatggcgatctggtaggttaggtagcacgcgtgatcatccattcatcacaagagattgtcacatggcccatgcacgctatcgcacaaataggaggagtgattgcaaagagaagaaaaatagattaagaaaagaaaagagattaattgatgggttctacgatgactgcgatgagacgaacacccgaatctgctccaggaaggtgagctgctgcggccgatccttgcggcggatgtagccgtcggcgacggccggcgagtactccgggtaccccttcttgccgctgcgcgcccacaggtcgtcggcgtagccgcggtgcgcgtagtaggcgacggcgtcgacctgggcgccctcggcgaggaggacggagatggggaggcgctcgtagtgcgcgcgggagacgccctccagctcgtcgaggcggtcgagcccgcgcggcgtgacggcgtagagctcgccggagacgcggtgtccggcgccggggaggttgaggaggaaggggacgcggtagggcccgcagacgagcgggaggcgcggcgcggtggtggcggcgcccacgaaggaggcgtcgccgtcccgggccaggtcctggaggaggccgtggttggagaagcccctcttcagcgtgccgtacgtgaacaccagcgtccgtggagccgccgccctcttcgcctccggcgccgccggtggctgctccgccgcgtcgcccgccgccgtgcccatgcgcgattcaatcgcggcgagctcgagtcgagcttttctttctttggttggttggttggtgttttgaggcttgggtcggcttatttatcgagagaggtgggcccgcttcgtcgatgtcgcgtgggcccagcctctcacatttgtcgcattagccttccagcccattaacaatatgggctgcacggagctcgactcaccttgcgggccaacaaacagggccttgatgcatgggcctcgttctacttccattggagaaggcaagcctctcctccctctccgaaccagccgccgccgccgccgccgccgactgctcggcgatcatggtcggcgaccgaaagcgcccggctcccttcgccggattctccccgttcgctcgctccctcctcttctccgcctcctcctctaaaccactacctccccccgaggatccacccgccgccgccgccgacgaaatcccttcaggtacgcgtgcttacacttaattggcaacgccgtcgccggggcctcgctacctccttctcacgcctcgccgctctccaggaatcgccggctccagtcgcgatatgccgccgcccaagcgcgccaagcgggccgagccttccagcgacgaggagcgctacagcagtgacgacgagagctacagcagcgactccgacgacagcgacgacgcgtcggaggaggtgagtgcctacctctaccttggttctagcctctctggagttcctactcatcgattgatgcgagttgctcttcggattggtgctcctagctcgatacggtgcaagcggacttcgccttctacgaccccaagcccggcgacttccatggcgtcaagctgctgctcaagacctacctcgactccaagccgtgggatctcactggcttcgtcgacctcatccttgagcagaccacggtgggtacggttgtcaagattgctgacgatgaagaggatggtgaaggaaatggtgctgatggaagcagcactggtggcaatgacgatctgtttggtctcattagcgtgcttaatcttggaagatacagtgtatgttcaacctactcactgcttcatccacaagatacataggtcttgctgcactggtggcttctgattaatcaacttgctggtgttgtcttgtaggagcaccgctgtatgaaggatcttaaggattacctgcttgctgtttgtggtgacaaggataccaagaagaagctcaagcaaatgctgggggacaaagcacctgatgtgggtctgcttgtgtgccgccgttttgtgaatttcccatatgaacttgtgcccaagatgtatgaatcgttatttgacgaagtttcatgggccacagaagacgaggtttgtcaagcaccttcttttatgaacgtcgagctcagatagtgtgaaacacattcttttctctactttcttataacgtgttttcaactgtcctcgcatatctgaagccaacacaagaactccgggactccttccggttcaagcagtacctaatggttgtcagagtacttgaggtgagcaatgcaatttgtttccatgtttgttttgcccattgatattcaaagcgacttgttttgttgctcagtatttccgtgtaagatgttgtatagatcatttttcaagtgtaattgtgctctgtatatgaaagttcctgtcttgttgtaactgcttcagctgtatgaataacacgtctttgccatctggtgtagaggaaaactccagcaaagcaaaaggcaaagaacagtacagaagaggatgagcctattatctatcctaagttagaagacgaaatttttcgcgaggtatcaagcaggacatgctactgacaatctgagattaatttttctttgtgcagttctgtttgatgtggtaacaaaactttcttcctcagctttcttcatggtcgttcactttcccaatacgttctgaacaatcggctcagcaagaggttagttgtgtataagtacttcaggctttattatgctgttcttttattcatattttcatagttactttcagcatctggaactggttcacttgtggcactggcactacaaatttcctttggtacctggattgatattgttatcttttggacatctgtttgactattcgttttaataaatatgtaagtatcatttattttgttttataattaaaaatactttaagcacgagtttttacatatttgcataatttttttgataaaacaaatagtcaaacatatgtccaaaaaatcaacaaacgctgtatatttaggaacagaggtagtagtagccaaatgaccaaatcccaatcatgtgaagtaggaacattcgttcctttgtgttatgctttcgttatatctttcttcttctgatgatcattagctcaccatttcaagcagaatctgaacatgcatcattctaagtttgatgttgtgtacacctaaattgaatggactccctgtctaccctttcagatgaagaattacaaggagatgggcttagtgatggccgtcaaagctgaagcaattccgaagttccgaaagaagttggaggatctactatctgaatagttctctccacgcattgtaggtcgtgtggaattttgctgctgtccacatgatattggaacctccatatcttctcttgctattgcttgttagtgtccctagtaagcgcggacgctaagtttgtgagtgcaaagccctaattgaattgctagcattgccatagtagaagagaaattcatgtgtaagaggaaatcaattatgaacttcccttatactgatatcaagagattttgaaggacttttttggttgctcgaagacatggtctttctcagcccatacgcaccacattttagctgggagtttgtttgatcgatatacatcacactgtggtcaaagtcaactgtctatgattgtttttgccatgaggtagaaacgtgtgacgaaactgtgccctgtgcataacaaccgcatctcttctgaaggcataggcatctgcgtccttaaggtcagaggacattagtcatgccttgcaaagtctctgaaaacatggatagctgaacaaaaacaaccagcgaccaatcgctcggtgttccagatgaaatttgaacaatggttgcaaatatatcatatctctaagccaaaacaagagcatcacgtaattaaactgccaagcacacacgggcgtgtagcattgcaacatcataaacaacagaatgttgggaggtgtcctaagcaaaagtcaccgctacttattaagaacagtcagcacgccatctcagtgtcttaactaaaatcgtagtatgacaccagcatttactgatttccacatggatttaaaggaacgctaataacatagtatactacttcttctggaagtattagcagggaggtatcacaataaaaatgtaaactgccaacaaatgatcatgaacgcgagtgcagccatgaggtcattgggcaaccttcaatcacaagttcttgaatgcagactcattagggtgcttgggagtaagcctcgccaacaaagccttgttcgggaagtgctcggcatcaacaaaatagaagttcccttcagccctaaaagtgacaaaaggtctgttggtctctggaggcctgacatcagcaaacttgattgtccttgtgaggggtgtagccagccatgacataatctctgcttcaaagctatctgaacctggtcgccacctgagcttgtgaatgtacgggctcacaaaccagtgtaaggctgccgttgtggtagcactgaggaaaatgacagtggatgcaacagcgcccttgaggattacattcatatctggggatgtcatgaatgttatcacagggccaagcgacacagagagacagcaggtggacagagaaagaagcttcacttttcttatggtcgatgatataggtccctggtaaactagcctgtcatctttgtcatcttccttgatctgcttggattttggcccaatgcttatcttgctgccactattttcagtttctttaacagcagcagcttgagaagcccatcttgcctgactgtacaaacaagtgactgaaccaaggccatcaagttttggaagaggattaggcttgaatgttgagaaatgcttccatgcaatacatccaggagcctgaagatctgataatgtaaaggacagttagctgactttaatcggatttttgacacctataaaaaaaataagaatgcaaatctatatacttcggctatccaagataatggttcagaaaccattaagttagcaaaggagcatgttgctttcagaaaggaagatcattacgctattaagcattttgaggtaacatacagtggtaaattggacttcaaccatgcgccctgttgaattactataacacatcttcctaacaaatgcacctcaatacagtacaattagacacatgtaactggcaaaactaaatcatgtgaaaccgaaagaggtattgggggctcacgagagtaatatgtagagaatagcagataataaatcatgaaattcaaggtagaagcttgaatccacagattatgttggattgtgggtggagttagaaaaaatcatccctgaaatagatgtggaggactgtcatttaaactaccttttcattgacacatgcactctcaccgaagtctaaccaccaactacaatctaacttggaaattccgagattactcacaacatagaagaacatatagctagtcagtcagataacattagcactacatagagggcacagcacctccaggagcccaggacctaatcaaactagaaccgaacttgtgcaccatggaatcgtatgcccgttctcacaacaatttcgcagctcatagctgggcactaccacgcggatcagatttaactatggagagaaccacggggggagagattcgaagcatgaggcgaacctgagacgcgggagaaaacttgcggcggcgaggtggttcccacggagcagtggcggaggaggaccccgcggagggaggaggcggatcggagcctcgccgtcgccatggtctccttccgatcgaggcggggatttgctagggtttttcccaagggatggaggagaggccaaaaggagacgaagcggagcgggcctaaacttacaccacatgggccgatatgggccaggccttaactgggaggcgggtttcttattggatccggatccaaaaacctcttcggcttccttccatctttttttttcttggcacgcggatcttcacacttcgcaccggcggaaccctagccgccggcccgtcgcggcgggtgagattcccttttttttttacctgattattacctcacaactggaacccaaggttttttctaggcacaaaccctaatagagttccccaaactaggcagattttttttacc

SEQ ID NO: 21052 - DNA, 5273 bp, Oryza sativa
gggcgcgagccgcctcagcttcgtcgaggacgaggacgacgatgacgccgaggagggacctttgtcgcagcgccgccgcccggctgctacggtccggcaggcccgcacggcatcgccagctgcggcgactctccaccgcctcacgcccgccagggaccgcctcaagagctctacggccgtggcagcggcggttcccgcgccgaagccgtccaacttccagtcgcatgctggagagtacacgccggagcgcctccgtgagctccagaagaacgcccgcccactccctgggagcctcatgcgtgcaccgccgccccctccccctccaaccgctgaagccccacgacagcgtttgcctggagctgccgccagtcctgctcctgctacaaacaccactgctgctgctgtagagcccgtggtgattctcaaaggtctggtaaaacctatgtcacaagctagcattggaccaaggaatccatcgcagaacgaggacaaagacgaagatgagtcagaggaagaggaggaggaggaagaaggaccagtcatacctgaccgcgcaacaattgaagctatccgagcaaagcggcagcagcttcaacagccgaggcatgcagcaccggattacatctcccttgatggaggtggtgtgcttagcagtcgtgaagctgctggtggatccagcgacgaggatgatgatgagacacgcggccgtattgcaatgtacgctgagaagtcagatagccagaggagcacgaaaggtgtatttggcgtgatcaataatagaggtcctgctgccagtttgggggttatcaatgatggtttcagggaggttgaggatgaaaaggatgacgatgaggatgaggaagagaggaaatgggaggaggagcagttcaggaaggggcttggtaggagggtggatgatgcttctgctcagagagcagcgaatggtggaccagctcctgtgcaggtccagccgcaaccatccggatactcaatcgatccccgttaccagccttcctttagcggggttttgcctgggacttctatttttgcatctgggagtgcagagttcctgtcaatcgctcaacaagctgatgtagcaagcaaagccctgcaggagaacatcaggaagcttaaggagacccataagacaacagtggatgctttagtcaagactgacacacatcttactgaagctctttcagagatatctagccttgagagtggtttacaagatgcagaaaggaagtttgtgtacatgcaggagctccgaaattacatttctgtcatgtgtgatttcttgaatgataaggcattctatatagaggaattggaggagcacatgcagaagctgcatgagaatcgagtgactgctgtctcagagaggagggcagctgatctagctgatgaatcaagtgttatcgaagctgccgtcaatgcagcagtatctgtccttagcaaaggatcaagctcagcttatctatctgctgcatctaatgctgcacaagcggcggcagctgctgctagggaaagttcaaacctaccacctgagctggatgaattcggcagagatatcaatatgcagaagcgaatggatcttaagcgtagggaagaagacaggaggcgaagaaaaattcgatcagaatctaaaaggttgtcatctgaagggaggagtgcaaataatgaacatatcgaaggggaactaagcactgatgagagtgatagtgagagcagtgcctatctgtccagccgtgatgagttgctcaagactgctgatcttgtattcagtgatgctgccgaggaatactcaagccttagaattgttaaggacaagtttgaaggatggaaaactcagtatcctctggcttaccgagatgctcatgtagctctgagtgcgccatctgtgttcaccccttatgtcagactggagcttttgaagtgggatcctctccatgaaacaactgatttctttggcatggagtggcacaagattctttttgattatggtgagcaaaacagtgaaagtggcactgaccctaacaatgtggacaaggacctcattccagtattagtagagaaggtggctcttcctattttgcaccaccgtattatgcactgttgggatattttaagcacccaaagaaccaaaaacgctgtggatgcaattaatatggtcattagctatttaccaacctcaagcaaggcattgcatcaactattggccgctgtcaatagtcgtctgactgaggccattgctgacatttcagtgccagcttggggatcaatggtgacaaggactgttccaggtgcttcgcagtatgctgctcatagatttggagttgcgatacgtcttcttaaaaatgtgtgtttgtggaaggatatttttgcaaaacctgttttagagaagcttgctctggaagaattgttgaaggggaaaattcttcctcatatgaagagtatcattttggatgcccatgatgcaattgctagggctgagcggatatctgcattacttaaaggagtgtggtcttcaccaagccaaaagttgcagcctttcatagatctcgtggtagaactaggaaacaagttggagaggcgacacatgtcaggcataagtgaggaagagacacgtgggctggctcgtcgtttgaaagacatattggtagaactgaatgaatatgataaagctagagctattttgaagacttttcagatcagagaagccctttagctcttattcggcataccacaagaattccagttttgactgtgatacaggttcttaatccttctgctttaggaaatgttgtaacttcatcaggttttctgtacattaaatgatcatgagttcctcgttcaatcctgcatgatgttatccatacaaattttatgggggcttctcaattcagaaattatggtcatttttaattaccatttaccaatgctaattaactgtctgcaaatatatatctttctagcacttttctgtgttatagacatattgtatgacagtttgagcgtgtctgtatggttaattttactatattttgaggccttgagcagaatgtctttgctgtttgcatcagcaaaccattttttacatttagctaactgacaatgtattttttgaaagatgcaaggtgtctaaatattgcatgaacgcttctatttaagattatgtttgatatctataacttacactaccagttaagcttctcagctttgtttgtattcgtgtctactctgttttcttcatgtgcgctttccctattcttccttccattattcttcacgaagggtgacaacataattgaataactgggattattgtatttttttaagtgataccagtacatccaggtctatggaattatacaaaatataatattgtctttctgtcattctgtcctggatttatgtccaatggaaattgtaaacatcttaggcctttcttacgtatgtcttgtggaccattcttccaatgcaaaatgtttctgtttgaccgacctgaaacttttcatgccagtttccatcaatcaatcccataatccagcacttttttgctagttgtttctattattcatgatgttaggcttttatagctgatgcacacattgactgtcctagcgtactgtatattacctggagcagggaagaaagtgaatagcttagttctaaatagtgatgaaaaagtaaattaccaagaaaacaatgcaaatctgcagcctctgtgtataaaaagaaaaactctgaatctgagcatctgttctgtgttgcaccaagattctacagctacattatgtcctcttctctgtttagattagtgttcattgttaattatcttttttgttcctaagaaacactttgtcacaaacagtattgataggaagcaagtttttttttgtcaaccattaatatgctaaacgaatgcccttagaatatacatattgtctcagagattatctgtcgcctgctgaggatttcgaaacatgttgaatatcaatacataatgtttcagttttagccgagagtttgtgctccaaatatatgactgccaatattttgtgccccataagcgaactccaaaaccattgagattcctgaaggcaatgaataaggatatgtgttttgtggtttggaaggtactgttggcatttcaaataaatagggagtttttttttttagtacaacctgcaagcatgtctgatgtttgttttgcacggatgactgccttacctcaactattatactgtaaataatgtttgcagttggatcaggtaacatgtagttggagccagtcacatttggtgcagattccattctgtgtattcagatgctgctgtttatatcacataatatatgacttgccacaaccctacgctgggaattatgtagaatccttgttggtgttggttcagtctcagattcaccaagcactgatgcagaaacatgattcctgcaaacccttgctgcgtatgaagtccaggtgctcttgaattgtgtgattctgagaggaacttccagtaatgtgggttcttgttttttctttctgaaggcttcaacattattccactagatcttcatgttggttcccgatctgtatctgcaaaatacttacctactactagttggcttggatggtgctcatgtagtgataaatgaggtactgtgatcttgctacattgaacatggcactgtaggtgataaatgacccttgctgacttcactgacatatgagaccagcaggatcttccaatcaaaggtacaatgcctcgtgcatgaatgatagcaactatgaaaacttgtgaatgcaaagtgattttgatacagctgccattgtgcatgttattagcatatgtctggattttctgcatcttataatgttgaatagggtcattcatgtccctgatcaattcagattttgcacattatagctcttccttttcgtttgtgcatcatgtaaggctggtgtgtgtgtgctagctgtgggctggtcatggtggcgatgcaggggggccagccgcagccagtggagggtacagactacagactacagagcgggcaggcagcgtaatatgcaaaggacaaagcgtcatcaagagccgttggctgtgtttgtctatctgtagtagcacaggcagcaacagtaatttggtttcagcttagcacgactgcacgagtctactcatctgctctttctttgtttggtgatctgatctgttgtttagcttaaggggtgtttagacgggactaaaaactttttagcccatgtcaca

SEQ ID NO: 21053 - DNA, 3236 bp, Oryza sativa
ctttgttgtgtcagatgagatgagataagcagggaaaagtagtggcctcatcggaccacacagccccgccccgcgtaatgcatgtacgcatgcatcgtcgctcgccggccacactctactactctaccacagctcaaactactacccttattaatcaccctctattatagtaactgttttgacactttgttgtgagttttttcttacccagtgataacaatatttttacccccaagatcgaaacgccagtgggctccttcgagagaccatattggcaaaagttgaggttgacgaattagaagcttggacggggcgtgtattgagattaacgtaaccactatatatagcctataggcaaatcatcttgttatcgacgggtatcaaatacatgtacctttaaaagaactactccctccgtttcaaaatgtttgacaccattaactttttatacgtgtttgaccattcgtcttattaaaaaaaattaagtaattgtttattcttttcatatcatttgattcactgttaaatatactttcatatacacatatagttttacatattttattttttttaataagacgaacggtcaaacatgtgctaaaaagtcaacggtgtcaaacattttgaaacggagggagtattaaattttaaaagaattattaaatgtaaatacgagtaatcttcacttttaactctaatgtggtgggtagatttcaatacaagaaccttaccggttgaattagacttcaccaatagattacaatctcggtagatgtcaccacttacattgctccttaataacgaatgtagctacccctttgaatcgtagtaacaaaaaaaaacagaagaatagaaaaaacatataattctaacaggaatgtaagtgtaaaatagcgaattgctaagtacaggaaaaacacaacaatgatcgtttgattggatcacaggaaaaatacaataatcggatgagagagatagactcaaaggattttttttgctaagtttcctccaaaacctatcctatgcaataagccatcccataagaattttgtaggatttgaaaaaacttcaatcctttaaaccaagggctaaatagaaaaatttttgatagatttcaatcctataaaattccttcatagttcctttaattcaaagagatcctatactttcttcattctagaatatgagaatcttctatgaaatctagaagtaatcactttatctcaaaatacaccatataaggtctggtttagttggggaaaatttttggatttgatcgtcacatcagatatatagacacacatttgaagtattaaacgtagactaataataaaacaaattacagatttcgccagaaaattgtgagacgagtttattaagcctaattaatctatcattagcaagtgtttatgggaggcccaaaatggttaattcatgacataattagacttaaaaagattcatctcgcaatttacacgttaactgtgtaattgtaaagaaggcctaagatcttattgggagaaaagtgattattactactactccttataatcacgacagataatcttgttcccaagccgacccatttaaagccgtgcacatggcccgaggttctccactcttctcagcccgcacgcacccaccactctctctctttctctagctagctcctcctcctcctcctagtagtcgagcacacactactacactacactagtaggagtagaacctagagaaaatggcggcggctgctccgccaccgccgacgccaccgccagcgtccagccccgcgccaccgcaggaccccgctaccggcggcgacgccctcgcctcctatctcggcctcagcttcgccttcttcctcgcctccctcccgggcggcacccccgccgcgcgccacctcgcctcgctccagtcccgcggccgcgtcctcgccacgcgcctcctcgccgccgaggaccagctccgccagctgcgcgcgcgccgccgcgacgacgcccgcgccaatgcccgcgccgccgagatcttcgccggccaccgcgcctcctggatggacaacgagcgccgcctcctcgcccgcgccaccgccgccaccgacgaggccgcctccctccgcgcgcgcctcgccgaggccgaggccgacgccgccgcgctgcgcgcccgcgtcgaccgcctcgagcgcgaggccgccgagcgcgacgatctcatcaacgcgctcctcgcggccacgcgcgccgccgatgccgacctacgctccaccgacgacgacccggagccgcgggacgcggagcagcaccaccaccaccagccggcggctgcggcgttggatttggatccggccgaaccgcgcggcgctgacgccgacgcggaagccctggctgcagccgcggctctctacgctcagcagcgccagcagcaggagggtttcggcagcgacgacttctacacggcggcggcggcggcggcggcctcgggaatgcagcagccatggatggagcgatcaaaagggtggcaggtgagacgacaaaaagctggaatccatcccctttctctcccattgaccccttccttgtttcttctcttctctactaacacgttgccttcccttactactactcctacactaccacttacttccaatgatcttactccatcgagcacttatattctactatcttcccaggaagtagtaaatctattggtggattgcttaatgcttatccttttaatggctgctactgctaatggatgattagctagggcgcatactacatttgggaaattttaatgttactgttagacttaaaatttttgtatgacttaaaattttcacggcacaagtttttggtgtgtctgtttttgccagaaaacagataacagtgcctatcaaattgattgcaagaaaagttcgcattcaactgcatacttaatcacacataactttgtacttgtctcagaaatgtccaaaccgcctcgatttactacattttcttgttccccttgtccaaaccgcctctgttagtttgggtttagtagcagtaggcttatgccctttatccattatctgtgaactgtaataaacaatcaaattttgatgtagttaatgctaagtcttaggtgtaacatcctgtaattgctctccgtgcacgatttcccagttgtgatagtgataccaccatgaaccttcatacaccatgtcatattgcagaacatagaacagacaaacgaccactttg

SEQ ID NO: 21054 - DNA, 1101 bp, Oryza sativa
gatctattagggttgctggagcctgcacgtccaacaagactgctgcatacaaacactcagacatgacgctcatatgttaattgtaatgatactatgaagtgcagttttcatgccttggtcgacttgaaacagctgtctttttggctcagtacagtgatacttaaaagacacattttgatttaagcaagaatctatgcttttgttattggcacttaagcgaccactaatttgcatatatgtattttttttctagatacacagtgttacataaattgaaatgttgtaatggtgttgccacttaatgcaatgattgatttgcattaatatatatttttttcaataccagtggtacgtaaatggtatatataatcttattatcattgttctacgtaattatgttcatgttatatatggacacaaatcctaggtatcaatgtttgattgttggtgtcagtctgagcattgttagactagtaccctttttaaatttttatgtttgtggttcaatttttaatgttcatcttgtaggacctgaagtatgaaacggctgagccgatgtataacacaaaacatgctgtaccacggtaggttggcacttttcaattgaggcacatggtttcctgaacttgcaaatgaataaacgctagttaatgtttactctctaaacatcttccattaacaggagagaatcaccttggaaggtggatgtggaatcgtcaggagttcctgcaaagcttcaactgcttgagcaggaattaattaacctggaaaagattggaaatggagacttatccaagataccattggtgatgagaaagcaagtgaaaagataccaaactcttgctgggaagattgatgatctttgcaaaagaatggtaagcatcatcttttgatactgtatctagtcttttacttggatttgctgatactactgcataacttattcatagtgtataactgaagatgtgatgaatacattaatgtagcatatggctgttatgctaataaatacatgcttgggaagatctgggaatttgggtgttttaaagatagcggcgactcctgtctgttaaactagtcattctcggttaatttgtaggg

SEQ ID NO: 21055 - DNA, 701 bp, Oryza sativa
aagtggttggttgattcttttccagattaaaagctgagaacggggaaaagtcgactcacactttgtagctcattcatacacaaatccacaaaaacacaggagtagggtattacgcttcgcagcggcccgaacctgtatacatcgccgtgtctcgtgtgtcttgcgggcgagtgatctttccacagacagagagagtgagagagcttgggattgcaccctaagcccctggtcgaaccggcaaaggggggcttgcgcagtctcccggtgaggggccacgagctccgtcaacgtcatccgtgtatgagtcggtttttaagttcgcttgcttttggaaatacatatttatatttgagttggtttttaagatcgttcacttttggtaatactgaaggaatcatataagaaatctgtttaaaaaaactcacatgctaactcgagacgattagacttctaactgtaactcataattttctaaaaaaatatatatccaagcgaactccccgcgataaatttcatcttaactaaaccatacaacagattaaaatagacttcacccattgcaacgcacgggtattttttttctagttttttaagaaatttatcttgggtcaaaaatatattttttctataaatttcatcaaacttgaagcagtttgattttgacaaaatcaaaacatcttataacctaaaacggagcgagt

SEQ ID NO: 21056 - DNA, 5332 bp, Oryza sativa
  unsure (1)..(5332): unsure at all n locations
tcctgcagccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcgtcagggttcatcggtcatcatccagctactatattcacaactcgtgtgatggatgtgcttacgtgctttccagtgccatgggatcgtattgtggccttcatcttggtttctccaccaatgtccgtggggaggaaccatggccaacaatggaattatgttcttcttgttgctggagcaccgttatcttcttctcctattattttctgttgccgccttcttctgtgccaaccagccacaccagcagaagttgtgcttcgactgatggtggcgggaagcacaattaattgtgcccttcatttcagagcatgccgaaaaatctccttcccctcttcagatttatacttactgccaacaatgatgagtaccatacatgctaatcgtatagctcctttaatagcgagttactaacaaaggagtttaattttatgccctccatgggggcttatttttaaacgaattgattttatagttaacgttcgcatcactcaaccaggatgtatgctttaagaaatataacatgattgccatgtaaaacgcctgatgcactattatcatatttcttgatgagttgggtcctgaagaaacatttttttcagttaaaatagccatccatcaaactttttttttgttaaagaaaataaactatggctgacaagatttccatgttcttaattgctttcagtctggagtgctttctgatctctaagactagtgttctcgtaggctaggtggtcacagtagtttaacatgatgtccatctagtataacaggactcgtattttttttctataattgatgctaagatttatatatcttctcttatcttttgttttagttagtcaacattttagccttacaagcatagtttgtcgtatcctttttggaaaataaacggcctatacttttctgttgatatctgagaagttgtatggcctgcgtcaaatttattcacctgtggtacaaaggttttagctagaatctcgtgggttggctatgaatgatatgtgcaagaatatataattgttccagacataaattaaatattgcctgtctcttgtactctttatatatacatctttatgccatctttattcctttttttttcctcttggtctcaggtgtatttcacttactcttttggatagcatggcttatatcggaactacctctatgctaacattgtctaggtctcattagctagattaacttaactgttttcacttagtggtgttagtctgtaaagaaaatgaatacccagtcttagttgagtcttttgtaaaaaaaaaaaatggaaccaaagaatgcaattgcactggatgaacatgtgctggattctactatccgcaagaggaagcgtgtgggtgctactcaatgtgctgaggccaatgacgcccccaacctctctcagaatggtccaaaacagaatctcgctttatttcctgattcgactggacataagaagtccaagatgatgtgctctgccgatgacattctggagaggtacaataacttcaagataagcgggatgcctgttcgtgtgatgtctcaccaacatggtggatggagagacttcccagaggatgttgtcaattcggtacagcagagcttccagttgaagaggccaattactagtgcagtattccagaacaggcacatcctgttggacttcatgcagatggtttgtttagattctgtgatggccataagcaagccaattgcttggatcgatgatcatggtaaatgcttctctccggattcatgtgctggagtaataccatctgaacctctgcagcatggaaaaaatgagttcttgaaaagttttcatgatctaagcagtagttatgaagctcatgaacatgatgggatgtctgcagctgaaagctcaagttcagcgtcttttgatgcagtgctttctgatgttcaggaggtcaataatgtagtggaggacaaacagaaggtactcaatgaaagtggtgaagtttctggggaaaataaaaagggccatttaagccatatgaatgaaactgctgatggggccatgcaagctcctcgtaataatcaaagtgtccagcgtgctgattcagctgttcggaatttgttgtttcaaggatcaggccatctatttactgaaaaagacatcatcggtatttatagaaccccaatgctagatcaacttgggaggtcccgttatagtcttttccagaaggaggtacaagtcacaaaaaatcaacggggaaatgcaaatgagcgttatgcatggcttgcttgcactaagggtactatggaggagatgatgatgaatggtgctttggaaatagcaaaacctctgcagggtccaatgtatggtgttggggctcatcttgctccagcaaactcctccaatatctggtaaataccttttgtttctgatttatttgttctatgtgctctaacgcctctggtgttactgcttttgttttggatgtatagtagcctatgtcttacttgaagtttgtccacagtgttggtttatctgatattgacgaaaatggaatcataaggatgatgttgtgccgtgttataatggggaatgttgaggtggttttccctggatcaaatcaatgccagccaaccagtgaaagttttgacagtggtgtggatgatctccaaaggccaaagcattacatcatatgggatgctaatgtgcataagcacatttatgctgaatatgctgttattatcaaagtaccttacatgaacaatggtactataccatgttttttcccctctcttttttaccttgtgtcgttattttccatttgccctagataacttattttatattactgtatgctatttggttacaggagatactgcatccaatatctctgagataagaaattctggtgcactagacaatccaaccaaggtatgcatattatggtttagctggtgtgctgttgttcactgaagcataattcagttctgtcatgtagtacgttttgcgggaaaattgaatttgtctcacctaggcttaatgatctattatgtagtgtagtggaaagggtgaatggatgcttagacttgaaggcgtgttttgtgcttctcgttatgggatttgctcactttattagcgaaatttccagttggcgtttaaataggttcccatttattactgtttccgcagttagtgttctttaacccgaaaaacataaagatgacaattactatatctctttatattttggttatggcctatggcagatccttattgaattccactcttgtatttcttgacttgatggtgatggaatttcatatttttcttcatttttgttgttgattagtaccttttaatgtctgatcatatatggtagtggtgtaggatgggggcgggaagatcaaagaactttgcttagttatgtgtttccttcttgctgatgctctttggatgtaaatgaaatttactgaaatggattcaggttctgttggcccaattcctctgcttttcataatttgcagaaactaatccggttgatttttctaaaagaaaaactggttcacaattgaatgattgataattggcacttaatgggcgagcttagttgaccttgattttgatgacagttttaggaaaaatttcatcttgttaatttgttgcttgcttgttgtgagcaggatgacagtctacagaccattgcgtcttcaggtgatgaacaacaagcatgtatgcttgggcgtgctccaagtccaaggtctcctagttcaccttggatgcccttttcaatgctttttgctgctatttccgctaaagtaccccgttcggacatggatctggtgcataaatattatgaagaattcaaggttatttgtccttcctttggagattttcagctacatgcaatatttgtttgctggcatgctaattatggtatggtttttgatgttaaaatagaggagaaagataagcaggcctgacctagtgaagcagctgagacagattgttggtgacaagcttttggtttctacagtagtgagacttcagcagaaggtacttcttttttactgtgctaactctttgtatacagttcacttaggatttgaagtcctccatcctcactcaatgtgaagcctgctgtgtatatttgaggaagcgtggtacatggaattatgcaatcagctaattgatttttttccccaaaggaccacatatcatgcttagtatgcagcatggaatccgtagcattgtttcataccgtctaatgtttgagtttaccatttactaatttccactatattattcaaacatatgtttttacttactattgatacctgccgcagttgccacccatggcagcaactgaacaagcgccaagagcacctggaaggggaggaggtgctagtccgtaattaaaaatgacagtttgccgacataacaagctgtggaggagtcgggttgagcaaagagagctcaaggaaatgtgtgtaaaacgtttgtgccgtaattgggccccaaacccaaaaggaaaanccttttttttnaagggttttctttgaccaaacaaaactagtctaaacttccttgttgacaacatgttgtttggttgtataaccatgcatggtattctcgactaccggctgtagtgttgttctttttcgccgtcaaatgtagctgcggcttgaattcatcaatatctcctgtggatatttcgttcccgtttcttgcaacttgtgtacaccattgccttcattctgatcactggggtggcctcgcttgaacttagtaatgctaggtagtagttgcagcatgttccatgaaatggaagcaacaacttgagccttgatctaggtttacaaaaccgctcggttatcgtggttatcatatgtggtgagctttttagtttttgaaaccacgatatacctaccacgctgttgtcatggtaaccgtgaggtgaggtaatcttgtttggttaaccctagctagccttgatcatgtacctaccacagccttggtcatgcacctaccacgcaagcagaaatctttgacaaaaacttgtatgggctgatctgatgctacccacatccattgtttgcgttttggcttattagctgcaactagaatttaaattttaaaacttgattttaagttaatttaaggttttctttaacgcagtttatattctattagtattaggcttttt

SEQ ID NO: 21057 - DNA, 1729 bp, Oryza sativa
actaaggatattatataagagttttatgtataaattatttttagttgcttcgtttattttttctttgactttgtcagctgtaaaacaagcgttccagaagacagaaaattagttatatatatatatatatatataaaattcaaggctgttttatatactccctgtgtttcaaaataagtgtagttttgcactattcatattcaacattggaccgttcgttttatttaaaaaaaattataattagtatttttattgttattagatgataaaacataaataatattggtttcaataggactccttacgagcgttctttctatctactattatctaaaaatagtcaagttattaatgactagacgaaaccaaaaaataaccccttatgtacgaaattatagaagatcccctttaagatcaaacaattccatcgaattgagtatgactgtatgtgtgatagcatctactatatcaggaatatcaatgaaccccattcttgcaattgctcaggataccctcttttagctgctaggtctatttcttagttcaagatccctcttaataactggaataaaagaattagtagatctgttccgcccaaaatgggaatgggcgctagggttatgaacttataatcatggaatcgactcgatcatcagattataagttcattccataccggaccagaccgtgcacattcttattataagaagtggtcattcgagcctatggaaataggatactctgtttacatagaaatccccacgtccttacattctatttaggattaggaataggtgtaatcagacctgcttttgacatatctattctatccttatttgggtaccatatgcacctctttgggcttctattgaatcgagaaattggattgtatatctttttgattttgatacatataaggtgtcctacggataatgcaaatcgaagctatttgatgtctgactcaggcctatatgaccgatcgaaatactccaagactccacctttgtcatatattccatatatcacattagatagatatcatattcatggaatacgattcactttcaagatatcacattagatagatatcatattcatggaatatgattcactttcaagatgcattgatggtgaaatggtagacacgcgagactcaaaatctcgtgctaaagagcgtggaggttcgagtcctcttcaaggcataatacggagaatgccattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgagaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttctattcgttctttgagcaaaaagataaagatcggatagattcgaac

SEQ ID NO: 21058 - DNA, 468 bp, Oryza sativa
aacttaactgttttcacttagtggtgttagtctgtaaagaaaatgaatacccagtcttagttgagtcttttgtaaaaaaaaaaaatggaaccaaagaatgcaattgcactggatgaacatgtgctggattctactatccgcaagaggaagcgtgtgggtgctactcaatgtgctgaggccaatgacgcccccaacctctctcagaatggtccaaaacagaatctcgctttatttcctgattcgactggacataagaagtccaagatgatgtgctctgccgatgacattctggagaggtacaataacttcaagataagcgggatgcctgttcgtgtgatgtctcaccaacatggtggatggagagacttcccagaggatgttgtcaattcggtacagcagagcttccagttgaagaggccaattactagtgcagtattccagaacaggcacatcctgttggacttcatg

SEQ ID NO: 21059 - DNA, 479 bp, Oryza sativa
ttcctgcagccctatatatatacagtacgtactaagtttttttcgcgaacggcatatacgtacatgtatatactgcacatatatgtgcgtagtacgcatctctgaccctgagtacgtacgtactcagttagcatttactagtaattttattttatttatttaattatgaattaagacagtactacccgattataattgaaggaatcgatggtacaggatcggagttaagtgccgggtgtcataacaaccctctatgtgccgtgatcaaatcctcgatcggcagatcgatcgatgtgctactagtaatacactgagcatatagtgtggctaattaatagtgtatatttatatagaaaaaaaacttgcacatatatatatatatatatatatatatatatatatatatatatatatatatatatatatatatatatatatatatatatatatatatatatatatatatatatatatatatg

SEQ ID NO: 21060 - DNA, 18399 bp, Oryza sativa
  unsure (1)..(18399): unsure at all n locations
nnnnnnnnnnnnnnnnnnnnnnnnnnnnnnnnnnnnnnnnnnnnatatacacccactctgtatggcttcatttacagctactaactagattgtggaacagaacatttgacttgcacctcagcttcctcctcctctgctgcaggcaaacacttctcatgcgggcacggcctggcgaagaatttggggatcctgtccccaggcataataacgggcaaaccacactctttctctgctttctcgttctgcaaacaacaatacatggggatcattcttagatttctgtaagtctacaagaaacgatcatttcaggttaagatcaaagtaagatatgaatagggatcgttagtactgtagtaccttgtgatcagatgttgtcttgctcggagacgcaatggagatgacggtgtgctggccttcttggagtatcacatcaggatgccgagaccagaggaaggcacggagcttgtcccagtggtagcaacatgagaagatgccactgagggagaagataacaaagatcaggagcgccgtccctaggggaaaacccagagttggccttgaggaatgtgccattggaatcgtcatggatggagcaggcgtcagatctccaagcttatacatatgcatcagttggctcctgctcatttggttaagagcccagacttgcaaggtaaggagactgggtatttatacttgcagccagggcaccttgcacggacagaggatgatgagaagtggactggcttgcacggccaggaagacggaaccatccgtggtactggctagtgctgtggcccacatgcatctgctggtgcccgctggtagtgcttgatgctgatctcactgcctgtcttttccaagaaaaagaagctgtttaaattatatgaacacatagctttatagggtgggagaaaaggtaatgaatttcacttcggacaaaaactacaggtatgttcacaagcaaatgtttattaggcaaaggatgatgaaatgatttactgatgtactgaaatgttcagcttcagaaggacaaaaacatatcagcctagcagggcagcaggttggcaatgaaacactccatgcggattttctaaggaaaaaaaattactgagactcagagtttacagctttaaccgagtaaagaggaatcagaaagtgggctcaaaaagattgacatacaacatgaacctactatgcaagagcacataggagatgaacatgcatcactttatctaagtgttcttcatcattcaccttttgaatactatatgcttttcaatagataaagtgccaacagattgagtatcctggacgaaatccacacttgtgtacggatgccacacatgtcaacttatcaggaaaatgtggctgctcttgtgatgtcaaaaaaaatgtgactgctgaccataactgtattaagcctggaagctagcctaaataagggaaacttcactctatggtgtaccaagtgccatgaacaagtttttttcagtcataataggacactgcaacacattagaatgacccaacagctttacaattctacacaagaagcaaaccgccgggagcaaaagaattgtaatcataaataaatccgtagttagcaaatagatcagcacaaggcaactagttcttaggtccagtctttcctatccaaaacggtgtgtcaagcatgttttcaattcaaccaatagttactaatatgttagctagctaggttcaactttggcatcagttgagctgcatgagcaatccaattcacctgtttcccacttggaggttcccacatgcataaataataacagagataaacaactttaatgatcgcactacatcctgtcggaaaaattgttatgcacattggtgggctcgcttcctggtttttcttcaatggttcgtggcctagtatatcgaatctggaacatacactcaccacatgtttgtagaagcagatcgaggaatttggtacagaaaaagatactgatgggaacaagcaaatttagtgatcaaaacaagcacgatgtatcgagaggtctatgaaattagtatcagacagaaaatgtgtacggtggaagaaaattgtgtgggtagctatagcagatacatatatgatttacagattctgctccaattcatgaaggaaacataatataatcgtgtgggtagctaaatacccttagcagttagcagcatcacaattttaggctctctagtgcagaagttgaacaatacatgttggataaattaggtttatagaattacttccacatcatccagccaatatgccactgtactgggacctagcaccactagcaatagtgatgcaccctaggctcctaacccacctacaaggctacaacgaagctatttgagagggacctctccggtaagactttaggtaagtgctcttccatattattacagaacacacaagaaaactgtactgctcaccatcagtcatggtctggtaaatcaggcgtcagatcccaaatgttacacgacacagtgagtagtacataatccattctacaaaattacaatcatggataaacttcatatttataatgtaactgcaaaacttagctgtactcatccatcatttgtacgcctcaactgaagtaacctgacggtaatcagttccaactattggaactttgcaatttatctagatgctcttcaatatttgtattcactttgtctgattatgtaaaaagacaaaaaacattttgctataagtgattgatcatactaactcttgtcaagctttcagggtagagactggaaacaactgatttccctccgccaaaacaaaatgcggtaataatatatggtgaaattgtttattacagacatactgaaaatggatatttagatttgcacgaagtttagctgaggaataacatctctaatgcatagtattaatgaactcacactactcgtgcaaaataaggacttgatattttcaagcccaaggcactgtaccgactgatctaatggaagcataacaggggctgacacctttataaaataatattttttgatcactagatgagatggagaaaaagaatacatgaaagatattaaggatcttgcttagtgcaattttctaatgagacatgctttttgtaaaggtgcattaaagtaagcatcatatgaaccaggaaaagaaataactaggggaagggcccttaaaaggctaaaaaggtagttcagaagtccagaaactggccaaatcatatcaatctaacttcacaataaacaagcacaaaaaatttagaggaaaaatagaagcagtaaccttagtgatcttttaatgagtggcttaactgaaatgtaaagaacatgtaaactaattgtaacgcaatcttaaagcaagtgaaattaaagaacagggccacaggaaagggcgtgtgatttttcctttgttaatgcaaatgatattttccaaacaaaaccatagctgtcagcacaaattcctgacttcccaacattaccatggggaaatttgatgttctgctggatgtacagttaacattcacccaacactatgtttctgttacttttgctattttgcagttagttttgatttaaatatgacacaattgtgataaatagagttaggaacctgacccaagtaaaatgtgttctacatagtggcatgtctcagatacctttcatggatacgaaacgatttgaatatcttgataaaattttcttgtgagtctgtgatgcagttctcaaagtgtgtttcccctttcagaacagttcactgcagcaaacagaacagtcagttaattcatgctttgggtgataataaagctgtaatggtcatataggcaactgggcattgcaaaaggaattcattggaaatgatgctagcaccttgacttgcaatgtatcatccaactgcttccaggcaatctccgcacacctcgctgctccatctcccttctcacctgttctgccttgtcatgcatacccatgcctgaatagatgttcgcaagtgaaacaaagttacctgcattctccggttcaatctcaaacaatgctctccctgcaacctctgccaaccccacctccccatatttcctgcaagcagcaagaagagcaccccaggctttcgcagtaaccttaactggcattgtctgtataacatcataagcttggcgtagtcttcctgcccggcccaagacatcaaccaagcatgaatagtgatctccacaggcctcgaccccaaatattttggttagaacatcgaaatacttcaatgcatcatctgcgtgaccagcatggccgcaagcctttaatacgccaaggaacattatgccatcaggccggacattgtccagctccatatgcctgaaaagcgacattgcaacatctgcgtggccatggaatgcatatgctgatacaatagagctccagacaaccacatcgcgctcctgcacctggtcaaacacgttccgtgcgccagccagagaaccacatcgcccgtatgcttcaatgagggagcttcctaggtggcagctcgcaaacatgccgtgccgcgtagcaaaaccgtgaacctccttgattgagctcaacgcacccagcgccgtgcacgaggggacgagcgccagcagagtaatgaggctcgggagaacgcccattctctgcatccgtcggtagagatcgatggcccgggccggatgttccccggactcagcaaccgcggcgatcacagagttgaagcaggaggcggtcggcgccacatccatgagatcgagctcacgcagcgcccccgcgaggtcgcccgatcggatgtggacggagatcatggcgctacagacgatggcgttgcggtggggcaattcgtcgaacaggcggcgggcgagggcgggggaggcgcatgcgccgtaggaggcgacgagcgcggaggcgaagaatggactggagaggaagccacacttggcggcgagggcgtggagggagtctgcggcggccgccgctgaggggaggcggagggcggaagaggacttgagggccagcgggaaggcgtangccaaggaggggtcggagagcggccggagggaggggtccgagaccatgctggagaagaaggcgagagcatcccggtgacggccgacgttgacctgggaagtgagcaacttcgtcagcgacgccaggcgttggtggcgggaatgcatcgatcgccgcctggtattccaaagctccacgaagactgaccgcgagcgaggtgatttgaattgaaccggagcaagtcaagacggggaagatgcaacaggggaccgatctcctgatactgcatctaaatatatgaggccctacatatatagttttgtgataattttaaaatataatattttaaatccgtattttttttatatattttgatcaatgtacatgtatatgtagttttgtaaaattcactctttattattccatctggctataaacattttatatttagaacaagatttatgttttaagacaggatttgatcaaatggggtagttgatgatatacccacaaacacttctttcagtgcgagactgcgccgcgtaacccgcgctgcttatcgtacttcagctctgtggcacgcttatgaattgatctgttgcattcaagtaaaattgatctgttgtattcaagtcaaatcggtgaaatgtatttggggacgatttggtaactagtggttgtcttttgtaatatatatccaacagctaatatctcctagcaatcaatattatcatgtacacgtgatattttacattaatagctttctatgtaatttgcaagaatcattactcgcatgtacttgcaatattttgttatgaatatcattgcacgtaacttattttatccactcatgttttttttttaaaaaaaaatactttgacggatagctgtacatttcgagggtcatcttcgaccaatattcttcaaacccaaacagtatataaaacattctaacatttctgataccataaatcgcaaggacaaacatcacaacgattgatacagttatcgttaccaatagactaccacattgaaaagtatcccggtcagatgtcaatcgtcgcaaaaaggatcagtttctgcaaccaaggatggcggcattgtccagccggttgaaactcgtaaaccatttccttcacccttcgtgtccagttaagaaatttagctgccccagatactactaaatgctttcttatgcacaataattctctgatctatagcctgtataaatacacgggaacattgcttgtacaatttcgcaatttgaacagatgaaaaaaaaaaaagaactctcgaatcagtaactgccttcgaatggcaattgatcattgggcctgggggtctgcacccatagcaccaaaccttgctccagcgccaagcccagcattgggtggccttgccacaacaacattgtcatcagcaaatagcgccttgatgaacgaaggagtcttcaggggacgcctcccagtcatccgcgggtatacatcttccaggaagtagtacacatgcccagcaatcataccctgaaagaaacaatatttgtcaattacagatatggtccaagaagaaaacagcatattgacaattttaattcagtcaatacatcaggcattcataccgaataaggacatggctaataattcattaaaaaaatacagatgcatgaaaatgatggtcaggagagtacacaggcataaattatctctgaggaaaaagtctctgttaatacaaacaagcaaataagatccattttaagttcatgatattggcaaatacaaaccagtcagagaagacacgagccagccagcactccattaccaagttaccattaatacatgctgctatgtctaccagcatcgtcacacatagacagcaaaaagaccaatagcttatttctgttaaaaatatgctaacatgttgaaaataaagttttcagcttccatacttcaacaccaaggttaaccattgaaaatagctagtaccatctcaatgtagctagttaaacctacatcaggttatagctcactaacccagaaacatctattggcaagctgggtagaaaatgcaaaatagagcccaggttcaggcattcaaaaacaatggaacaagcttttaacacaggcttatgtcacacttgcaaataagcaatgccaaataaaagttggacagcaagatgaccaataaaaaccagtcacaggcttgtagctcatggaaaacgaaacaaacaatattcatacaaaaccatgatagaagaaataaccgttgaccatactgagcttgcaattctacaaggcattctttaactgcagcattggcagcacagacactaaaaaatcacagtgctattatgatattcatcataacgataagaaacataccagcaaatcaacccatgtactgcttcccacaagaatagagaaccccagaaggacctgcaatttaaaagagaacaattcacgcagctgtttctcatctctgatataaagttgaataaactttgaacaatttcagtgaaatttcatctgtgtgatatcaggtgaaaaagtaaaatcaaggatcactacaaagcaaaaacaagatcagagccactagagtttctgtttctctactttgtaataatacattctgacaatgaaatatgtgcgcgatgcaaaaggatgtccaggagttggttgacaaaaccttttcagcgtacattgtcacagccagtttatgttgaaggcttagcaaatccaaaaggcattctgtaaagagagcacatttacatttgctaattccccattttactttatcacacagtactgaatacagaaatttattcccactctagtgaggtactcccctcatttcaaattgcttgccgttctagctttgtcctaaatcaaatgtttatatgaacatcaacttgtagaaattcatatagtttaacatcataaggtttatgtttttagattcaccatgagaaatacttccataatatatattgcatgttaacctacacgaatttccaaaaatggatggtgaaaaatagaaatgtttgactagtggcaaagctagaacgacaagtaatttgaaatggagggagcattcatttttaagatgaacctagacctactggaacaacaaattggctccatggtaaaggaaaggtctagcattttacaccaagttcctgtgacgtttttacacactaaatagaccattcttgcaccaaaacataaagttactactacttcatgttgtgaaatagtgagagcattcatcacaaaacaaaccaacagaaaagcatttgttgggtaatgcttaggacaaatggacaactgttgggaaaaaaaatggtttgcttttgggctcttggctaataggggaaaaaatcaaacatatattttgctctacaaacaaagaaaaatattgaaattgaagaggttttaaataattctattgcataaaacatatgaaatcaattacagatttcaaatcgtgtgatttaacattcaggcatgaaaaaaatgattatatgaagaggctctaggaagttaacttaagatgagaatcaagtgtgcattagtcatgtagtcatgttgtggtacatggaaaggaaactaaaaatacttacccaaggtaaataagcagcagtaaaggtgaacaaacccaagaagctcatatgaatgaagggattgtgcttgctccatacataaacctgcaggtccatacgagaggaattactaaaactcaacttctaagtatgcacccaagaagactattttcagagcccagaaaatccctaagatttgtcctgcacccctaacgatggtgtagaaaaccaaaaaccaagtataatgcttgtactaatctcgtaccatcataaatgtcaatgaattgctcaagaacaggattctggcaaatgtctcagaaatataaggtatcatcccaccaatcagaacaatgccagtcaggacagtagcgccaaacaagagcatgtagaaaaagtcagcagttcttcctctgaatgagttctcctcaagaagcttgcagtatcgtgcaagaaaaaacatgtggaacagaaagtccaaatctggaaacaacaaaagatggattcaggaataagagtaaagggattaaattatgcataaaaattattcaataatgctagaataacagcgcttacatgttctacttataatgcaatacatacgcaacacacgtgtagcgaactaataatatacaagcacttccatggtgtcacatgaggacacataaattagcacgataacataaatctatatccgctgttaacttataatggtaactggagacgtggtaagatgttagatataattttctaaatgcgctatacatcaggatcatacaattaggggaacaaaatacagggtagacacaattaattcaatgaaaacaaacaaggaccttgagtgggtgggtataaggagctttcacacattatgagtttgaaatacattgtgatcataattaaagagttgcaaattgtataccacttgataagttctttgacgaggtcccacctaaactcctaatgcagcccaaaggcacttatccctaatcaataccacaggttgaagctgtccaacaaggacgctaaagagcgagtttaatagtagaggtaactgatgcctctatttttgcccacattatctactcatcgattaggacaataccaattttattttatttgtttgatatcaatctattggttatcttcctattccctctcttggtgatggagcacatgtacaggccgtcttttgcatgaggggcagctccttttcttctccacctcataatgagcactcttggcactagcgctttataccttactggacattctgtaagtagccgtaggcgcataagccttcatcaatgagtcatgggcagaacaacacttccgttctagcttcacgtccgaaagaatcacacctctgaaatgataccctcagaatacaataatagaattatcattaggactcttattgggccgccttttttaaagcccccccttttaaaaatttggggcccccaaaaaaacccggttgggttaaaaaaaattacgattgggatccgcacaaatagtaaatataagtagatactgtttgtaaactgacaatcttgcaagtgtaagagaaaggtaagaggcgcatacccatcttacggaagtagaggaagttggtgacgaggcgccagatctcgtagtgctgcaccaccagcttggggttcagatacaggtggtagggcgaaatgatctgcgaggcaaggagggcattaggccatcagcgcaggcactcaaacaagcaccagatcgaggagagagtagaatcatgtaaagaggggcgggcggagagagagagagagagagagagacctcgagggtgcagccgacggtggtgacaacggcggcggtgaggtaggagcgcgtgatgatgggcatctgccggtaccactcctccaccgcctgcgccatctcccgcgaaaccctagcgggcgagctctcctctctcgagtctcgagtaaaccctaattgacccgaatcgaatcgccgatgagatgttggcagcggaagggggaaggggatggatggagatggagatgggtcgcaaactcgcaacggaaagctgcgtgcattggtgtctccggtggctgcgtgccttcctgcctgcctgcgtgtcactgacatgtgggggccacgagtcggtcgcattgacgtggtgtgttccagtaggatagcgacacgtcagcgcacacgttgcaacgcgccatgtttcgttgacaattcaaatctgacctggtatgtactcctatgttgttgtagtatgttgttggtcaagccagggattacaagtggtcatatagaaaaaaataaaacgtggatgttaattatatgtggttgttccttctctataatagatactccctccgtttcataatataaatcattctagtattgcccatattcatatagatgttaatgatatatatatatatgtctggattcaataacatctacttcctccgtttcatattatactagtaagactttttagcatatgtctagatttattgacatatatatatatgtgcctagattcattaacatctatatgaatatggacaatgctagaaagtcttataatatgaaacggagggagtatatgaatatgggcaatgttaaaatgacttacattatgaaacggaggaatcatattgtattgttttggtgtaagtatgcaattggttatacggagtatatggaaaaactaaagtaacacttacaatctactcctgtattttcttactagcttaacaacttaactactccctacattttttatttatatgacattgtttaggccctatttatttcagcttagaattattataatctgaattattagcaataatctgaaacaatcatgtagatcattataataatctataagctagattagtataatatgataatctcctctaaacgtgcttctttcaaattagtaggtggctaaagacccactaatcttaaaatttgtatgcaaattacccaccacttccatcgaacccaatagattgagtacatccgcttcctctctccacagtgcaggcgaatccggcgcctcccccagccgcgcatgcatccgcttcctctctccctagtcgcgcgcgaacccttccccaagccgtatcgtcatcgccgccatttcatccttctcccactccacaatagcttagggtattagagacatcagcctttcgaaaccaataatatatgtctctaataatccaaagaaacaaacagctaataacttattttattataacttattataatccagcttaataatctggattgcaataatgtttagttattaaaaaaaagggtagtacgcactggaaaaatttgagactcaagtgaagttgttgaaagaagatcgaacgttagaaaaagaattatgtcgtgatacagtgatttgttctttaatgagaaaaggttagaatctttaatacctgcaatgcacgttcttatctttatcgtggagacgtaaataattactactacaatacattttaattgaaacagaataaaacaagctcgatgatacaaatcaataaaatagtaacctaatgatatgacatgcgattttattgacaaatttattatcaccactcgtaagagtggtaaatagttaattattccaatgagagttgggttcttctttgtatggcagggagaaagaaaaaagataaatgagtaattttacactcaagacatgactaatgggttagggaaataatttcctagctaaaaatacttatatttttaagacggagatagtacctcatttcatctcagtttttcattcatttacatttctcaatcaggcttctcatgatccattatccacacatactgcggtgacgtggcttccgtagatttaaaaaatgacacacgagcaataaccccaatatttgggaaaagccttctcttcaatgataaaaagatggaaatgatccaggaggatgacatttgcaaatacgtgaaccggatgagtcaaaaacccaacagagactggaatcagttgagtttcagcatcagcgcccccaaaccaaataattttgaactctccggactccggccgccgccttccagaggaacctcgcggctgccggtgccggtgccggagaagacatggccgggaagaagaaggccctaacaaatcccgcctctccctccgcctccgcctccgcttccacccctaagaaatccaccgccacctccaaggaccgctccacgccgaaaccccgcaaaaaccccaaccccaaggaggaggcaccaccgccgccgcccgccaacaacaagcgcctcaacccccaagggggatccaaccgtaagaagaaggccgatgcggggacgccctccaagaagccgaagcgccagccgccggagcccaaacctcggaagcacaagggggccaagagcgagaagccgcaccgggtttccggcgaaggggagaagcccacgcccacgaagaagaagaagaagaaggagagcagcaaggagcccaagcgcgagaagcagcaagcgtccgcgcctatgtcgactccctcgaagaagaacaaggaagccaaacgcgacacaggaggagcggggaagcccacgcccaccaagaggaagctcggcgacgtggatcccccacaggagcgaccgtccggtgaaggccaggcaagctctcccacgcccgccaagaagcggaaggacaaggcggcggcggcggaggcggttgccgaccacggcgccggcagcttcccgatggctcgggtgcggcagataatgcgggccgaggacgccaccatccgcccctccaatgaggctgtcttcctcatcaacaaggccaccgtatggttctttccttccttcccacattctttcacttaactcgcatttggttaatgaaacttagtttatgcaatgatttgtgatggcaattagcaatcgaggattggagcttctccatcctaatgtgatgatttgggttggactggaatctagttaacctaatgagatttaggtcggcgttgctgtgatcgcccacaaggtgtttgatgaattgtctgatatgatcacagatcacgaatggtgttttctacctccaaatggtagatgttacaggttgtctcagaagtccaaagcttgatttctctgcttctgctgccatcaaacttttggcaggagggtttatgcacgattgttttatgtttgtatttgttggtaactcgctaaaatgttgctgttctctgatgcattaggcatatgttactggtttatggcatactggcaatgagaatattatagagggcatattaagatagaatctgaagaatatattttcatgatttacctagttattctgtcagattactgtgatattcattacggaccagtgtttcattattttttccattcctcgtccaaagctgatttggttaatgttatatcgctcacttgaacctgtaaatctgtaactgcaggagatattcttgaagaggtttgcagacgatgcttatcgaaatgctttgaaggatcggaagaagtcaattgtgtatgataacctttgtaagttgcacattcattcccattcacttcaaaactttctttgttgctatgttgaaaatgcactttgtatagaaaagctaagggatctgcatttattaagattggaaaaaaatgtttgaaacattcaaacagtacatagaaaaatgagaaatctcagataggtgaaagagggtttccctattctactaatgtaccagcacgtcatcatcaagtttcaaaacaacacaatttgtggaaactgtatgctgtctcattagaattttttttagtgaaatataaactacacatgtcctgaggttgttacttttagtgttcatattttcattttcaatctctcaagagatgaagaaccttccaagattgcaatgatagtctggtagttatcccatctataggtagatgatatttccatttctgcagacaggtttgtcaagccaggagagaaagagcagttagtatatagctatagtaggaccattgtgtgtaagagggcaactgcatttagttgcgattcagcttatcaatgccccaatatcactggctggatagattccattgacaagagccaaaagataaatactctctcaaagattgggtacagatgttgagtcctacaagttgcaacatcaaatggttacatacataggatattttgttatggtcttgtcaatattcttgcctgtcccccctttttcttgataaaatgtgtccacctatcaatctaatgatcataactttactcatagcacacacatttctgtgatgttggcatatatatatatatatataaaactaatgcatttgtgcagtgatgaaacatttttatttctatacaagccagtgtaacatgtactgatattttttagactgtccaacaaagatagttgaagtccactcatgttctgaaactggacagaggggaatcaatcccatcgagaggctctcttcctccttttttctgaatctgtgagagaggcaaatgagaagttcagagagacctcaactcttctgcatttctctgtcagtagtgataataacttattaagttgatcaaattagggatttcactttcagtacagatgttgcattacttgcatctcaaatatcattttttgagccatattttttgacattggcctttgatatatgccccagcttcttttttttttctctcaatgatgcagactttcagaggtcataggataaattctttataaccagtgacctacaaaataacctcaggaattcatatacttaaacgtctatgctttgcctacttgcaccttttttttttttttggggggggggtgtgcaaatgttccaacttcctgacagagttatcgtgtaaaattgactcaggaaaaacaatcataaaacatgtttcttatgatctgtgatggcaagatcagcatccaacatgtgaatagctttaacatctttcatctcaactcatagacatacactttttgtggatgggctcatctctgaattgcaattaaagttcattgatcctgtcttccgtgaggttgaagatatagttaatgttctatttcttttgtccttttatttttctttatctcacagcacatctgccttccttttcagcaacagcagtgtgcaaccagaaaagatacaagtttctctcaggtcaatatttgtcttttttacaaacccatggaagcctattttaatcagcaaaggctcttcatatgccttagccttttagcaatatcattatttacaaatcgtttctgtggtctttgctcagattttgttccacagaaagttacagctgaagatgctttgaaggctccagttagcagccaagtgaaccaaccacaataagttgctagtgctccgcgaggtatgctgctatgtttttactacttcctagcttttttaaggagcgaattactggaaattagttttccatgttgtgaaagttccagcattcagctgctccatcctgtagggaggtcatcctttcacgagttatctcctgggagggttctgcaattgtaaacgccagctgtgcagctcatgttgccctcaggactggcatcttgcgacatgttcaatatgattctgatcagaatcggaggcttaaaagaagattataaggggaaacctgagtaatctacatatgaaagaagcatgatgaaactttttgtcatgagaatcacttgaaatatgcttgcttagagcctcaaatcaggatcacctttttggctgtgtaagctgtgggttgtgtgaggtggatgtagcttaagctaaatgttactgtgtatttttttttagataatacgttactagtagtatacatttgtgagttctgacttgttcatgtactagttcattacatatattttcgcaggtgcatgctttaccaattacttgctggtgcaaatatgaatgcctagcaccatgagatgcttgtcttgcactggagtttatctcctatggaatccacgagtaggctgttatggaggatttgtatttgtaccttgtttcaaaataaataaaactagtatgagatatgatatattttagaactatgaatctgggtatgagtattataatgtataatatctcatattagatctatttattttgtaaccaagagagtgcttgctttgtttcataaaaaaaatctaattctgtataggaatctagatatagaattgtattttttttttaacggagggagcaagtgcgagcagacacggtgagtctacgagatttgtgtgtcaagtgtcaacgcatcgttgctggggctttgttcgggacgaagatccaagtatgcagtacgcgtgttcgccggtcattcgctgcacatgggctcctgacttgcttatgccgccaaagattagcaacagccaatagctagctgtaaataatgcgtaaggccaacggtaccatctgtaactttctctcactttcgttgcatctcaattctcaggaaagcaactgaccctaacgcaaacagtagtgtctttgaattggtcggtgcaactttgccacgaacaatttgctaaaaagtgctagaaaaaatgaatatacaaacgagtcagtcataagtttcagccaaacatcaatttgccaacaaattggttattatggcacatataatacttgacgtgacaaaacttcaactgcaaacctaacatgccctttgccataaatggcacagtaccgctcatgtttgaaataatcaaactgctgtctccaggccctaaattaaagctatcgttaaacatccaagtcaacctctttaatttgtcgtaacattaaaatccacgcgatcattgttttctgttctcgagcagctgctgctatagcacgagttgtaccacatgtcagtatatctgaacatatgtgtccaagggcaggtgccgaactaatgaactccggacatatgtatatgtatatatgtgttagtgaaaacacattttcttttctgttgtgtttggatgaaaaattgaaagagatacttttgttgccaagtgtctccaagcttaatttggcagaataaaaacgccaagaaagaagtccggaccaccagattaattatttgtttggtaagctttagcatcagcgcatcggctatagcattagctccactcatttgagaaaacgacgacgcattaaattagtaacagattttttttccacgtaaaataatttcggaagctagtctaacaaaaagaaattaggagtagtaataataataataagtaaagtaatctagtaacaaaattacatttgatgagcgactggccagggaggaataggttcaggtgccacattttcttctcccatcccatcatcccatggcctggcctcatgggcgcgtgatccgagaaggaaccgacggtgataaaaatattgaaatctcgcacatcccaaccaaccatgcagaggctcgcagttctggatctgaatactgttcacaccaatgcatcacggctcacagctcacttggagttggttctaatcaaaattattaggagtagcagtatatcattctactaggtatacaaaactgcgtgtatccatctccatatcactccattacgttattcctctttttttttcacagaaaaagaattttaatggtttcaacaccaagaataattaacacaagaatgaaatgaagaatctaacatctcgcggatcacaggagcaatttgaagcgcggccatggaaagcatgcatctaatctgtgtatctgcggagct

SEQ ID NO: 21061 - DNA, 4680 bp, Oryza sativa
gaggggaggtctcagaaggcgcggaaggggagagcgcggcggcggaggaggaggcctcggaaggcggctgcgacggagcgagggcggcgtcggcggggtggaggcgctcgtctgcagccggggtggaggcggtgggcgcggacgcaggcggcagcgagatgggcgactcggcggaggcgagcagcggcgcgaggaggaggacgaggaagagcgcggcggcgcagggcaatgccgatgacgccatggcggaggcggaagcagatctgcggcgaggtggtttggttggtgacgagattggaggggttttatactcgggtcgtgaggggtggggatccctcgcttcgcttgccacgtcggcgatgcggttgcggcgggcggtagcaaaggaaagggagagagtagaagagtccaatcgccggcaacgcagtataggccggtggtacgccgttttcggcccatcttccacctctacctgccgcttgtttgtgcttcaagattcgtgcacgtggtcacactctttacttcctatatcatcatcataatgatagcagataactatatgcatcagtacgtaatttaagtgctactgtactctttttttaactcaaaacagaagccccatcaattaattctgctgtactcacggatggcacaacagtgttactctcatcagccacaacaacaaactactactactactccagtatatattggagtatactgaaacttcattttagagtttaactgaggtttttttttttcttaccatagtcttttttcaatcattgacttctaaaccatcaataacacatgtataaaagttttacacataaatataacttagttgcttcatatcttctagggcttattagccgtagctcaaactatagaagcatcatcaaattattgctgctccttagcgaacatacagacagtgctactacaacaaaatgctggcctgccagcataactgcatcatcaatgagaaaggttcatcacagttttggatggaatcatcttaacagaatttcgccctgcctaaccactaagattaaaaacaaaaataatcccagaagcgtaacaataagattgtgatgagcgacaatcagtgtagggctgtggcacgtttcttctgttgcccttttgtagcttttcccccttgtgaagcagcagccttactcagctcttctgctgctgcttcttcggatttatctgcatctgcagaatacggggaatacaggaacttctttgagttgcccgtgccaacgcagttcagcttcacgatccttctccccgtcatccatttcagcaggatcttcatgtgagtcttgctattcaggccactgataccagcatcctgttgtaacatactccaaatgagtaggggctcatgtgaaccaataattgtgttaggtatactatcttcaagtctgatgcaactttgcaatcaacatgagctgaattcgcagaatggcatcaagaaataaccaaatcccggtatactatcttcaagtctgatgccactttgcaatcaacatgagctgaattcacagaatggcatgaagaaataaccaaatcctaaactgctagttgtagattaaaaggtactgtgcagtatgtgaggatgcagactgctaatgttcccaggtgccatggaacgggcaagcagtcaggtcagccagaatggtagagcgtattagcaactgagatttagaccaactacacgtgcctcgtagagagaggcaaaaatatggcttatgttttcacttatagaaacacatggcatactcctacataagataagttgacataaaaatcactccttgaacatttatagcaccaaaggcaatgatatgcctccatttgaattcaggttatctataacaccaatacagcaccagctcattcaagcacaataggcaacataatgttgactcaatactcataagctttcctcttactttgaaaatatttgtgatataaccattgagttgaaatacattacacatggcgcctgactgaacattagcaaaagaaacctagacttatcacaaggatatactggtagatatcctagtaacagtctctgtaaatgagtgtatgacaaacactcaggcacgcacacatattgcacataaaaaaaaatccactttaaccagactgaataagctaaagaccgtgaatcaaagcacggaaaatcgcaagatgatgtggcaaaatgggttacgtggatcactggtaagcctgattcaccaaaatacttaaatgggctatgcaatagtcctaagtggacggttactctgctgatatttttatccaaatgaaagaagctagagggggtaaaaagggaggagccgctaccaatttcatagtgtaaagaacattggatcaacgaaatgagtagagcaatacttgtaggcgtctataacagttgatcttagaccttcacctactgttgatttagggggaaacgcagcaggtttgtttcactgtagaatgcacacatagccggagatttgcaccggtatctggtagactacactaaacatagagctggtgagtagtgccagtgtcagaagcaacgtaccttggcgtggttccatgtgttgccgacggtgagggggccatggtcggtgaagatctggaggaggcgaccggagatggcgacggcctcctccttgggcaccttggggttgatccgccgcacgtccaccgcccgcttccgcgagaagtgcctcttcagcacctcccacgccatccctccagctccgccgccaccgctaccgccgccgcctcctcggaggaactgcatgtcgccgccgccgccgccgccgccttggttcgctggctggggttcagttcagcttccgcagctaagcccccgtctctcccttttcacccgtaggccgtaggaaggagaagaattttggcccattagatgagatatcatatgggcccggaacaaaaaggagaagaaggcgaaggcccacgattgcagattatatgggcccagcccaagaagagaagaaggcgaaggcggcggctgggtcgggcgctccccaccatccaaccaaccaaacctctcatctctccgccgcgatggcaactgcggccgccggtggtgaccagtgaggtcgccgccggctgaagtgtggttccattcgaggtcagcaccccctttcctcttatctatctgcttctattctatatgccctcctagatgggagcgagtgaggctgggggtacttggaaacatgagcagatgagctcaattgatccgatttgattttgattgggtttattttgggttgttcgctgatggaaagaccggaattttgctcggaaccttgtgtttgcagggcagtggcctgtagcgccggccgcatatgtcagctctccgcttatgccatggagccatcaagtcgccgtgcgctcggaagcttgctgctgctgctgcgccctgcgctcggaggggaatcccggcaccccaccaaaagaagcaagcgaccttctgcttgatgcgagcttctccttccttccgcacaaattctaggtagtgttctgttcagcgtttgcaccgaaatggctagattcctgatgtgtaatgtgtcaattttgccgctgtgtgtttattaggcagtacttaagtcaatttcgtgccacaccaagtgtttggacattatacagacaattttgtgctaaaatggggatctaaagctactctttccaaattcaccgtagcagtgacctcagttagtataaagacatgcctttctctcctttttgcacctaatgtaaaaaacattgcgttttctgaacagttggctgtgttaattctatcatggaagactcaaatttaacactctctttatatgtcgtcaatcttcagatatagagttggcaccgaaccggagtcaagagtgtgaactgcggtatttcattcaggcagtttgtgttttctattgttggcatttttgtccatctttacgcttgagttaacactctttaaagtgttgccaattttttgttgatgacatgaaatgttcgaacgtataccacactgtaacaggagattacctatagcgtttgctctacttgccagttttgcttgtttgtataatgcagaaacctctttttatgcaggcagatgcaatggtccattgaggctatgaccgatgatagtgctgaccaatcaggcgacaataacactcgcctgtttagtgcaattcagtcgtttttgagcaagttatatggcaagctcaagaaactaaggaaagggctgccgctgaagatcctcttttttctcatcggattttattgtgctacggcatttgctactgtcatcgggcaaacaggtgactgggacatattgtctgctggacttgctgttgccattgtggagggtatcggggctctgatgtatagggcttcgtttgcgtttcttggtaggataaggaagatgattaccatattcaattactggaaagctggccttacacttggattgttcctggattcttttaagtatgaagtggatgaatttcttgaatcctgtaatccattcaacattgatatcaatatatttagtctttggtgaacttctgctccaggttttaaaattttgttcttttgcatgccaatgatattttgatgtagcaatttcaattgtttagtcactcc

SEQ ID NO: 21062 - DNA, 1324 bp, Oryza sativa
ttgccattgtggagggtatcggggctctgatgtatagggcttcgtttgcgtttcttggtaggataaggaagatgattaccatattcaattactggaaagctggccttacacttggattgttcctggattcttttaagtatgaagtggatgaatttcttgaatcctgtaatccattcaacattgatatcaatatatttagtctttggtgaacttctgctccaggttttaaaattttgttcttttgcatgccaatgatattttgatgtagcaatttcaattgtttagtcactcccgggggagccgcataactttttctgtccaaaagttggagccatggatcaaagaagagtagttgtatcttaaaattgttgtatatacaatattgtaccttacaattgttgtatacacaatactccattgtacagcattaattaaagaattgtttttgcacctgatactggcctgtacaaagtacaaccgtttgacaatgaactggggttagttctatgttcaccaccactaaacaaaagagctctgaaatatggttcaaaagctactatgatcatttgaattcatcagctttgacatgacagtcctctatccctcatcgtcttcttcaccttttcagcctctaccaaccttcccacattttgatagatctccatcaactttacaaaattgtgctcattgtcaggctccagttcgatcaacctcttcgcaatgatctctccaaccctggcgttgcgatgcatcaagcaagcctgcagtagagccctcaaaacagtctgttcattgtcgagaggcttccgcttcgacatgaactcgtaagcctcatggatcatcccagccttgcctagcatgttcaccatgcaggtatattgttccatagtagggggaattctgtactcattctccatctcagagaacaatctcatgccaccctccaccagccctaaattgtcacaagctgagaacaccaacgcaaaggtggtctcatctggtcgcatcccggaatccaccattcgacggaagatcatgagaattctgtagtcctggaggtgagcagagattatagcattccaggactgcagatccctcatcgtcattgactcaaacaccaacagggcatggctctgttcgttcttatcagagtacatcctgatcagagcatttgctactgacagctctgtctcgagaccatgacgaattgcccaggcatgaatctccagtccccatttaccattgtcacaaaccaacggcagtatcgacagcattgttgataatgtaatggagtcgggctcatgttcttctctcagcattcttc

SEQ ID NO: 21063 - DNA, 19334 bp, Oryza sativa
cgcgcgggcagcaggtggtggaacaggtggtgggcgtaggagacgaggcccagagaggcgtggaggtggaggaggcggcgggcgagcgcggggtagcggcggaggagggagacggagaggaggcggcggaggcgggcgaggttgcggcgcggggaggggtggagcgggagggcggcgaggagggagtcgaggaggtcgggggtgaggaggcgcgggtgggacccgaggtcggagaggacgcggtccagggtgggctgggtggccgccggcggcgcggcgcggagggtgagggccgcgccggagtggggatggcggcgagaaggtgggcctcgtcggcgagctggcgcggtggagcggcgccgccgctggatggcgcaggtcgtgtggctaacggttgctgggagcgccattttcgttggaccaatccacacccagagcttctagaagcagtctcattttttagcgccaaaaaaagaactactcgtggcaaatactccctccgtatttcaatgtatgacgctgttgacttttcgaccatttgttttattcaatttttttgtgtaaatataaaaatatttatgtcatgcttaaaaaacatttgatgatgaatcaagtcacaacaaaataaatgataattacattttttttaataagatgaatggttaaacgttagacaaaaaaaatcaacggcatcatacaaataaatatatggaggaaatactattcagtaaaagatggacaccacaagtccatcacaggatttagagtggaagagaaaaatatcatatggtttgatgggagtctctttgcatgcgggaaaactagttagcgcacggcggcgcgtgtttcacacctcttccacgctttttttttccgtttttttaccgtttgttttcccacttttttctgattttttttatatttagcatgttttgagtttgaaagtttttaaattttgagttgaaaattttcaaatctaaacttgaaagtttttaaatctggatttgaaagttttcaaatctggatttgaaagttttcgaatctcgggttgaaagttttgaaatctcgggttgaaagttttcaaatccaagttgaaagttttcaaatttgagataaaaagttaaaagttttcaaaatttgacttaaaaaaattcaaatttcaagtcaatatttagaaaactttcaaatcatattttgaaaactttttactcaaaaattcaaaatcatctgtttctatttttattgagaaattactgtagcatttcgtgattagtgctaattatttggattagcaatgtagtgctgtttttcttccagaaaagcgctaagcgcttgaggcggaggcccgcgtgcgcgcggcttaaagttctcgcgcgcgcgcgagctaaccacccccctttgtaggcccaaagaggatggggggcttggttttgtcaacacaaaaataatgaatgaggccctcttatgtaaatggatttacaagttggaatctgggtgcaaacagcctttgctgtgatctgcttaggagaaagtatatgtcaaacggtggaggttttttccaaacttctgctgatgaggtcaaaaaatggatgaagcttggcagtgcatatgttgtgggtaatggtgaaaatattagattttgggaggacatttggctgggggaggtccctctaaaaattcagttcccatacatatatagtgtttgttctgatcctagtgatagtgcgaaacaaatgcaagtggatggggaatggaggattaatcttagaagatctctaggcccaaatgatctggaagagtggtcggagcttcaagagatgctttacttcgacacagctgactgcagaaaatgacactatgttttggaaactaaatcagtcagggacgttcactacaaaatctctatacagggctattatctttggagggattaagggcaccaagctccaggagctttggaaaaccccggttcctttgaagataaaagtgtttatgtggttaatgctgaaggggaggattcaagtggcaaagcaacttaagaagatgaattggtcaggcagcccgttttgtaagctttgtgggatggaggaagatgtagatcacctaatgtttagatacctaccagcacaattcttatggtgttgttttagggcccctttaaattgtaggaatggaaaaatggaggaataggaaaaatataggattctgacaggaatgcaagtgtaaaacagaggattgcaaaacacaggaaaaacacagaaatagccgtttgattggaccgcaggaaaaacgcaggaattagaggagagatgaagactcataggaaagtttccataaggtagaacctcatgctagattttctccaaaacttgcatagcattaggcattccataggaatttaataggatcctataaaattcattcctttgattcaaagggctatataggaaaaattcctatagaaatgaaatcctttagaattcctatgaatttcctttgaatcaaagggggcctattagagatgctttccattggataggatccccacctctaggaatgaactcttagacttcattcaagatcatgggggagttaggaacaaaaacttgttttatttgtttgctgcaggtgcttggtcgatatggctagtgaggaatgactgggtttttaacgacaaacttctgaccaacgtgacgtttttacctcacaaagctatgtcgtttatgatacagtggaaaaacctggcgccggtgcagctgaaggaggagttggagaaggtaaagcgatcgctgcttgccaatatccgcgagacaggagattcaagcagctgatgtcttcgtgtccttgatcttttaggctgttttctgttatgctagctgtgcattagctttctggcttgtctgttgtgccagcagcacttctacttagactctttcgctgttaattgtgaagctggcatccccggcactactgtatcagactcttatgctttcttataaaagctgggctttatgccttttctccaaaatactattcagtaaaaaaaatcgtaccagtagtattttctatagcttgttaagccaaaagtattgttcagaattggcatattaatagagaaatttgagatgaacttttcatgtgctatatatgtggatcatacactggacagaagtacaaatgatgagttgaagtgtctggagaatgattgacgctagttgataacgatggtcatcagtctgaatgaagggtaattttagaggcttggttttcccggacgcataagcaaagaattcggatacatggatatgaggggatgcagattgctgcacgaaatcgaaaagaaagttgcctgccgattgatcatttcagttgatctcttttcaaaaaatcatttcagttgagcggttcggttcagtcagttgaggcatccatccatggattgcatcgcatcgcatcttgaggtaggtggtgctttggatagctctgaattcaagcaagcatatccaaccgaccggatgatacgttagcttccagattccacaagctatccaagaaatcatcgtttttgcttgcgtctcttaattaaatgcatccatgcatgcgcatcataatatgcataaaaaatgcattagttcatgccccacaaagtagcattaccagtacctgaattatcagaaattgatcatttgcgtaatcatcactaagttcgttttgacttggattcagagatatctgaagccggtccatcggatgaagaaacaataatattaatttttccctcgaatatactactacttgcagcatgtacccggtactccgtactagtatagctttcaagcgttggtgtgaaagtaatattaaggtccagtagaaagcacgtgtcttgcttacgagaagcagcaacacataaaactttcagtaaagtctcttctcttgctcatgctagccctgtcattttcagtcctaaattaaatctctctttcttgtccatcggtttatcaaagaatatcccactcaaagagcataattcaggtttccttctcaactcaactctcctgatctctctggctctgcctctctctatatagtgtcacagtgtattcatgcagaaattgatccaaaccaaaaccaaaagtgaaaaaagaaagtaccaagaagaatataatcaacacaagagtacagtagtgtagcaatggcggcggcggcggccggcggcaagatcaagacggtggtggtgctggtgatggagaaccgctccttcgaccacatgctgggctggatgaagtctctcaacccggagatcgacggcgtcaccggcgacgagatcaaccacctcgacgccgccgacccgacctccagggccatccgcttcggcgacggcgccgagtacgtcgaccctgacccgggccactccatgcaggccatctacgagcaggtgtacggcacgccgttcgtcgacgcgcgcgccacgcccatcacccctcccggcgtcccctcgccgccgatggccggcttcgcgcagcaggcggagaaggagaagcccggcatggcggacaccgtcatgaacggcttccggccggaggccgtgccggtgtaccgcgagctggtgcggcagttcgccgtgtgcgaccgctggttcgcgtccaacccggcgtcgacgcagcccaaccggctgttcgtccactcagcgacgtcgcacgggctcgtcagcaacgacaccaagctgctcgtcgccggcctcccgcagcgcaccatctttgactccctccacgacgccggcttctccttcggcatctactaccagtacccgccgtccacgctcttctaccggagcttgcgccagctcaagtacgccggcaacttccaccccttcgacctcgcgttccggcggcactgcgccgagggcaagctccccaactacgtcgtcgtcgagcagcgctacttcgacctcaagatgctccccggcaacgacgaccacccctcgcacgacgtctccgagggccagcgattcgtcaaggaggtgtacgaggcgctgcgtggcgggccgcagtgggaggaggcgctcctcgtcgtcacctacgacgagcacggcggcttctacgaccacgtcccgacgccggtggacgtgcccagccccgacggcatcgtcagcgccgcgccattcttcttcgagttcaaccgcctcggcgtccgcgtcccggcgctcttcatctcgccgtggatcgagccgggcacggtggtgcaccggccgtcggggccgtacccgacgtcggagttcgagcactcctccatcccggccaccgtgaagaagctcttcaacctcaagagcttcctgaccaaccgcgacgcctgggcgggcaccttcgacgtcgtcctcacgcgcgacgcgccgcgcaccgactgccccgccaccctgccggagccggtgaagatgaggccggcgacggaggcggcggagcaggcggcgctgacggagttccaggaggagctggtgcagctgggggcggtgctcaacggcgaccacgccgacgaggacgtgtacccgcgcaagctggtggaggggatgacggtggcggaggcggccagctactgcaacgccgccttcaaggcatggatggacgagtgcgaccgctgcaggaagtgcggcgaggacgggtcccacatccccacggtggtgaagccgccgccgccgccgtcgacgtcgtcctcaggctctagctcctttgcttccaagttgctgtcttgctttgcgtgtggtcgtcctaacaagaattagtcagtgaagatggctgattaattgcttattcatttcgcttgttgattactgtatagattattaatttggttgtgcagggaggagtacagtactaaggccggattttacagagtgattatgggtggtgtgtagattattgatgtgatgattgtattacgaatgttggtttactgatcctgctgatctgaccagaaaagaactctggaagttcagctcaatcagattcgtcattgagacccaaaagtttccattaagattgcatagtacatcaccaactggacaaatgaatagcaggcaaacagaatatctggaaaagaacagagaagctaagaacaatttcacaggaaatgagtaacagttagaaatggctacaaaatcaaaatgttacagctggagtttatttcaacggcactaagatggcccagagcagtgatctacaacacatcatgctgtattagacaggcatttgaagcaggatgaaaatgcctgctcatcatgtgcagacaggtaatgctactaagttcatctaggaaacattggacacgtttaagcgtaactttaacgccttcagctcaagaagatataagcgggattggtctcacagcaccctgtatacgacggaatgcagtcttgatcctttctctcagtgtagcattttcacattcaacaccaccactcctcccatccaagtgtgctacttgtccatccacagatataacaagtttcccttcctctgcaactttgacatcaccaaaaagtgacaccataagagcataaactaccttctgggccaccctttccgtctcttcctgtgtcttcactgcttcttcaactgggacaactttgggaccttcacggcctatgttcaagaccatggcgaccacagaatcagacaccatatcactgataggatcagacgaccactgcaatgtaacatagctttctgattccaggcgaatggtcactctctcatgcacaatcaatgttggaacatcagactcctctgttgatgactccacgctctcatatatttgcttcagtctgtactttatgacttcaaaagaaccagaatatgggacggcaatcctttgggtaatgttagctgtagatagctgcgtgtacacacggagatcctcaggagccataatttgatatgtgaatcccttctttacaagcaagccattaactgattctccagcttccggtaccttttcagccaacctgccaattgtcttggccattttctcagaactgaaatacatctccactgattggcaattcttggggttaacaacttttatatttgtcccatcaaactgagaaataagcttctgcttaagtcttgacatctcatttgcttccccgtgtacaagaacaatgttgggtggctggagctcatccaagaaggtgcttgtctgagggaaatcagcatgagcagaaaaggaaatatagtggacctgcatatgaagaggagcagtgagcccattcgccagtgtcacttctcttggctcgttaataatggtctttgcaagggtgccttccacaacataacctggaataacacatgaattcttcttatctgtgcaccatttgtcaaagagctgcctggagaggccactctggagaccacctgggcttgccataaccactgatggacccacatcatgaaagttatctatgctattcaaagactcaatatgcttgaaatggaagggattagattgtgcaaactggttcctaatcctttcattcatggagttgatgtatgtctggtagacagccatgcatttcttggcaagaggggaggcataatagattggaatcttatggagctctgggtggttggcccaatactcatccaggataagtagcagctcttgagctcttccaagagcaaaggctgggataagaacgcgaccaccctgcgagacggtcgtgtgtattacatcagtgaagcgcttctctcgtacatggcggggttggtgctgctgcacgccataagttgactcgataatgcaaatatcaggggagaactggggaagttcagcagctttcaggtggcgatcttcctcacgggagtagtcaccagtgtaaagaacgcgaaccccagcaatgtccaccatgaacattgcagcgccaagtacatggccagcagtatagcaccagaagcgtatgccattaacttccaatgtctggtggaagtctatgacctgcaaggcatttttatgttaacaaaagtattcattcactccatgaaatacatacaagctttcgatcatcacaagaagaatcaacaatatgctatatggaaggaaatggtcaatgtttacaaagcaacaatcagatgttacaggtttctcagttgattatcaaccatctagaggatttctgtccattcaaatttgttctaacatatgcatttgaaaggggtcgacaaagtgctgtactgctatataggcaatttaaatccattcagggagataaaatacctcaattttatccatggaacgaagaatgtcttgctcgtcaaacagcatatcctccacagaaactttgctgactttgacataatcggaaaggagcagcctgtagatggcctttgtggcatgggtcatgaacacgcgccccttgaatgtcgtctgcaaataaaaccagagcaacttgaggatgctgaatggtatcagggcaatagctgagcacttactgtcgaagcaaaaaaacggaagatggtggaacattaccttctccaagaagtagggaagagaggcagcatggtccaagtgaaagctgcaaattttaagggcgaagttaagcaagagacgcacagatttgacagaaggggcaaagaaaataaaagaaaaagggtgaaaagagagtggggggaataagtactgggtgattaggaggacatcaatggtggagggatcgatctcatcgaagtaggggagcgccgccatgccggagtaagccgggtggatgccgcaatcgaactatccaagaatccaaaccacaccacaccacatgacaaacaaaagcagaaattatcataaaaaagaaagcagtggaagctagggtttggagggaaagagtggggggattggatgctcacgaggacggtgcggcccttgaatgacatgtagacgcaggagcggccgacctcgttgccggcgcccagcggagtgatgatgagctggtctccctcccgcccgccggaggcctgccgcttccccggcggccccccggcggtcggtgcggcggcggcggcgacggacgacgccattttccccttcacttgctgacgagcggagaaggaaagaccttttagggctttggacacggcggactcgaagcaggctgaattaagttgggcccggaagggcttgcagtccaagcagccctggagctggacagtaagttcactttagctcccttaaccaatctaatttgtatcttgaaccgcaattaccgggatttctagccctcggcccttcgccgccaacactgctccagatcctgcaccgaagtggagaggaagagaaacatagagagagaagggagaaagagggaagagcaagaaggatagaggggagatggcacgggggcctcatattttttattgtgtgaatgacgaatggggctcacacacatatttttttttaattctaatgccatctaaactccatgtcaacactcacgtccgtgaaaccgtcctccaaaactgctgagggagtcaaattgcatcggttttaatagttgagggatcaagatatcccatattggagttgaaggaaacgaattatattggttgagatatcatggagctggagcataactttagcacaactcagctccagcttcacgtcttctagagctagagcctagcctaacaatttcagttccaacttaaatggatcagagttggatggggaactctcacaaaatgaactagagatgtagagctgggtttagactgctccacaactaaattctagacctaacgtctggagctaaatttaggagttggagctctaccaaatagacccagagaaattcgatagcaggcatggagctagcccatcgagctagactaatggggagaagaagttgagtcgtgcaggcttgacgtacgcaaccgtccttgcattgatctataggtgtcttaggtggtgtttggatccaagggctaaaattttagtctctatcacatcggatgtttttgacactaataagaagtattaaacttagactaataataaaactaattgtataaatgagagctaattcgcgagataaatttttaagcctaattaatccataattaccacatgtttaccgtagcatcacatagactaatcatggattaattaggctcaatagatttatctcgcgaattagtccaggtatggtatgagttttgtcattaatttacatttaatacttctaatgagtgtctaaatatccgatgtgatagggactaaaattttagtccctgatccaaacaacccgttagattcgagggctagtttattcagtttgaggaattttaatccatagaaataggaaagtgaaaaaaaaataaatgcacgtatcaattcatatgaattttttcaaaagatttgagtgaacggaagtcttcctatgttttttctctacaacttaaaggaaaagaaaaaattcgtttggttttcctataacttatttatacaaaccgaatgggaactgtagaaattatttttgggaatccattttgtttccttcaaaccgattaaaccaatgcacaaaaatgctaattgtcagggttatggataccacatacctaatagtagttgacttaatctcgacaggacccaccatataccatgtcttatacggaaacaaccttcggatataggaggagttccgtataaggaaggatgaatagagttctacatgaaaatggcaatgactactcggagtatccatattggttttcctagttctacttggacaaggggacacttatgggtataaatacaaggccccctaagaggagaggggacacggaacaatagatcaagacataagatcaacatacaagccaacatacgccaagacaagacgctggatatcgacttaagagataagcatggctagtcccctatggtgtctacagatgctgttaggagagacatagcgctgtctttgatctcaccggatgcggattcgatgaggaaggctaccctgttgtcgactacgagtcagaactttagaccaccatattgacaacagttagataggctaccccaaatattgtactggtgtgactatggtaaataagagcaacgaccggcttcggccaacatgagtagggttattacctgacaattcaggggcccggacatatatacaaatccttgcctccgtctcttttacctaaatctcgcgtatatcctagtaccaacgatccccatactatgcaaataccggaatcgcgacatcaaacgtcgacactaatataatgttcctatgtagtcacgtgcctttgttggttgccctgttcacatcgtggttctcactaaactgtgatcttcactcaaccttttcaactccgctcactcagtttttacgcgtacgtttcctaaactattaaactgtatgctttttaaaaagaaattctatgaaaaagttactttaaaaaatattacatgcgcgagagattatttctcacctccaactaccgaacacagctttaagctacccatcatggcgttactaaactacgcatatagtattatatatggtactacctaattcaaggtcttcgtatcaaagtctttgttttttctataaaaaaaaacaaacgaagaagaggaataaatagatggctccacggctgccaataaagcgcattcccgcaggcgcgttcaaatggaatcaatcctttttcacatcatggtgtcactaattttatgcataatataagcatttctgtaatgattcatattactccaataattgcaatggtcttagagtcaatcagatcgattgttacaaagaaattcaaacatataaaaattaacaactgaatgacaaatatggaatcttttagcctaaccttagaatttattaaacacctattacctcgcctcccaaaatatatagatttttaggattgtacatggttatttaaaaatagctaggtataactaaacgagagaaaatcgtgattgagtgacaagtggaggtatgtggggaaattaaatggtggagaattttgattagttgggaagagaatattgatggagaagttatcatattctagaacgaattctagagattaaaaattattatattttggaacgaacagagtatatagatccttgaaatgtaaacatagacgggtacaacacaaacacaaatattgaccagacgcgtcaatgccccccccccccccccccccggggggagtgcatcgattcttttacaaggaccaccttcacatcatgccgtggatagtctatttcaaagtttccttttttattattaagaagaagaagatatagactctccctcaatggcttacgagccgtagccaaaatttaaattttaaaaattaaatttgaagatgattttgaggttaacttattaagttgtatcggttagctcacctattaagttttaagttttaggactatattgcacccacatgtcaattcaatctcccgtgaatataatttacttattttttaaaatgacttaaaacacatactcctatatgcaaattttacctctaaaaaaatttagttgctttagttcaatttaagtcgtggagcaaacgataaaattggtagtaatcatgcaccatggtcgccgaggaggcatgtcaatgtgttccgacacgtacactagtaaatgaaatggcagggggagggttaggtgaagacaaaaatgtgtttttcataaaagtttcttctacttagtgtgtctagatccagggtgaaaattttttaccgtatcaaatcggatatatgaacacatatttaaagtattaaatgtagtctaataacaaaacaaattacagaattcacccgtaaactgcgagacatatttattaagcctaattaatccgtcatcagcaaatatttaatgtagcactacattgtcagatcatggagcaattaggcttaaaagattcgtctcacaatttacacacaatctgtgtagttagtttttttaatccatatttaatacttcatgcatatgtccaaacattcgatgtgacaggataaaaaaaacttgctaggagatctaaacaggccattatatatttctactatcctataatatcattatatatttctactatcctataatataagacatggtcaaacttgacacggtaaaaaaaaactaatcttttctcttataatttatcatatattataaggtttgtagtgacaaaattatagccatacgaaagtaaattcaaatgtcaattcaatatacaacttttagcaagtaaaattcaattcatatcgtactaaatattggtcattttgaatgtgaaatcttgaaatacgcgagcaccttatattatgtgagtatcttataatgcctatcctacacattttgttaactttattttttaaaagatactagtattatattagactagccagggaatcatcaatcatcattttttttgaacgaaatcaatcatcattttgatacacgggttctttcggaggtgcgcttcatcaagcatccaatccacttgaaccacttgactgctcctaaaagcaatatataagcagaccatcgtctagctaagcttatgatcatgagcaaactcctaataaaattcctcacccataggaaaatcggagcaacgacgtacacgctcaaattcccacatacgcgcgcctcgatcgatcgatcgtctctaagtcgagtcgttggtccttgtgtggttgaaagagagagagagatgaatatcgggcctagagaacagagagcatttgcgagaatgacgccagaagaccgagcgtggttgataaagggcaagtcgggggtgctgacgtgcctagcgtcggtccttctgctgtcggccgggagcatcaaggcccccaagacttgcaccggcggcatgttcttggggcctataatcgctatccggctcttcctcattgtcatgttcgtggtgggttcgtgtggcctgaagaaaaacgatggtgacctttacgactgctacctcctcggcgtgtttttggcaatcctcctcctcctcgcctttatcatcttcggatacgttgccgtgggaggcatcgacgcggggcatgcggcgaatgcccgagagtacagcctcagtgagtgcaagcgggggtggcttaggggtcgcgtcacccactcctcgcatttttgggcatcaaccagcgcgtgcctccgccgcagccacgtctgcaacggcatgactaacctggtacgcaaccccgacaccggcatttttgttccccgcccatcctccttcgaaaggtgggccaagagacacggggtggacgccgacccacgtgtaatgtcccctatcgaggtacgtaccgcctttttctctactccctccgtctcaaaatataacaatcttgtactagataggacacatattaatacaacgaatctagacaggttatactaagatatgtcccatccagtataaggttgatatattttggaacggagggagtatcattcgcatgcacacctataaaactagcgagaagctccgcgcgactggatacgtgtcgcgcgtggagagaagagcggcgaacactaattgcataaatgagagctaatccgtgagataaattttttaagactaattaattaatcagtaattagcacatgtttctgtagcatcacataagctaatcatggattaattagtctcaatagatttgtctcgcgaattagtctagggttttgtcattagtctacgttctaattaatgtcaaatattcgatgtgacaaggactaaaatattttagccctattcaaactcccccttattaggttgtgtttagctttaccctgcgttcccaactcacatctcttgttattttacctagatgactattctattacattgatgtggaaaattaagttatgtaatatgtataaataagatgtaatataattattaaaacttaaaaaaaatgacttgcatctacagtctggatgctgcaagccaccatcatcgtgtggattaacatacgtgaatgggacgacgtggatatcgacagcagcatcagcaggtgccccagctgccgttgcccaagtaaccaacaacaacaaggacgacgactgtagccggtggagcaacgaccatcaaacgctttgcttccagtgcgactcgtgcaaggctggcttcctccgccacaccagtcaggcctggagtgtcgctgccatctatatcgttctcgccttcatcgggctcattctttcctcacttgcactctacgcagatcaagcaactgggaataataatactggaagatcacgatgagtactagctagcagctactcccagttatatatatacatgtgcgtgaaaatctctgaagcttaattcatttaccttttacctgcagtacgtacgtacgtacaaaagacgtactaggatcgcatgcacgtgcgtggtgtgtaatggtgctatatataaaggcctggtccttaattaatttgttaacgtttttactgaaactagctactctctccgttttatattataagtcgtttgattttcttactagtcattatcaaattagtttcattaaatctaaaattgaatatattttgataatatgtattatttacgttgaaatactactatactcttctagaaacttgatcaaacttaacgagttcatggtgccttgccactatactctcccagcacacttatgctttgtcgtcatcatggttacattgtggtgtcctctgtccttgatatgggatgttaggtcccgatcttccgataggtactgataaacagtcgatttgtgcggagtcgtgacacaactcgatccggcttttgaacgaacacgctactgaggctcacaatcgcagaaccacgtctcctctggttatcaaccgtgccgaaacccggttgacctcgccgagaaggctaatccctgtatgcaaatcgaagaacacaagcaagaacaagatatattgcaaccaaattacatatgaatgattaaacactcgaatttggggttctacaaaccgatctagcggcgaaactattcttgacagaataatataagcaaaacttgactctaaaagataacggctactgaataaatgtgattagggacgtcatagggttgccctagcgcgcacacccccttgggctaagcccacgacacaattacaaggcccaaaacttttccacacacacaaacttccaacttttctgtcacatcgttccaattttaaccaaactttcaattttagcgtgaattaaacacaccctaaggagaaataggactatatttttggcaataactaagggaaagcctggaagctttcatggacactgatgtcacaaactgcacactttgttgctaatcagagatgctgtactgctagcgatcagacttggctgcattttcagtcgcgtgatattttgacagcaaatatttgatcattgcacacatccgcaagccatcaagacgatctggaaacgggaaagatctggtagacactattgaatcgcaaaaccacgaagctatggatcaccaaaaagatgcaaaagattagccctaatcgcaccgtgattaagcagttgtctgcgacgtaaccaatctcactttgcatagtattacggtctgatccaaagagagagtataaagctaggttgttcctgacaatcaaacttgttcctgacattacactatctcacccgtccgtcactaaggtgactaactaaagctatatcatctctcaaaatatcgttctgatggtcttccagcatccttttatagcattcatccaaaagatcgttcttgttgagatcaatcgtagcatgtatagtgaaatcagattagaaacataagcatctgtctgaacagagaaatcaggcagcccactagtatgctttcctaagactatattcctcaattaccaaatcaaacacgtctgcaaactgaggatttcgctgcgccgagccgctggccgcgcagccaacgatttttgccgcgccgctgcctgccgggaggaagtgaaaacctgcatcagggagagatgcggttcctacgtcggggcgagatgcgatgcgtcggacctgatgcgaagaagcgaagaaaacatcccataccaaaattacccctaaactatattaggatattactaatctatcctataaaattaatggtcaagattaattctacttgtggtagaatacttcaagtagagagcattggagcgtaactcttctccagaatatacaaatcggtcacctgctccactcaatttacaggcataacgctatctactttcatatttagtgatgggttattaatgtatgacctggatagaaccttcgcaggcaggccaatttcctaacagtttccatggtgtaaagcagtagtaaagaagaaaaggtatacgccgagctttatagagaaagcataaagtgtctacaaggtaactgctgggaactccagcttacaagacaagacggatcaaatctttcaagctcatgatgttcttacaggcattgaggtttggagttggcctcgtcgccgaattgcaaacacctggacgaagaagacaacggccagcctcggcccgtcccctggtaagttgtactgctaccagatgtacctcttccttctctagtcgctgttgtctaaaattatgagaaacagctggttggtagttagattttaaaaatttagaaaggctgagtttcgcagcttctagcatctagtttattttatgaattctacaactatagtttctgagaatctggacaaaaagctggactgtttggggagcttcttattctgggagaagctgcaacagttagaagttggatatttttttaccatgtcagaatgtcactataatgtcttaataatagttttttcttcttaaaatatagcaatctaaaatcgaatgagacacgttctagtaatatgaacgtagacatgtcccgttcagatttatggtatatgatatatctcatccgatccttgtatttttagacagaggtggtatagtagagccccattgaatgtgatttcataatattttcaaaattagtttttaagtcgttaaaaataaatatataacagttttatatataaattaatttggctcatttacgtattagaaaatatgggtaagtgggcaaccgatggggacagtagtttagtggcgtcatcctgccaaggagcctggaggtcagcactgacgttgctggaggtgagtagccatgggccaatggccatggcatgtaccggccggcggccggtgcaggtgaattgagatgagaggctcaacttgtggctgctttattgtgttaccggtgaccgacgacttggaccgtcaaatgcctcgtcgcgcactagtggaaattaaggcagacgcgtgagctcgttttataatactgaaatactttctccatttcagtgaacagagggagtatagttttttctgtcacatactcatgtggaaatactccctccgtttcaaaatgtttgataccgttgattttttagcacatatttgatcgttcgtcttatttaaaaagatttgtaaaatatgtaaaactatatgtgtacatgaaagtatatttaataatgaatcaaatgatatgaaaaaaataaataattacttaattttttttaataagacaaacggtcaaacatgtactaaaaagtcaacggtgtcaaatattttgaaacggaaggagtatcatactagtctctatacaaatatttttcttttctttttgttactttatggaccctaaacactatgcatgcggtggaaaagtttgggagttggggaccctcgatttctgctaaacgacatgacttttaaaaaaaagaaaatcatcggattttcttagaatacctttgttaaattaatttttaactttcccattgtcggcattgacctcagctcagacgaggtgacgaatcctagcaaaaaccgtgttgctttcaatataagcagagtcttttgaccttttctctagaaaaaaaaaaagacgaggtgacgaagctgttggaaatttggtcataattcggcatattttaatccaaaataacaagataataaacatgatatttataatgggatttgatccagtgataatggtgaatgtaatcaacatgagcatgcttaacgttgaataagcatcaacaatcacataatgacacaatgttgacattgcgatgaacattaacagtaaaacttctaagtgaaataatgtaataaggttataccccaagaatggtcctccgctggagtttgaggcagtattgcctccgttggtgttgacgggagtctcctt

SEQ ID NO: 21064 - DNA, 4804 bp, Oryza sativa
ataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagaagctgagtctaaaggtgattcgattcataatgcatatgcagtccacttgagtcacaggactagctagctattcccgaatggacaaacgtacggttgcaatatataagcagccgagcatgcatcgttgggagcaacatacactcaaattccctggcaggctcatctgtttgttgggagagagagaagagatgagtaatattgggatggggatgggggtgatagaagctgggcgatttatgagaatgagttcagaacgacgagcgaggcacttggtgggcatgggtgttgtgctgacgttgaacacgtcgatcctaatactgggtagcgccacccgtgccccgacgcattgcacccgtggcgtcttcttgtggccctgtatcgcgatcggcctcttcttcatggtcgtcttcatcttgggcctgtgcggcgcgaagaacaacaacgagggtctcttcttctgccacctcctcggcgtgttcatcgccatcctcgccctcatcggcttcatcatcttcggttacgtggccatcggaccaggcatcgacctcagcgatgtgaaggcacgcgagtacaatctggacgactacaagagcgggtggctcagggctcgtgtggacgacgccgcgtactgggcaacaaccagcgcctgcctccgcggcgacaggggcgccgggtgcaaggccatgacgaaactggtccgtgacccacactccggcttgttcgtccccgacggcggccgccggcacgtcgacatgtcacctatccaggtatgtacgtatttttgggatatatggatcacggatagtttacaattacatactactatcactaattggaacctctccctagtagcttattataattaactgaatatatagtctggatgctgcaagccaccatcatcgtgtggattcacatatgtcaacgggacgacgtggacaccaacaccagcagcagcaacaaacaacgtcgactgcagcaggtggagcaacgaccaacaaaagctctgcttccagtgcgattcatgcaaggcaggcttcctcgaccacaccaggaaggcctggagctcggctgccttctttcccattttctgcttgatcgcggccattctttcatgctgttcaggtttaaaatatggaggggttctccatgaataagttgttatcttactttgtttatttttatcatgtttaggctttgagccaacaaccttataataaatgattgttcctttgtttatttttgtcatgtttgggcttcgagccaagaactttataataggagactgtagcttctctcaaagcaaaagccagatttaatattcattatctaaaaaggttggaggagttactagatgggatacaaacagctcataagagttttcatattatatttattgttatttttttaaaaaaaaatagaaaatgatttttttatccagcctctatatccaaccggatatatacattttttttctaaattgggaacttagtccatcaaacagctcagtccgaaattcacgcttctatggaaatttgaacctaggaccttgagatgctactcttatttgttgctaattaagtttcaagagaaaggagagaagtttaaaatctgaattaagttgaagcaggctgaattaagttgggcccggaagggcttgcagtgtacgtgaggcctggtcaatccaaacagccctccagctggggaataagttcgcttaactatcgaccaatctaatttgtatccttcaacccgatatctcgatcccaactataaaaaccgatgcaatttaactcctttaataattagaggttttcctggtttcgctgatgtggcatctacatggtagtgttacattggtctatgttgttgatatggcgcttaggtggtattagaattaaaaacatatatgtgggtcccattcatcactcacccaaaagaaaagagggctgctatacaacggaatcccgttgtgacgagatgataccggttaggtatgaggttctgatacctctgaggtatcatgtcttgatatctaaccggtatcatgtgatacttgtgaggtatcatgtgatacctataaggtatcagacgattcctattacgtatcaggtgatactcgcgaagtatcatatgatacctgtcaagtatcaggtgatacctgtgcgattcctactacgtattaggtgatatttctattcctaccacgtattaggtgatacttgcgaggaatcaggagccgggcaccaaagcatcgtcgccggtgatcccaccgtccacgtcggagctcgtcgccagcggccacatcctccaccatccacgccacgtcggagctcgtcgccggtgtcagcgtcctccatcatccaagccccacgccgaagctcgtcgccggcggccgcatcctccaccgtccacgccacgtcggagctcatcgctggcgcccgcgtcatccgtcatccacgctccacgccggagctcgtcgctagcggccgcatcctccatcgtccacgccacgtcggagctcgtcgccggcggccacgtccttcgtcatccacgccacacatcggagagagccccttcctcttctccggcgatttgctccctgacggagcggcgaggtgaggcgaggcgaggcagcgggggccttctccgatgagctcctctctctctctctctctctctccgcttagcaagcccccttcttccttcactaccgcatgctgccattgtgttgctctgctgccccgcttagtgctctgggacaaataagaagacgataccatcacgggtgttgagaacgggataccggtatctagctttttcgaaagaaaattgtggggaaaattaattaaggttgtaaagtaagtaaaagcgaagaagactaggtatattctttcttcgatactttattcatcggctagcccaggttttatagcctgcgataataaaaaggttacaataattgagctcaatcaacactgattacaagctctaagttcaggaacgtacacgagcaacgacaaaatgaatgacgtaaatacgtaaagcgcaccggtgtatcggatgtattcgaactgtacgtgcggcttatgctgtatatatatgggccggtcgaccgtaattgtgatgtacgtgcggcctattatgctggagcgggaatgtcgctcgcatgataagttcatgtgaggtccattaacttgtcaacgaattcgatttccgtccttcaaccgaaaaactagatacaacggatctgtcaactgttaaactagtgtagatgaaatcccttagcggttttggctgacgtggcggtcttcatctaactggcattgatataacgtttacgtgacaattcgattcgaaaaataataaacccagtgagacccaactgtcagtttcacacccaaattaataaaaaatggtgggtccacgtgggccccacatgacatttccactcctcttcatcttcctcctcctctctcccctctcccctctcccggcacgacagagagtcaacggcgggggaggggaggggattaatcggcaccaccacatccacgcgacggcgaggaggcggcgcggcgatcacataccgcaccaccgccgcacatcctcctcccccggccggggaggtcacgacatagacggatcatccaatcatccgatcactgccgcagccaattaacttcagagctctcgtaggtgttcgtccatttgtgacagtagcaaagagaagtggtgagtttgtagtgttgctgccatggccaactacgcctgcgtcgtcctcctcgttctctccggcggggtggcgttggcggcggcgtgccgaggggttggagccagaggcagccagccgacagtcagcatgggtcccacatgtcaaggcctattcatctctctctctctcttcctcccttgttcccatctcactaggcaacgagcagtgagctagtgaggagaaggccggccaacgacgggcggtgccggtgaggcgatcggaggctgttttgctcaagcgggaccatgacacgacgacgtacgtcctgtggagaaactcaccagcacgcgcgcgcgagctggactcgatgcatatagcaattaaaacacgccctacagtgctggcatgagatcattgaccagatggcgataggcacaatagataagagacaaaaataaaaaagtttgtttcgttggaagctacttctattaagctaggtagggcgcgggacaacatgcaaaacgatataccccatattactctctccgtttcaggttataacatgtcttggattttagtaaaagtcaaactgcttcaaatttagctaagttaataataatatttatattaccgaattagtttaattataaatatatatcttctctactattataaaaattgaatatgtttttgtcagtattttagtacgtctgtcggtgatatgggaccgggagtatcatggccagaggcttgaggcagacgcaatcgcccacgtggcctggcaccttcggggacgtcgggcccgagggtgaggtgtccgccctcctcctgatctcccccgagggggggtcgggttgcgcttgccccggcccctaaggccgaggccccccggccccttaaggaacgtctgcgccacatatatgg

SEQ ID NO: 21065 - DNA, 15778 bp, Oryza sativa
gcactcgtctcaagccggagctagcgtgttatctcttagagataacacgttagccctggtcagatttataccaggcttcatcctaaccattacaggcaaggtgttacacaaagaagggcgaacatgcatgttgttaagctgacgcgtggtggacaagaatgaccggtctggcactggtcgcgtcagctacgggcagccacgatcccacgttgcgcctgtctccgccgggagtggaggtaggtgtgggctgtcccatcggagtgtcattcggacagcaatcataccaatctccgtccataaagagaagaaaagtccagtttggaaagggaagggtgcatgtggtatccccttgaagtataaaaggaggaccttgcccatagagaagtggttggttgattcttttccagattgagagctgagaacgggggagaagtcgactcacactttgtagctcattcatacacaaatccacaaaaacacaggagtagggtattacgcttcgcagcggcccgaacctgtatacatcgccgtgtctcgtgtgtcttgcgggcgagtgatctttccacagacagagagagtgagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcagactcttccgtgtgcgccaagtttttcttgttctgcctaatggccgagcaagcaaaggcgcacgacctctctccgagtgtgagcggcgacgacggggagccaaacccacgccgtcgagctcgtactcccccgcctccacaccaaagtcctaagcagggggaggcgctcgagagggttggtaaatccgcagcgtcaccggttgcgggtgatgcaggagaacggcgagatggggagcgttgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccgccaccaagacttccggcgccgctaccaccggttccgtgtcatcaaggcggagggcgcggcgagcggcggcggctgcacggcattcggctaccactccctcgtcgacaccttctgactcgggaggatcagcatggggagccggatgcccgcctcaacatcgagcgccggcgtaatagccggcgtactccccgtgcaacggagggcgcctcctcgtccagagtgtcacctcgacatggacgtgaggatcagccctccgtgcccccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacttgtcacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagttcccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggccctcaacatcctttcccccgtggcttttgatgccatcaaggccccggggatggtgctccgaccgtcccaaccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggccagcgttggtgaagttcatggcggcggtccactacgcctacctccagatgaagatgccgggccccggtggccccatctctgtccatggcgatcttaaagtcgcgctcgcttgcatggagcagcgcaccgaccgcctcgctgctgcgtccaagcccgagggtggtgacgagaggcttggcccctctgcccccaccgccccgaggcagcggattgccacatacgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatagtcgactccactgcggggtgcgaccttttgtgttttctagatgcatactctggttaccatcagatccgcatggctagggaggatgaggaaaaaactgcgttcattacccctgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatccgcccccccagcaaacttagggatgtgcagtgcgtcactggttgcatggccgccctaagtcgtttcatatcgaggctgggagagaaggcgcttcccttatttaagctcctcaagcgttcggggccgttcacttggacggaggaagctgaacatgcccttactcagttaaaggcatatctcagctctcccccggttctagtcgccccggagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccctgacgaccggagtcggccctctgcccgcttgtcaaacggtgctgagtgcccccgaccctcaggaaggccccgaggccactgagggaaggccgcacttatcgccctttggccccgaggctaaccctgtgctgattcgacccgggagagagcagggagaagaggcccccgagtcgaacggaggcctgaggcccctgacgaccggagctggccctttgctcgcttgtctgacgacgccaggagcccccgacccccaggacggccccgaggccactgtgggaaggccgctcctgtcgtcctccgaccccgaggtcatcggcacagaagacgagtgtgccccgaggggccacttggacgaagagcaccccggggatacggcccctagcgaagaggatcggccccgccgaaaggtgcagcggcctgtttactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcgcggacccctcacagctgcctcacgccgcccactgggtgatgcaattcgacggttctttgtctcttcagggcgccggtgcaggggttacgttgacctctccaaacggagacgtcctcagatacttggtccgtctcgactttcgagcgactaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcatcctcgcgaacccagaccccaccgggcgcctttgaagaaaggcttacccagccgtcggcgcgacccgaccccttaggggagacggatgcgcctgaccggcccccgaggcccgtcggagtccaggcctcgggacctgaagggagcgctccaagctcccttagattgattgcttggatctctgagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacagctctcaatgatgcagtcgatctggtccggcgatgcagagcgtgtcagttccacgccaggcaaatccatcagccggcccaggccctgcaggtcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggggtgcctaaccgtattattacggataatggcacccaattcactagtgaactcttcggcgactactgcgaagacatgggcatcaagctctgcttcgcctcacctgcccaccccaggagcaatggccaagtggagcgcgccaatgcagaaatccttaaaggcctcaaaaccaagaccttcaacattctcaagaagcacggcgattcatggatcgaggagttgccagtggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaagggggggtcgggtgtcaggttctggctcgggccaaccccgcacccccctcgggtgtgcaggatcggccgggggctaccacacatgcacatatattcctttttccttcatttcagcatttcaataaaaacgttttcaatttcctaaaggttgtgtctgtgccgtttttccttctgaagaatcttaacttgagataaagtcattcgtgctcaaccttgccctcgggggctcggttcggtcagctaaaatcgccaaccggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagcccgacccgagccattcgaggactgggacttgggcacgggcccttatttcaagctaaggcgcaaaaggaccatggcacagatcatcctcatctcgtatgtatagcaaaataaaactaacacaaaaattttttttcatcatttctgattgcagattaagttaatttgtacaaaaaagaggcatgaaggccttagaagaaagaaaaagaaaaaagattggcgggggcctgggggctcattctgacgcgcccgggtcgccggcctcgtcgccaccatcgtcctcaccgctggcatcgccctcctcgtcggagctgggggcgaacgcgagccgaggggccgagccctcgaagccgttgacgatgtggtcggcggcatcccggacgcgcgcgcgtgcatcgtcctcggtcccgggagggaactcctccagcgccatccatggggagaagttggggtcccgggcctggtaactcgctagcacgagttcgaccgccccccgggcgaggtccctcaaggatgacttaatggtcttctcgagctcctcggggagttgttcgaggacccaggccatcctgttgaggtgcggagcgaggccttccaggttggcggggcgcatcctcgtctggcctttccagaggcccgcttgccgaccggcgcgatccatgcgggagaccgagtcccaaagcatgtcgggccccatctcgcccgccaagcggagggcctcggcctccccgatggaggaatctagtgcgcgctgcatgtcagcgacggtgtgttcggcagccgcgaggcgagcggctaagtcgctttcgcccgcagccgccccaccgacgcgcgcccttgcgtccagctctttttcccgcgcctcgaggtcggcagcccgctgctccagtgcggctctctcggcgcggacgcattccagattgcggagcgcctgctcctcctgcgctgcctcgcggagggacaggctgtccgccagccgtttggtcgtggcctcagcctcctcgagagctcgctcccgctcagcgagtgcgtcctcgcggaggcggagcgtgcactcctcctcggcgcaggcggcctcgtgcgccgccagcgtcgcctcccggagaacagcggcggcctcgcggtccgtcaagcccctctccacggcgccggcgtgttcttccagcgccatggcacgggcctcaagagcctcctcgcgccgccgagacgccgcttcagtctccgttacccgccgctctcgggcagcggcggagtcaaggaccccttgggcggcgtcgagctttttcttcagctccgcctcccagcttgcgtgctgaaggcggagggtgtcttgcgcctcgatcatcgcggtggtggcgatgagggcggccgcccgctcctcctccacctcacgggcgatctctgccagcgccgctttccgggcttcaagctccgagacatgacggcggtgagccttacggcccacctccaccatggcgtccaccgagcgccgcccctcctcaacacgcgcccatgcggcctcgagctccgctcgttccgcacgcagggcctccacttgggcgttgaacccatccagcactgcggtgtttgcggcggccagggcctgcagaaggggctcggcgctcagcggggcgacagaagatgaggagaagagccgccttggagaaaatgcgacgcggcttggccccccggaggatgcgctgggctcggggatgtcccccgggcccgtttggtcctgggcgtcgcccggtgaggtaggcccaggcgatgcgcccgcggcctcgtcgcgagccgcttcggaggatgtcgcctgagggccgcccgagggagtgggcccaagtgacgcgccagcagcggctgtcgcctcagcctggcgagcccgggcggcctcctcccgggcagcttcttcggcttggcgagcccgggcggcctcctcccgagcagcttcctccgcttggcgaacccgggcggcctcccgggcggcctcttccgcttcccgaaggcgatctgcggcttcacgccggtcagattctcgcctccgctcctctgcggccgctggatcctcggcctcggactggccggacttggagtgacgggaggaatgcgacgggacatcgctgaaacagaagaaaaaaccagaagacgaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgttttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtaatcttcaggcccagtgtactcccaggcgctccgggcgcgtcgttggagcggcgcaatccggcgacggaggtaatcgccgtacaccatggccccggtgagcccctgggatcgcaggccagccaggcggtcgaggacggcgtcgtagtcctcccccagatctaccgtcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaaaaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcaaaaggaagggagcaaatccttttctcgatgcttttatacccttgccatcgctgggcctggctcctcgtttctcgcgcccactatctcgctccctcgtatctcgctatctcgctccctcgtttctcgtgcccacgtttccactaatcccattcgcccgcttacggcgcgtgaagtggatatgcggttgtggcaatcgaaatggattgtatcgtgcgcgcgttaattacgctcgccgaccgaagcggcgttaccgtatctccgggcgagacagatctgctcacccagattcgcgcgctgctcaagtggtgtggcagtcttgaatagaccgcccattatggacaaccaaagttatcaataccaatgtgcatggattgagaccgttgggtattttgcccagctacggaaaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacgcaatcgcccacgtggcctggcaccttcggggacgtcgggcccgagggtgaggtgtccgccctcctcctgatctcccccgagggggggtcgggttgcgcttgccccggccccgagggccgaggcaccccgaccccttaaggacgtctgcgccacatatatgggataagtgagcacagctgtgctcacctaacagcatttattgcagtctggtcaagcgtgtcacgctgcatgcaacgcagcacagcgcgttcctttatccggtctgtgaccagtcacagaccggtcagatcacgggttaggtggcgactgacgggctgacgcacgctttgccccgtcccgtcaagacgaaagcctctaggcactcgtctcaagccggagctagcgtgttatctcttagagataacacgttagccctggtcagatttataccaggcttcatcctaaccattacaggcaaggtgttacacaaagaagggcgaacatgcatgttgttaagctgacgcgtggtggacaagaatgaccggtctggcactggtcgcgtcagctacgggcagccacgatcccacgttgcgcctgtctccgccgggagtggaggtaggtgtgggctgtcccatcggagtgtcattcggacagcaatcataccaatctccgtccataaagagaagaaaagtccagtttggaaagggaagggtgcatgtggtatccccttgaagtataaaaggaggaccttgcccatagagaagtggttggttgattcttttccagattgagagctgagaacgggggagaagtcgactcacactttgtagctcattcatacacaaatccacaaaaacacaggagtagggtattacgcttcgcagcggcccgaacctgtatacatcgccgtgtctcgtgtgtcttgcgggcgagtgatctttccacagacagagagagtgagagagcttgggattgcaccctaagcccctggtcgaaccggcaaaggggggcttgcgcagtctcccggtgaggggccacgagctccgtcaacgtcatccgtgtatgagtcggtttttaagttcgcttgcttttggaaatacatatttatatttgagttggtttttaagatcgttcacttttggtaatactgaaggaatcatataagaaatctgtttaaaaaaactcacatgctaactcgagacgattagacttctaactgtaactcataattttctaaaaaaatatatatccaagcgaactccccgcgataaatttcatcttaactaaaccatacaacagattaaaatagacttcacccattgcaacgcacgggtattttttttctagttttttaagaaatttatcttgggtcaaaaatatattttttctataaatttcatcaaacttgaagcagtttgattttgacaaaatcaaaacatcttataacctaaaacggagcgagtatattacaagattagacagtacgtatactccactgaatcggccagtagtagtatgtcatcgatcgatcgtgtcctgttgcatgcgtctgccgtgttctggtttctggtaggacgaactagattctatcaaatcgaatcgatcaaaggcaaattaaaggcatgcatgggacggcgtgaagtatgtactgtagaggtagaggcgtatccggccggccgggtggtcctagaaagccgtggtacaatgcaggcagccatagccgggcacgcaatgcatactgcagcccggcaaatcagtggcagtaggctgcaactgcaagcaaagcaagttcgtactactggctgcatcgtgtaatactccctccgttttatattaaaattcgtttgattttttttatcaaactttattaagtttgattaaactcataaaaaaaatttaggaatatctgaaatatcaaatcagtttttattaaatctaatattaaaatattttgataatatgttttgttttgtgttttgaaaataccactatattttggcacctcccaagctaaagcgcgttgaggtaaccgtgacctctgcgagcatgataagccacaccatggtccccctaccacgggcgttccgtcgcctccaaagtgaaggtttgagaccgctggcaatatatacggcctcatcttttcgcttatgcttatcagtcaaaatttgaattttcaactttaaatttgaagctgattttgagggttttttcatcaaagtttattttttagcctttacttttaggtcgctaataacacgtatataaaagttttattaacgaattacttctcatttacaaatatgctgtttggtttattttacaaataagccaaacaatgagggcgatagtatggcctaagtgttggagcggctacagtctagctagtacgatgggtaggcatgcagcagtgagcaagccatggctgcctcctactggccggccaagccagccatcctgcagcctagtactacttggtagctagttcctcctagtagagtagtactccgtagtacaagtatagtagcaggatgaggcagagaggccgggcgtgcgtgttgcaatgcaatgcattgggtgttttggtgcgtgcgtcgccggggaggggatcgatggtggatgaactggcatggcatcatcgatcacacctgtgccggccggccggagctagcgagcgatcgagcgaagacgaagagagaaagtgagagagattcctcagcatgattgtgtcgtggaaggaaggaacaagcatgcatgcaacccacaacccaagctgcaatattgcatgttcatcgtactacataggagtacagaccagtagtactaccctgctttgcttgctgcatgtcgcacatcgaccatctatctgtctctgctactgctacactcctactcctactccgcgatcgatccatcggtgtggcttggccgcaccgtcgtcgacccaaccacaaacgaactgtctcgtcctcctcctccatatccgaccatccgtatcagctgttgcctgccgcttcagcagtcgacccacccgccgatcgaccaacctgccactgctgactaaccgcgccatgtcctgctcgcaggcctcaccctctttttttttcacaaaagccttggggatcgatatttattatatatctatatcttacaactgctgacgcagattatggggattacagaggaaaggaagaatacgctagattgaaagacaatcatattgcactcctggaaacaacaagtaaacaaaaggagaaagagcttatgtctaagcatcaggaaaaactcctaggagactaaggctgtgttcgggcatccttgtacttacccatccggaacagtaatcacagaaaatagagtggtctattagcgcttgattaattaagtattagctatttttttaaaaaaaaagattaatttgatttttttaaaagtaactttcatataaaaatatttttttttgcaaaaaacgcaccgtttagcagattgaaaagcgtgcgcgtaaaaatcgagggagtgaggttgggaaaaagggtgccaaacacaggctaagggcacccacaatggttatctataagctctctacaagagatccatgtcagcatatctattatataattaaaggaatagaaaaaggagccttcacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagtcgctctcatggcttagaaattttcccattattgggagaaaaagaaagacagagtccatatagaaat

SEQ ID NO: 21066 - DNA, 12845 bp, Oryza sativa
ttaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtccgtctatatagaaatacaattaggaaataactgaaattcggaatgaaaaaaaggaatattagaagaggagactagagtccatatagaaatacaattaggaaataactgaaattcagaattaaaaaaaaagaaatatgagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaggtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccactatgcttgttttcctaattggaagagattaaatgaagagagagagagcaaagctatctactaacatggagatagtctatagagaaaaaagaggcaatggattagagagctatagatacccatgtagacataccattgaaatggtttactattaatctagtctattgttgaggtgtacatgttttatagatagcaccttactttaccattgcgggtgctctaagagcatgtacaataagctgactcagcatgctccaaaacattttatattatctaaatcctacgtggaagaaagagaattgaagagagaaggaagcgagcgaccattctgtcgccagcgctagctgcatgtgcctgcgcgcttccgaataaaaaatacgctttgcggaccccacaaccaaaccgtctgatcccctgtatgttcccatcttcatgcctgctttttctcttccgctccgtcgaatgctaggcgaaatctccgccgcgccaccaaactgcgtcgctcacctcatctgtgttatttttaaaccgcaccaacccaaagcttcccctttcttacatgattcgatcaacccccgtgttcgccgcccttatggacacgagcgttcctttctaacctgacctcaattgtcaacgcccgataaaaccgtgaatcgatttatactgtaagtgctaaccactagcagagcttcaagattttataactaggccgacaagtatttgtgtcgagaattatattttcaggttatataaaagggcattatagttcgtcgtgtcgttacataataatggcataatataaggtgtgtattagatgtaatatataccaagtagataacggatctagtaccaaatgtactaggttgtaacatctccgcccagggcttaataggattgataggatactcatatcaacaatttgtaacttctttttcagaagccgatctcgaaagaacataggttaagcgtgcttggttgcagaaaagacttgtgttggtctgtgagggcagtctatggcctatgaaagttgccagatgtaagcgggcccaggccggtctgcgagaggcgggacgttgcacaggcctcaggtgttgggtacataaactctccgtccctaaatatttgacgccattaacttttttaaacatgttggaccattcgtcttttttaaaaaatttaagtaattattaattatattcctatcatttgattcattgttaaatatatacttttatgtatacatatagttttacatatttcaaaagagtttttaataagacgaacgatcaaacatgtttaaaaaattcaacggtgttaaatatttagggatggagggagtatttaccaactattacaaacaacagatccacgattagaaaaggaggtgcatgcgcatgcaatatattgcatatgcactcggtgtgaaatggcctacgtgcatcagtaatgatgcagctaatgtccgatcaatcgtactaaaagaacatcaaacactcgatggatgcctgccatgcaacctaggcatattcatcaatggcaagtgcaagtgcaaagctagctgctgccgctgccgctgcacacgctccactcaaaacaaatcatagcgtgatgcagaggcctatctactgtgcgcacacgagtaattataagtgctcggattactgtctctctctccgaccatgcatgctgttcctcaatagccgctccatctcctcattagaaaatctctttttttttaatatatactactaccatttcatattgggttattgtattttatattatagacaacttgtctattatttcctccgtcctataaaaaaccaacctagtatcagatatagaccacgaatctagttatatatctatccagatttgtagtactatgatgtgtctcattcggtactatattcgtttttcatgaggcggatgggagtatctcataaaatatacgcgcaccaagataacattaatttgaatattcttctttatctggtggatatataggcctaatgggaaaaccgccaccgcccgcctaaattgttgccaaccccttcggcttggccacatgtttctgaccctctgccccgaaacggtcttacctaataattttatactataagctttttaatatagaatcattctatataaaattatttaaatccaatcagtattagagcaggtacaatagcaagctataagccagctgcaaacatattttaaggagataaataaggagagagaagagcagcgggctacagatttatagccagctgtagcatggactcaaagacacagtgtttgtatgacaggtgggaccaggtattaatagtgtagtatgtaactattgtatgaatgagctattagattggctatggatgaattgaatctataaaatcgaactttcagtgcattaacttacaagaagatcgaggaaattaatgatgtggcggaaaaagaaaaacacgagcattcgtgattcgtgtgtggcccggacaggcgaacattccggcactagcccttaatttcgatcttgtggttaaagtttgttatggagatcgtgttgacacttgacagagtggcctaattggtttcttatgctgcagtgagagcgttaacattgatgtatggctgacacatagcacctgatcattaagcaatggtgggcccttcattacagataaaacgccccctaatttctgcattgaaatgaagtgaaattgactaggtactagagtatatgatccatcatcataatagccatgcacctgtgttttgagtgtgtgtaataataacatctatggcactgccactaatacttgttcaattcatagctaatctgtagaggtttttcaagtctgaactgagattactttggagcacttacaaaactagagaatcaatcgatgctctcttttttttaatcaaggatgtttatacaaaggccaacactagaaacaacaacgttaatatagatagacaaaatgcaaattattgatggagctggatataattcagagcagaggattcttgtgcagcgagacaggggtaatccctagcgataacttatatagaaatttgatggataaagaaatatagtagtacatacatacagtctacagaagaagagaagagataagaaaagaaatgaaaagaaaaagaagaaagtagaaaagcagagtccgtggagcagagagaagagcaggacagagttaatagttatcacgcggtaaattaattaagagcgggacagagttaagagcgggacacgcggtaaattaattaagattatgataattttgaataggacgaatgggcttgcgttgcatcgctggcgaatggcgatggccggccacgcttgcagctcgagtaaccttagctatcactctgctagctactcctacgccggctcctccttccgtcgcatagtataacaatttgatattgaatgaaatattttacagtacaataaatcttaacacttttttacccagatttattgtacggtaaaattttttatttaattgtataagttgctatattataggacggaggaaatagtacagcagtgagtagctaggagtacaaacttaattactagattaagtagcgataaatgaatatccaggtccagttccaggggaggggacgacgcgcactcctttctccagctgcgcgcgcgcatgcgctgtgctttaactctctcacaagacaacctaacctaaagcaagctaagctagctcctacagggagtatatagcacgccggccttgcacttgcacctcacctcgcctcccttgtatatatacactcactagtacactagtagccggccggccggcgagcgagagaggtcgagtcgagagagatcgatcgagcgagagctacctagctagctaggctataggcctgcacacacatacagctagctagctagcgcgctcgagacgatgctggcctgcatcgcctgcgtcaagcaggaagatggcggccgccgccaggacacgccgcgcgccggcgccggcgccggggacgacacgcccacctgcagggaccccgtcaagacgctcacctcccaggttaatttcttacttaatttattactactataccttcatttttctccttcctttttgtttgctgctgctgcttcttcttcttcttgttgttgttcttgttgcaaccggccgggctaccttgcttgcattgcatcttgtttgccatcgatctgcactccagcttattttcgatcgatactatcatctgttacttaaccatctgcaccaccgtaccatccattactttcttgaggctccgatcgagctttaattaatttattaattattagctgcgcaatatataaatatatatatatatatatatatatatatatgtgcaagttttttttctatataaatatacactattaattagccacactatatgctcagtgtattactagtagcacatcgatcgatctgccgatcgaggatttgatcacggcacatagagggttgttatgacacccggcacttaactccgatcctgtaccatcgattccttcaattataatcgggtagtactgtcttaattcataattaaataaataaaataaaattactagtaaatgctaactgagtacgtacgtactcagggtcagagatgcgtactacgcacatatatgtgcagtatatacatgtacgtatatggcgttcgcgaaaaaaacttagtacgtactgtatatatatacatataaagtattcgatgatttcaccaatccaacacaacgtacaatataatagtacctgcagatgttgtactcctacgtaatgagtagtgtttagaacttattaatttactactactacgtcactagctagatcgattgatttggccttatatatgtactcctacgtgtttgaaggttctctagcactacttacatactcgagactgattaatttcaaaactttacatcgtttgtttcactgtttggacggtagagtttgctatatatatacacctagcttttcctcttgcttttttatatgatacacgcaaggcaattaatatcagagtcttatactctctccgtactcgtaaagaaactcgtttaggacaatgtttaagtcaaacctttaaaatataaatcattaataactctcaagttgttgagtttgaaaatgtaaaaattatatgaatagatttgtcttgaaaaatacttccataaaagaatacatatatcactttccaataaatatttttatagaaataagaagttaaagttgtgttttggagaccgtgaagctgttcaaaatgacttctttttttttaagtacggagggagtatatatatagaagaactaggtagatagagtccccaattaattgcattacggtagtaattaactgacaaaaagtgagtgagagagatgaagctgcagctacataaattaatggacatgatgatgaggacggaaacgataataataatacagttaagcaaagtgtgatgctgcgagcagagcagtaatgatcgagagaggatgagtggctggtcggccggccggagatcagagggcgtgcccgtgcagtcgctttcgattgagcaatatatatatatatatatatatatatatatatatatatatatatatatatatatatatatatatatatatatatatatatatatatgcgcgttgccatcctctctcttaagtttactatatgccctaattaattactagcttaataatgtttttatacaaccggaatatatacccctctattctaaaaatacttatatttttgaatggatgaagtagtgcatagtaggttaataataatgccagtgtaagaagcaaccagaggtattaccaaacaagagagaagactgacagtacagcaagactacaagagagacgactgaccattgtctcgcttggcacgtcttccgaggcgtacgtaggggcccaccaaccctacccagggcatggatgatggatgcgagcgggcgtgtacggtggatgcgtggcccacgtgtcggaatcatggcagctcaagctgatgctgctgctgataataacagcatacgctgctgcttttcgcagcttcattgctttggctgctgcatgcatgagactgtacatgatacagatgatgcagtactagcaaaacacaaaagccaggcgccaatcccgatccatcatccgatctccatcgatccatcgatcaatcgacctaccttactagtattgcattgcagctagctactaatttactgtaggatcgatcgagtaacaactgtgatccatggccggccgtgggctccattgctcccagcagctgcctccttctgctacctcagctcatcgatcgaccaacagcatgcagacatcgatcgatcagatgtctgcaagcttcaacagatgaagctgctaattaactattagcgccaaccttaattaaatagtagtagctacctaatcagtccaacgtcgtccatgtatctctatcacttttctcttttcttctttaatcgatcgatcgatcggatgaatactatagtatactaacacctggtggccggtcatctgccaaaaagaaacgcatctcacttctctccatctctttcggcgaattgaagctttagctgagcatgacactgacgctagctagctatctttgtgccaaagtcgatcaattcttctttctcttttctctttttgttattattatgcttgtctactagaaacagaatactggaagctcacctgatcaatcatccggccagtacctgcctttaacttcaaagcaagtttcgcgccttttttgccccggcctcttcacgaccgttgttgcatgatccatcgccatttcaccaatgctttcccagctctcccaatctgaaacttttcagagtagcatatcacaagttagcttgcagtagatgcctgattcaatttaaccaatcacccgtttcacccatctgatcaaactaatccatgctttggcatcaatgtgaaaccagaaaagatgtgccccatttagtcctgatcaacatttgttttcacatttggacttgctttgaatccaatgttttcacatccatactttctgtaaggataataccgctaccggtctaccatatgaaaatctgaaattagatcagataggactagatatattgtttttaattagctattcccatagatgtagcagccagatggacactgcacttcatattatttaagctaactgaacacagttactaatatttgagtgatgtggatacagttagttagatactgtatatatgttcaaactgaaactgaagcgggcaacgagatggtcaaaatgaggggacaggtagcgtagtgtaggctgtggctgccctggttggtggatgatcacctttcactttgtgtcgtttccttggggagagatcctggaacaaattaaagcaaagcacatagtatgcgtcatctacatatgtctattgtttctttctttcattcctcccccacaaagagtggccatggactattcccttgttcttttgtgacaaagaagctttgtgccccaacttcccatagctatgtgtccatgtcttttgcttctcattttctctcttttttcaacaccaaagtatatgtagtataaggtatgctcagagcttcagatgagatattgatataaggatggggctccagcatgctttctttctcaaaaggagagattgagagagtggcactagtgcactgcaatgcaaataaagagatcccctggttggatggatggatggggatgttgcactgcatctgcattgctgcttgcatgcttcagttgttatcagtagcacggcaagaatctatgtgcggggatgttcattgtactagtacatgtttttaacaataacaatacataaaagagaccagtcctaaagtgatgcttgatatcatgaaaggggaaaacaaactgtagatgaaacatacaggcgcatggacagtagtggctagtaatggagttaaatagctaggaagaaaatgtaaatatagtatatacttgtatgagataaaaacatacatatccttgtttcaggttgtgctgctttatatatttacctcatggtagaataagaatttactaccacttactgtgtgaagtgtggaacaggtcgtatttactttcttcttcagtcttgatgaggtagcaatgcaagatggcattgtgcagtctgagctgaataaagattacaaattgattggctataggtcaaatagtggatcctagagtgtaagatagtctttgaaaatgtcattccctgacccctaaaggggaagcagcttcattatctagcattcatatttgaccggagccttcaatggattcactagctgcactgccaatagtaccccaatataaaatcgcccatttgaatgctgcagacagatttgtcgacaactagtggctattagtgcagatagttgcaagatgatgcgttaagcaataacttactagtagctattagctctagacctctagtttccagaaattctggttgtagaaccaaataccttgacaataatgcagataggaacatggatgatatactaggtagtaggactagtacctggcccaaagctgcagtcgtatgaatgagtccaaatcaagagctgaacttccctggaaatcagccagttggaagagtatacaacttattcagcaaatcatgatgccttttaagttgtaaccaagagtaatgcatccagatggaagcttaatgactgacacatacccagaatgagcacaaatgcgtcctgaattatgattcaatatattcagcaaaccatgatccaggtataatcttaacggaaggaaataacatccagaatcagcacaaatgtatgattcattatagttcttttcaggactataatgtgatcgaatagcacaagttcgatttgcattgcttggagaaagcgtttacaatttcttttactacttgttttacctgcagtgtagctatctgctgaatgcagaggcaaccatcaagggctaaatatctcatttcaatgcacctaatgaaccctgatgaagttgacgcaatgtcattttcgtcatcataggacaaaatcttgcatctgatcacattgatatttaagtatcatcctagtgttgatcatcgatgatcccatgaatccaattaggagatgatggatgatggatcatcaaaaattaaatgtgttattaattgttggtgtatgcagctcaaggacatggtgatgaagctgtccggcacgagccgtcatcacggtcagcagaggcgtggcgggtcgccgccgccgaggggccggacgacgtcggtgtaccggagcgggtactaccggccgggcatggtccaggacgacatggcggtgccgccggcgacgtacctgggcggcggcgggacgtcgatgagctcggcgagctcgacgccggcgtgggacttcgcgcggccggcggagggcgaggctcgggagtgggtggcgcaggtggagcccggggtgcagatcacgttcgtgtccctcgccggcggcggcggcaacgacctgaaacgcatcaggttcagccgggagatgtacgacaagtggcaggcgcagaagtggtggggcgagaacaacgagcggatcatggagctctacaacgtccgccgcttcagccgccaggtcctccccacgccgccgcgctccgacgacggcgaggtcacttcacttgttctttcctgactactactagtacaaatgtcatggtccccatgcatgatgtggccggcgaggcggcgacaaggcaacagcacacggccacgacggcgacgttgcctagcctagcctgtcccgttcttggcttggcatcatgcagtgatagatgctgatacgttcttgcctgcatctgcaactctgcatatggcgatgcttttacagaatattgctttcgtcgttgctagctagtagcttgcatcaaaagatgcaacgacgatttgctagctgctgctagtgctgcagagtgcagagcatgcatgcaacgattaaagctggtgatctatggatatcatattcatatatggccatttctctctctctctctctgcatttgcatgaattaaaattaattatttgagcagagggaatcgttctactctcaagtggggtcgacgagggggagccccgccgccacgccgtcgccggcgccgctcaccccggaccgcgtcaccagctggagcgccttcgtccggccgccgtcggcctcgcgccagcagcagcagcacagcttccggccgctgtcgccgccgccgccgtcgtcgtccaacccgtcggagcgggcctggcagcagcagcagcagccgcagcgcgctggcaagagccccgcggcggcgtcggacgccatggacgcggcgagaacgaccagctgctcgtcgagggacgaggtgtccatcagcaacgccagcgagctggaggtgacggagtgggtcatacaggacgagcccggcgtctacatcaccgtcagggagctcgccgacggcaccagggagctccgccgcgtccgtttcaggtcacaaccttcatttttctactactctagctacctatccctgatgtagtatctattaattacttcctgaatgatcagatgatctgctaattactatagatgattgattaaatgcgtttttgagtattgctgatgattttgttcttgcagccgggagaggtttgcagagctgaatgctaagctatggtgggaggagaacaaggagaggatacaggcgcagtacctctagatgatcactttgcattattggtaaatctgggaattactactagctaagctacaagttggatgcttccattttgcaaggaggaattaaactacataaagtttattttacaagtaaatagagtttgtgttccaagttggagctgggaaagattaagataggaggtgggaggtgaggggaaaagaaagggaaaagtttagggcattagtacctgccccaggtaatctgtgactggtgtaccataagttccacacatcaacatccttcagctttgttcaatccaatttctcttgagtatgcctagcaacttatttcacagcagaaaaaaatgtgtgcattttcctttcttaatttaccacctgtaaatgcaatatagatatagtgaagctacgaatcacacatgatagtttcatacaacagccaaagtgatccagcatttacaccgcatgttggcccaacgatcaaaaaaattacaatgtacataaatcggtaaatgtaagctagcaagattaatacagactagagcatttatcagaggcataagcataaacctgtacaattactaaccaaatgaactgcggtaatgcacattgacaccgccaactgatcgatgtctatgtgcaaactaatgtagggcatctgtagtacacactgtgaatgctccacttcatgcaagttcgcgcacacccttgtccagtggaatcctcaacagcaatttggataaatgtgaagaaaagtgatctaggacacgaccaatttgtgtcaaaacatgtaaccggcaaggagaggagaaaaattctggataggaagttaaaatagacatcttaaacccatcttttgtttctcctttggttcaaaagaaatcagtgaaaatatcagtatggtctaagatcacttctcttc

SEQ ID NO: 21067 - DNA, 1250 bp, Oryza sativa
acacatcaacatccttcagttttgttcaatccaatttctcttgagtatgcctagcaacttatttcacagcagaaaaaaatgtgtgcattttcttttcttaatttaccacctgtaaatgcaatatagatatagtgaagctacgaatcacacatgatagtttcatacaacagccaaagtgatccagcatttacaccgcatgttggcccaacgatcaaaaaaattacaatgtacataaatcggtaaatgtaagctagcaagattaatacagactagagcatttatcagaggcataagcataaacctgtacaattactaaccaaatgaactgcggtaatgcacattgacaccgccaactgatcgatgtctatgtgcaaactaatgtagggcatctgtagtacacactgtgaatgctccacttcatgcaagttcgcgcacacccttgtccagtggaatcctcaacagcaatttggataaatgtgaagaaaagtgatctaggacacgaccaatttgtgtcaaaacatgtaaccggcaaggagaggagaaaaactctggataggaagttaaaatagacatcctaaaccaatcttttgtttctcctttggttcaaaagaaatcagtgaaaatatcagtatggtctaagatcacttctcttcataccttccaatgtttgcaagaatacctattaagacccaagggtatctgcgatttcacatgctgaacttcatccatactttacctgatgaagatgaattaatgtgccgaccagagtgctctaagattatcatcgaacagctgatgcgtagggagacaaaaagtactcccttatgcgtgatgccccgtcccttgctaacatgccctcaaggtctcccagaattcttgccaaccaaatctctaggctacgctgaatttccttgaagttgttccgaattgaactcagtgctcttcttgtgctcattttggcttctgctgtcagttcatcaccaaaacttccttttgcagtctctgcttgcagtgcactgagcttctgcctagtttcagttgctcggtgctgaaggtggaatgcttccagcaagtattctgtttgcctctgtgttctaaactctgagctcagtgttgaatcacaggggtcacttgtttgctgagcaaaattccaaataaatagaagttagtagtttcccactcctgctgcagctgtctaatacagataaggacaggaccagtaaaaaagatatcatgcataacaagaaaca

SEQ ID NO: 21068 - DNA, 122 bp, Oryza sativa
agattgtgtcagatcgaggcacttagttcacctcaagggtctggaagcagttgcatgaagctctcggaacccatttaaattttagtatagcttaccaatcgcagaccgatggtcagacagaa

SEQ ID NO: 21069 - DNA, 439 bp, Oryza sativa
tccgccggcccgtgtggcagccacgtaggtgccacgtcggcgccagctcggccaagaccgggtcaagccgaccccggtccgccgctcccccccccctttttttcttgccccgctcgcgcgcgcggtccaccgcgagccgtgaggctgcgcgtgggcccgccgcatccgcatccaccgcaagccgcgcgcgtgcaccgcgccccgctccaaaccctagcgccgcatcacgtgctcctcgctcacggtgagtcgagccgccaacaagcgggtcccactcgggaccacgcgagatggacccggcccaccggctacctctttcctcccctcccgcacgtgccttgggccgccttctcgggccggccggcccattatgctcggccgagccgcccctttctctcaggccgtgccctagccgcccgagggaagtctgtttcccctc

SEQ ID NO: 21070 - DNA, 638 bp, Oryza sativa
tcctgcagcccctgcaaataaaaaataaaaaataaaaatagcacaccatttgagcgattcaattgggcgagcagcgatggcaagcgtggagaggagagtagttaccaatctggccggtcatgggcttccagacgacctcaatggatgccttctcgggattctcccccttcctggttcccggctttggcccgtacacggcggcgagcacgatggtgtccccctgagcccaccgcgcggagccatgggcgcggtcgagagggttgcgtgtgcaggagaaggggcggagctggttcgggttccgcccgtccgcgcggctctcctccatcctctctccttcggcgatgggaaccagcgtgacggcggcggcggtcgtcgaactccagaaaccctagaaaaccccctcctcctcctgtcctccccttgttctaccatgccaccgcggctcgtgccaaggatacagacaaatcctagccgttcgatctgaatccaacggtcgagatcgccccagcctgtcccctattctggggcgagttccaactaggcgaaaccccgcaacaaaagagtttccccctccgcctccgaatcccaaccccaccgccgccgccgcaaaccgtctcgccgtcgcctcgcaccggcgg

SEQ ID NO: 21071 - DNA, 2582 bp, Oryza sativa
  unsure (1)..(2582): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaccgaatcgaatgcaacaagttttgcatttgttctgtttggttccatgtgcatctctttcctatgaggccaaggagcgtgatatatgtgtttgaacttattgtacactgctgttgattgtcattttattccctacaaacggttagtggacagtaaatacccgagagactataaataattgaaaagattttatcatagcctcaagattagttgttcacatccacgctaaagagaaattgtattcaaaacttaagaagcgtcgagcccaaaagtttgccatttatttttttttgagagacacttcttttgttcttgaaaacatttttttttaattttttttgttcaccaaatttttgtttaagcaaaatctcatacagggctgatgtaaaattgcatgaacataatcaaaagatggtgtgctcctcctttgcatgttagcaatttactgatttgtttcccgggccctgacttacctccaatgagaattgaacttgaggactcacctgtcagtttgaaaactttcctgtaggggttagtccacagaagatatatatccaatgtcgatgaacatattaactctgatggttcattaatcaatctcaactccatgtctaatttgattaaagcaaacaattttaacctaagcaccatgcttaatttaaaaagtctatggaaatacccaaaccagagtatatgaaaatagacaaggtaaacataatcatgtatgatcaagccatattcacatggtgatattattgagtaaatgcttggtgaaccttgttttatctttcgcatacctgagtgtacttaccgccaacatgatggatatattggaatctttggggcagttgcatggtcacatttgattgtagatttctcctccatctcgttgcggattatagcggaggaaggcacctcgaccatgccaactcaggcgagcggtttagtcatgcacacacgtcgggtgcaagaaccttttgccttgaaggtatgatccgttggcacaatattgtagagatgtaggaagcatctcttttttattggcaaatgtgcaactgcgaactggagcaaacgccgcctagaaaaagaagagggcatctcctcttgcttgtataagtgtagatgctgcgggagcgagaagttgtgcaccactaggagtggatgaaagctaaaccaaggcgacacataagctcaagagagagactgggtgtagctagatacagcctgtaacaccctagaaatctccacaagtctgggatgccactaaagaaccctataaaagtgccaaaacaaagaaatttcagcagcatctcttttttaaaaacaatatagcggaagcatcaatatatagattaaggttatgatacaacaactgactgacttatagggatagcctcgaaaaaaaaagttaatcaatggtcgataactctattatttaattaacccattatgtctaaacacaagtaatcttatcaacatattacaataatcatgactaagtgagatcatattgtgcaacagtgtagctaatcccatcccttcatgcaaacatgtcacaacaagtacctgaaaagactataaggggtgagaataaatctcagcaagcaaacggctttaacaacctatttaaaccacaggtttattatatagctgattaaataccaagttatgattcacataaagacaagttcaatatccaaggactaaaacatcatgacatcaccaatcaaatccatatattcacaactccgagagaagaaaacacttctcaaagacatcttcgatcgatagttttcataacatcctgcaatatgtgcatatgcaatgcaatggtatgtactcctgccttcgcacccaacaaggtgtgaagctgcatcgtattacgacaatatacgatgatgtaccggtacggtcgcaaccataggttcacagcataacttcaaatgcaatgcaagtgtgatgcaaatgcagtatgaattccagagtataacatcgaaaccacattccttagatggagaccagtataaggttattataaccaagagcataaagtataaccataaacagtgcaataacgataagcaatgattcagataggtaaaaccttgctacgacctgtaatactatcttgattattggttattgatatataattttaaagtgaaggtaggaaaataacaggttaaagctgtagcaaaccaccgctacatttacttgcctttaccgatgacgagatgaactctagttgcattccgaagtggtatcacctgaataaacaccgactcagcctcaaacaacacacatataatcattcaagaatcacacattcactttctatgctgggaacccaccccaaacaacataaagcaaatcaccgataatcttcctataaaagcagcatagattaac

SEQ ID NO: 21072 - DNA, 3859 bp, Oryza sativa
ataaatgcatcgacattcagacagccaacttcagaaattgatacctcctaaaccacttgatataaaatcatgccatctggtcagaagatagatctacacgttatctacaacttttgtatagagacttttcacaggaaaacccattatgttggccggaaaagcagccaaaacagaactgcgcagggggcatatcagcaagaaaaacctggctgaggaataaatcggtggatcccaaacttactcacttccaacacttgatctaaaccctaaaagaaaaccaatacagtgggaaagatcatgtatttgatacctaggcctccttgggaagcggcaatcaaacccctcatttccttcttcacctcgattccctccgcttccttctctccctttcttctccttcccttcttcttcttcccaggtctgcagtagggcaggcatgggggaggtcgaccagagggggaggtgggcgccccagggtaccaaatgacggctagggggaggtgggggggacctcctagggtcttgggggtgtggagggggcagctgggccttgggctggccgaaagctagcccaactagcgtataactattgtttttcttctaattgcaaacaccaaaaaaaaatgtagggaattccaatatatactatacgctattctttttttttctagggcattacacagcatgtcagctctcttgctctcttcctcttctcccatcttttttttctttttttttcgtctctcttttctcctctttttatctttttttatctctttttttagtaaggtgggactaacaccaactttaaaccaagatggccttgattgatggaactcgtcatcacaagctcgtcggcctttccccccacacttggacttttgtgtcgcaagacatcaaaaaccaagtgtgtgatgtcggagtctcctatagagtgttcccataccgaggatcgccaaagtgtaaagttgatgtagctaaccgtgtacttaggcatcgtctgaccctcattcttaatctcaacctgaaatgcttagcgaccaagaatacccgaagatgtatacaatcctaaacataggttcttgcttttattagaaaagaaacttaccgtagtaatctggactatctcctggcagtgctttgattatggtctcaagctcgaccatagggacatcatgctgcaagattagtgccacaaacaaatacaagatttgtagtatttatgataaatataagcatccagaaccacacttctaaacatgttagaaatgaggaccgtaaggtggttgtggtcctcgcacagagaaacgtcactaatcagacaggactctaggaattccttatgtgagaatgaatcctggggaattttgaaagaaaaactttcatgttcatttgtggaatgttttctctcatcctctagagtcaatgtctcaagcttgtctgtggcctgaagatcctcctcctcaagagatgcatcatgcaagaacatagttgtttcttgatgataaacaagaacaatgttctgtaggctagaaggacaaggcttacgcttgatcgacgatgatgagagtcgttcagtttcatgaagatggacaatagattcggaagaaatgaatgaaaaaacaaacatcgcctgctcgaacggctcatacttgggatgaggcttctttttgttgaaataattcagggtgtttccattatcttcataacgattatccctgaattggaatggaatttctggaggatgaatttttttcttcctccggctccagcacctagaatgaggattcggcagttgagtcgggtttcgactccacgtgcagaggtttctcacagataatctagacctcccggatggcttcgcttcggcagaaagaatcgttctctaagatgagatctaagagttctctttgttctgcagttgtcttgtgtgcgaacgatcctccagcggaaatatcgagatttgcaacagactccttgtctaatccatactgaaaatgttgtaacaacaaatggtcaggcaaagacaagtctgggctagactaagttaacaatgacaacctggcccaggctgcactgagagattccttcttgttctatcggaaagaaatgatgtctaatcgaagattaattatacgagttaatggaaagaaagcaaggcaaaatttgcacttagctcctcccattgaccgtggaatttcttgacagacatagtgtaccattgcttcacttcatctctaagagaaaaaggaaacaattttcacttcaaagtttcatgtgccattcctacgatcgataggcatgaacacactagctcaaagtcccgaagatggaggtatgggctttcactaataccaccagagaaggtttgctcttgaatcatggctataaagccaggactgatttcgtagccttatgaaaggattggttttgaagaacgagatggctcacaaagatcagcctgaggagcagaaaggttttgaattgtgggttgctccatcaaggaaagggataaaagaagaagaaataaaaaaagatacgaggatgacctagactcggaaaaattagcaaccgttccccggcaacgacgctagaaatgcttgttggtattccttaagaccatagataaatctgcaagcacacggaataccgctgtagtacttcatcttcgggtgacccctaaaggatatcgaacacagggaacgtgtgtaatctacataaatctaagactatctaaggacaacaactaatggtaagcaagctaggctaggctagagaggactttctaagtgttttagttatctagactgagttgaaggtaatttccaatctattgcttcaggcaccgacccctgctggtctgccagcgtggttctggctatagctctatgatgtatctgaatgtggaagattactaggacgcgattcagggctgtcaccacctgtcgcctacctctgacaaatccatgggatacacaacaaacaaaggtaatatctaaactagacaccacgtctaagttataataaaataaagtccactattgcttggtttactaacctcttgcagagaatgagcaataaatggagaagaatcggcatcaaaaccatcgatcaatcaatcggacgatgccgagaaatagacttatagaaagatgggccatgaaaccataattgacacgatcaaattggaccaaaattcataagtctgggtgaaggagagcaagaggaggccactgaccgagtttgggctgggttcggcagaaccaaccgaagcaccattggatccaggttttggatagacggtgtggatggcttccctatggcggttggaggatattaccgacatttccaaccatcattgttcagctataaaaggccttcactccctccatttccaacacacctcaagcaagcaagcttctcatactctctcaagtttagtttagtgctctcaagctagtggagtaagaacagaatagtagtcggagtccggaagtcttcggaagagttcgggtatggctctagttactttcctttgttcttttgtaagactagtatttaatttagaatattcttctgtatacgactatggaattgtaatactttccgattatataaataccagctttacactatgtccgagatattatgattatactgctagcttatctaggagatgcattggtacgggtataatgtttgcatatgcaaatactctatgtcacgatggtgatattagagtaatatttggtagtttaggcgtggtgcttagattactgggtatcattatttggggttatatgctgcggatgagatgtgggccgctgatggtgacagctcagtgcgggtattcctccgc

SEQ ID NO: 21073 - DNA, 1239 bp, Oryza sativa
accgaataatcagacattatacccgcaccaatgcaattcccagaagatttagctacacagattatactattcatgaatactataaagtcggtacgcatattctaagattggaataaagcacctgaattatataaagaagattattctattgaaagtagaagtcttacaaaagaagaggaaaagatacaagagactttaccgaactccttctgaaggctccgaggactagcagagctattccaattctactccactagcactatactaacactaaacttgtagagaagctttgatctttgctgggaatgaatgagaggaggagctatttataggccatgagttgcatttgggagagtggagatgctccaagcatccaaggagcatattctccttagcttcatctccttgtgacatgtgtccagcgatggtttcttcagtttaactggtcataaccgtcttgggacatggataactaccagctggtgaagaattaggctaattgggctagctactggttcagccgaactaggcccaatcagcccacaactttgcaggtggacttcttgttgattcatcaatccagtgatgtgaattattgggcttgtttactcgtgcgtattttgtgttattggcccatcttttcacaagtttgcttctcgatagctttcgagtgatcgttcgtttgctttctgtcgattctcctctatttatatgtgcttctcctgcgtatatgttagtagcatagtacatagtggaaatagacattttatttggaatttatgcattgcaagcatagctagtcttcagtaattgggaaatattgacggtcgaaattggttgataacgactgtcaacaaaccccccaagcttaaacctttgctcgtcccgagtaaaggacgaaaggaaacaaagacttggttgttgatcaggagttgctactatggtgtatatctagaatgtagaagtgcacagtttgagtactctctctcatgttaagtaaatatgcatagtggcttacccttatgcctaacatttgtggaacacacgcttctcaccaccttaggcaattgagagatagaacagatcatagagcaccattttctttttccttgctcagttttcatcccggatggttttcaaggatttttgcaaataaaaactatgttcctcaaatgattctcttgatcactcaaagtgtatagatattttattcctcacgaaagataatgccctatttga

SEQ ID NO: 21074 - DNA, 1821 bp, Oryza sativa
ttgagagagtacttaactatgtacagatacattagagatataaagcagagcaaatattcatcatttcaatgtggagaactaggttttcttacctagcatggtaaaatctatcctatatttttggtattttctattttgcaaatttttatgtttttgagttataaatgcaaatgcaagaattgaaacatgcaagaaaggaaatatgcaagataaatgcagatacaagtcacctttgcgggggagagacttctccccccaagcttgctccttgctcatggtccagagtaagcattgaatccttgatggcggaagtaggcttgcagatcagcttgttgttgttgcatcatattgttgatatttgagaactgtgcatcaacactttgctgctactcctgcgcctggatcacgtgtccttcgagggactgttgtcccagcgagaggaactcgagcaccaccagctggaggttggaggcacgccacttgagcctgctgagttggtgtgcccccagcgcacctcatgaggcatctgccactaggaactgccggcactcggctaggcagatcctccagtgctatgacgtagggcttgggcccagccggaggcatctctagctgatttccagccactctcataagcatgaccgggtggtgagtacgttgaatcctcctgttcatctgctgccattctgcggttactcctatgtgtcgcacctgcacgggattcctctatcgtctgcaggggaatggttagtgcataacagttatacaaatgataccccgggttaggtaacaggatttcatttctacaaccgggttggaagaatactaaggtcacatctgctccatgtttcaaagtatgaccttgcactagttatgattcatttatataaacacgagagactgagatataagcaatttgatcatttgtaataaccccaagccctcttgctatacaagtgatcaaagaagtgcattttataggagcggagacctctatgctctctacccactgcctaatcatgggttgcacaggagaaactctaatctaatgaaccatggcatatataataatcatctcattatcatgaacaggtctaggatctcctctaggaaacaaagtcatggcaatccatttatgtataagtctaagagttggattatggatgtcattggttctgggtttcaacccattgttttccagataacaccaaaatccacatccatacctgttttccggagtagctcaggatcgtatgctcgggtgtgagcgaacgatcggttcttcaacatctggtaggtttgcttctctcgtctgtcgacgaggtcgaggtcgtcatctgtcaggagctgtggaacatcgtccgtgtcctccatcgacatgtcggcggacgaacgatcactcgcattatcggatcgggagccagatcccttaagcaagcgagagagccgtctcctcatgactgcacaaaagcaaggatacaaagcgaactcgagcgggggttagtacgagataaaatacccgccggttagctttgtaccaacagcgacttgcaaatgtagcgaataaaggattttaaatataagacgagcttgcaccagcctggaatgaatttgagagcaaaatagaaattgagaaggagttaaaaattgagttggcaatgagatgaactccttctaccggccatccccttcttatagtgcacctccaacggctataattgtgacacggacccactaaccattggtgtgcaaaagaagggaggtgactattgcctgttggacggtcgtcatcgatcagttacattcgtcaatattaccgga

SEQ ID NO: 21075 - DNA, 23830 bp, Oryza sativa
ggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatgtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccgctgatggtgacagctcgctacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacgtacactgtgaagggcgtcagtcctgatatcgtcaggctgaggctgttcccattttccctcctcgggaaagcgaagaagtgattctatgccaatcgtgctgtgataaactcttgggaaaaatgttcgacagcattcttgtcaaagttcttcccgatgggcaagattaatgcccttcgtgggtgaatttcgggcttctagcagatgcgggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacgggtaccacccgcaaggaggtcaggggtggaaccagccccgtccgtatttccaagaaggcaataaccaagctaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagaaaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaagattcggggtgtcccacaatcacttgctcaatctagacacaaaaattcgaccaggcactctgcgaccttggggcaagtgtaagcgtcatgcccaaggacgtcttcgacaaactcaactttacggtgttggcaccaacaccgatgcgccttcagctggctgactcgtcggtccgctacctagccgggatagcagaagacgtgccggtaaagatacgggattgctttatcccggtcgatttcgtggtgctggacatggacaccggtaaggagactccgctcatcctgggcgtccattcctgagtaccgcagaggcaaacattgatgtcggaacaagaagcatccgtttccacatcaatggaaaggaggagaagttcgagttccagccgaggacgaaacaatgctccatggtccggttaaagtacgggccagccccgtagaatattcagacggtcgaagtggagccacccaaaatggacagcctcatcgctttcatgaagaaatctctggagatacaaccttccaggatgaggtcccgttattggaagacaccggcctagaaggaagagaaaccggctcaaaagaagccgccgcccataccaaggacaaataaggtatggtggctgaaacagaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaaccggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccatttttataacaggaatcaatcgtgtaaatagtaccatttccctggatcaagtagtctggtacacacgaattcatagctaaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtaccaaccgtactcagcaagccatcatagcaatgatgcacatgacagaggaattcaaaggatggctatggttctttttgcacaaagcaagttttgtaattcttttcacaagcctaagacctagcatagactgttcaagttttaataccagtgttcatattaaataatgacggttctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatatagggcacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactagggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctacaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcaggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggcataaatattttgttgtcataagtttttaatttactcttcccgagcattatatccatataataggttagaaatttctattaagagctaaatatcggaggaaatcctagaaatattatacaatttaatttattctatgactaaacgattaaatataatatgcggctaagattcttagtaattaaattcgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaggaatttccaaaaataatctatgattaaccccgaccatttttatttcctaaatcctcctaatttctcccccaatttcccttctattttctccttttcttcttttctattttcccaatttttctctcctctttttctttttctctcttttctctccctctctttctttttctctcttttctctccctctctttctttttctctgccggcctctcttttctttttcttttctttttttttccttctcttctctcctcccggctcctttctttcttcccttctcttcctctatcctctttcggctccttctcctcctctctctcgtcctgcctaccgcgaccggctgaggaaaggaaaaaggcggcggcggcatggcttaccggcggcaacggcaatggcggcggcgcacggtggctgcgacggcggcggcgcacggcgactgcgacggcggcggggaacgcggcacggccaaggcgcggcgcggcagctctatgcgacgacgcggcggcgtggaggcggcgtggtggggtgggtagaggagaggaggtgaggatggagggaaagagtgggagtagggggggattatataagggaaggggaaagagataatagggaagagggaagaggggcggcggcctcatggtgtcggcggggtggcagggcgcgggacgcgaggagcggcagcggcgacgcgacggccgaacggcgacggcgcgaggcgatggaacgggcggcgcggcgcggtagcagcggcggcacggggctcggggaagcagcgcggcacggggcgcgaggcggcgggctcgcggcgcgaggcgacgagacggcacgcagcgcggcaatggcacggctcgaggcggcgatggaacgcgcacgcggcgacgggatggcgacggcgacggcgcggcaaaggtggcgcgcggcacgaggcggcgatgggatgcacgcgcagcgcggggcgggacgcgacggcgacggcgcggccgcggcgatgagatggcgatggcgacggtggcgcggcggcaggcgacgagggcgacggcgcgcggcggctagcgacgatggcgacggtgcgcggcggctcggggcgcgaggcggcaacgcgcggtgacggtggcgacagagacagggggaaaaaggaggagctgggttaggggaccccgtcgaacactttaggtgcaatgaacagtgccgttttctaattaacccgattttagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgatatcaaattcagataaaatagacgaataagatcggcatgatgtaattagtttaaaaagtttttgaaaatccgtatttttagagttttgattttgtcggtcgaattttcagggtgttacactttgtttcctagaggtgatctttgacccattcaaggagatgaattgattatcatgtttgccatggttagaaaaattaaaattgctcctgttaaatgtatgattaggcaatggttagtgtcgcgaccgagaaaattgcattttcccgaacgctagtgtattaatccccgtcccaggaaaagccggggtacaccatacaaacatgatataaaagacacatctgtattatatcgataatatttacattattacaaaggcacttaaggcctgacaatcaaaaataaacagcagcggactagcgggcctactgctccatcttcacaggcgctcaactggggtataagccaggactccacctaagacttcttctccaaagcttctcttactgaagaggggaaagattgagcaagaatgagtacaaccacagtactcagcaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattttagttgttaagcaaattttaggaattaaaacgctaacttgggtacattgctcggcttgcccataaccgagggcgcggctattcgaatagattatactctgatcagaggtgtacaactttacccacaagacacatcttcctcacgtgcaaccacgtgccacataccaccacggtatacaggcggaagacgcgacatagtttccaacccatcctagccatagagaagagtaccgacccaatcccacctacggccggaacctccgggacaggcaggcaggactgagcccccagcagcagggcaccaaccctgtaccatgacatctcgactaccgggccgcagctcgtgtagccttcatttgccctggagaatgtccatcgacccccgacttcatccacctccaatcttacttttgtttataacttgactgagccacaaactaagccttacccactagacatgtgaaagtacggtagtgctttgcaacagaggcccgaagaccggtccttatatggccgaggtgctactatcaaaaccatgcaccctgagcccagcctaaaaccattttggggattttgaatagagggggcggtgtgaatccaattccacaataaaccaacaattccaaagtgtccaagtgatatgagaattccccaagtctaaagttataaaaccacctaatattgtctaattaaacagcgaagcatctacctaaaatcatactagtggtaccatgagtagagtatccactagttggggttttgtttaatctagggtggacaaggtaataataacaataacaacaataatacggtcataacaaaggtaaataggcatggcttagtaaaaccgtgataacgcgggaatttaaataaagcgataatgcaataatttaaatcaaaataattttataaactgggattcaatatgttcaaggatgatgtgacttgccttgctcactttcccaaacgccggcttcaacttccacgaagagcggatcttccaaagctgcagcgtctacacgaccaacggaaaagaaaaggcttttacgctaataaattccacataacagcagaaacaaagcacaaaaatgggttcttgacttcttaaggaaaaattagagacttgaacggtccaattacgagttcaaatggccaagttatggccatttgaagtttatatgttctttaaatggatatttgcgaatttcttcatttaaattttaatttaaaatcgaattattgcgtcagccgggagagagggcgcgcggaccgggtccacgggagtgggacccacgcggcagcctctcggtccacggtggaccgggtgcacgcggctggcgccgtgggtcccacgcgtcagccgcacccgcgggcgcgagcggctgacggccgggccccacctggcagccgcggggcgcgcccgaaggcggcctcgccggcacggccgacgggaggcggcgcgcccgcgccccgatggtcactgccggcgaccaccggcgcggcggagcggcgcccgagagagaggagagaagagggaagtgaagcggcggtcttcggctcaccccgggtcgacggcggcgacggaaacggcgaccgaagtggaggaaggcggcggcgcggttcgggtcgacgaggacggcggtgctccggcggtcggcgggcgaaacggaggagcggacgaggtcgacgaggacgcggcgaagccaaaggaggagacgccgagacgagaggaggtccggggcgacgacagcggcgaaccggagctcggcggcgacggcggagagagaggacgacggcgcgggctcgattccgaaggggagagtgagcggcgagcggcggaaacggaggagggaggcacggggaacgattaaatagcgtcgggagggggagagagcggccgggcgagggggaaacggccgcgaaagatgcggccgccattgatgccgacgaggtttaggggaaagattccgagcgaatccgagggagagagagagggaaaagtgggggaaaagggagagggaatcacggggaatgattccccccactttattgcgcgcggggacggcgggatgcggcggaatccgcggcggcggcggcggcgctagggcacgggcgggcggcgggagcggcgcgaggatagggatgacaggcgggccccacctgtcagcgagggtggcgggcgggcccgcccgtcagcggcgcgcgcgcggggagaggccgagtgggccgcggggagaggagagggaggggagggagatgggccgagccggcccaagaggggaagggggaaaaagaagactttttaggatttttctttttataaaatcattttaactttgtttatttcttaataattattatttgtgctctgagaattccactaaaatttgagggctccttttagaccaaggagaatttaacaaaaaatctccgggccacatttgaatttttcttatacgtattttagtgtttgccaatttcttttcgaattttaattaattctattattccttttagaaaataatttttatttcgggatgaatttatcaggacgtgacagttagaaagtattaagtatactgcccctgttgagtgtacttctttgatcacccgtatagcgaatggccttggagttattaccaccgatcagatcgagtatatatccactgtccgtccctatgaggatgaaacatacttagtacaagggcatatacttaagcatggagacgatggctcattgatatactttttccccggttgtacaaatgaaatcccattacccaatgcggggtatcatttgtacaactgtcaggaactaaccattcccctacagaccatagaagaatcttgtgcaggtacatcttacaggaagacacgcaacagaccaaggcaagagcatgaggagtcatcctcatcgatacctgtgcagatgtacgaggcggactgggagccaacgggagatgcacccggttggacccaggcaccacggcacagcaccggtggttcttcctggcacagtgccaatgagaatcgctggcaagcaccgcacgacgtacactgggggaacgcgcacacccgttcctctggatcaagtgggatgcctcctgcttccaactggtggcgctcgagttcctctcgggacttgggtttctcacgatgaggctggacaccctttatatgcaggcgggtgagaatggcagcaaaatgctgatgctcagttcgtcaacatcaataacctgatgcaacaatagcaggctgatcttcaagcatactttcgcttccaagggttcaatccctaccagggacctaagtgaagggctcaattcctttccaattgcatatttggatttccacattgcatcctataaactaaaaatgacataaaaaaatttgcaaaatagaaaataccaaaaatataggttagagtttattatgctaggtaagacaactagttctcttgttgagatgatgaatagtttctctgttttatatctcttatatatgggttcacggttaagtacgctctgaaagattgaataaatagtagccacatattatccgggaacctgaggtaagtgggctgcacttgccgaactaagtctaggttgtcgcgagatgatatagtgataagagttgctatgatcctgttctaagtttgacttaaattccggatgttttattttccaaaatgataaacttaaaagttcctcatttgataaaaattcctaccagagccaaaaattttcatatttgataaaccatatatattttgggcgcttgtacttccattgaactttgtcaaaatcttgagacttgtgtagatacttttgatactctatgatcaagatcatacacccacatatatgcacatgcaaacttctgcactagaagttagcattcattcattccatctatatccatcatgctatcacccaaaatcaagctctccaattatatgctttctccttccaatataatatcctttccaaaaagagataaaaagagggaaaggcatggttaggaaaataaagtcttgctcctcaaaatattgagcatgataaaaaaatgagtagccatgccccctccaaaaaaagaaatgaatgatcttgggagaagaaagaaagcacaaaggagaagtatttcctttttttttccacattctatttccaccatatagcacacacactttatgcacgatcttgatcttgagtatgtctagtcatctgctctagtctaaagttttgacttagtaataaatgcaagtatgctatgtttgatacctaccaagctccacatactaaaccttagagtaggaatcaactaggctactttggtgaggaattcatttatatacactctgagtgatcgagagggtcatttgaggaacttggatttcttttgaaagatcatttgaaaacttccggaataaaaggttgaataaataatgggtgactagtgcttgattgctgttctatcttccaaccgcacaagacaaggtaaagcaatgtctcgcgggaatcagttgtaagggtaagacacgtgtcaaaattatttgatttgagagagtatatctaccttgcacttgtacatttgagaatatacagcatagtagcaactcctgatcaacaatcaagttttgtttccttttgtcctttactcgagacgagcaaaggttcaagcttggggggttttgttgacggtcgttatcgatcagttacgtccgtcaatattactagaataaaagaactagttatgcttgcaatgcatatagtgtaataataaaataaaaactactagtacttggttcactaaccctctgcagagaatgggccataaatggagaaaaatcggcatcaaaaccgtacctctggtgtcttagctttatgaggtgcccagtttcaaaggtacaggaacaggtgtcttctctttaacctgccatacctcctttgtttttggtgcggtcaatggcttcttcgaaactgggaacgcaggttgaccgacttgtgttcctggcttcttgggtgccagcctaaggtatcaacggatcctcatttcttcttgatctttaggaaattcatcatgaaattgctgaaactgtcacgcccggaaaatctatccaaaattccgaacgcttacatgtgtgttaaaccctcgtccaggaatcaactgaggcacacaataacaaattgataatagagtacaaataaataactatttaatattcgcaaataataaattattacagaggtagatagttcctctcaaagaataacattctacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcaccccccttataaacaaggcatggactccccagcgacccccgtggacttctcgccacttctcagtctgacgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaacattaatataacatagtttataattaatccctttaattagctatgtttctaggcatggctaagcaaacttacatatagcatttagctgaaccaatccaatatataaggttcatgctaatcaaattataacccataggaaaataaagtcatcttcggccattatttaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaaaggaaacgctctcctccggaacgtcagaaactaaagcaattaaacaaaaatcaacaaaacagtacaaaaacaagcataaacagtacatgtggatatttttaacatgtaaatcttgattttagaaaaatttaacaacttgaaccacctaaaacggatctacggttatttagttatgattttccgaagatttaatctattagaaaatcgggaaaaagaaaaaccgatgacgtcatgctgacatcacccaaggcggccgaaccacgatggcgacctcgccggagatagagcggccggctgcggaattggagggcaagaacacgtagaggacgacgagacgaacccaacggtactcaccacaacgacaaacgacgtcggacgacttccggcgacgacggggaacgagcggcggctcgggttgaccgacggcggcgagctacggcggccggcgacgaaggggaaagggcggccgagctactccttgctcctatgcacctaatggcggcgagaaaaggcggcggcgatgacgcaagcggcggcgcggcgcggctgagctccggccggcggcggcggcgtcttgtcacgcgcggcggcggcgctacggagcactagagaccacgagagagggggcaaacgaaagagggcgacgaggtggtcctatttatagccttggattgaagagatcggactcctcccgcaagaaatcggtccgagaaatcaaaaactcggttttggagataaactcgaaaacgagtttgattcagataaaatacccaacgatttgctccgattcttgaggggaaagatagaggagaacgagaggatcaaaacccctcaaaaatccggaagaaacggggccggattgggtgcggatttgaggcggcaaggcggcggctcgggcggctcgggctcggcctatgccggccggaggttagggacacacccgacaggtgggtcccacctgtcggcggctgaggggaggaggggcgggcggcgtcggctgggccggcttgggccggttcggccgcgcgggaaagagggagtgttgggccgaaaacggcccaacaacttaaaggaggggtttttgaactttttaaataaaataatttgtgaaatgttgtttcaattattaaaaaaatacttcccttgctcaaataattcccagaaaattctagaaaatagaagagcaagcatagtatttaataaaattttatctagctcacttttatgttgaaaattttcctagataattaggttttagcttgtaggcttttaaaatattttctaaaaatcatttaaacaatgcatttttaatttaggcgatttttagggcgtgacagcccagtttcaaaggtacaggaacaggtgtcttctctttaacctgccatacctcctttgtttttggtgcggtcaatggcttcttcgaaactgggaacgcaggttgaccgacctgtgttcctggcttcttgggtgccagcctaaggtatcgacggatcctcatttcttcttgatctttaggaaattcatcatgaaattgctgaaactgtccgtctttcggggtagaccttgacctccttgtgggtttggtccgtacttgatcttccccatggagcaatgctccatccttgatctccttatggacgatacccgttgttgctctcgtgagcatgagtccttacgggttttcggatgatccatcccagtgtgactggcattgccacggacctcacatgtcatgtgagtccagggccttaacagcaccctgcttggcgtccttctcattgttgtccagtctcttaataagaagatccaactgagtggccagcatttccgtcctcttgacggtgtgcataccgtattgacggattcggagtcgttcctcgctccaacccatatttgagaccatcttctcaatcagctcggtggtacctctgaccgtctttaagaagaatgtctttccaatagcagtgtctaggtgatcccaagatgagggggttaatccattgaaaaaactctacaggatgagccactcgtccatcccatgatgaggatgggcggtgacatattcctgcagcctttcccaagcttcaggagttgtttcatccttcggctgctgaaagctggatattcttccacgaagagcgttggtcttacccatcgggaagaattttgagaggaatgtcgttgagcaattattccggatattcacaattgcacagttggcgtagaaccactgtttcgctttcccgaggagggagaacaggaacagtcggagcctgatagtgtctggagtgactccgtgctacagattttcagcaattcctgcatatgagcacttgcatcctcgttaggattgccacagaaccggtaaacctgcgccatcgtgattaggctggtcttcaaagttaccatctcccatgctgacttagggtccaacgggcacattgtcggcggagggagctgcgaacttgcggaggatcttcccagccatatcgttaaactctagtggcacgaaaatggatggtctggttgctgatagagtaacttgaggagggacaacacggggtcgaggctcgctccacaagtgactcaagattgaaattggttggcagatcagaactagtcttgtactaccctgttttcacataaaagagaaaacatacaaggtttgcctacataggatagtgattatacagaggtaaatataaaattattagcaagtagtaaactctgaatgatttatcttccccgacaacagcgctagaaatgcttgttggtatttcttagcgacagtactggaaatataattctcagcaatagcactagaaataatcccggtatactatggttacagatatgatccgcaagcgcacgaatgtaccattgtagcatttcacccggaagtattctaaggtatcgtatttaatcccaatggaagatatgataagagagaattatactaataatttatatattagttgtgtacatcaaggtctatataggggttaaaataatccaagagtagagtaacacacagcaaaagacctagcattcttaataatcatcaagtatcacattattcacattagtgagtagtgtgggactaatcacgaaaaacattgctcaacccgcccataaccgcgggcacggctattcgaataattttactctggacagagatgtaccaccgtacccaccatgtgcgtcaataccatcatggtacctaggaaaggagctgtgacaatacaccccatacaacacaactcaccacagcgcaccgttcctggatcgtagtcacccctttataaaacaaggcatggactcctcagtgacccccgtgggcttatctccaccacttctcagtctcttgccccgtaataaactatgctatacaaaaggtaaagctgttgcccacgctggcttgtggttggcatggttaatgtttcacaacagtagctcgcgaaccggtccttaattgtcatgagcacgaccaccaaaaccatgtgctcacaacccaccattaatcaagttttaattggcaattaattaattaaccaaacacgattgaccaccgtgtgcaaacattaaatagcaatcattaagtaataatgaagcattagttatccccaatagttaactaatacttctaagcatggctaagcaattatatctaatatctagctgaaccaatatataaggcccaagctagtcaaattataacacaggaaaataaatcttcggccataatatagggaaaaggctcaccacccaatgacattcgaaaataaatgcatatttgaaataaaaagagaatttaattatatgttcaacatgctcaaaggattgtgtttagtatctgtgtgacttgccttgcaataatttcaattagtcttctggatcacttccgatgcactcatgatccttccaaacgacgaaaacgacaaactaatacgcaaaacgaggaaaaaaactaaggaactccaaataaacagtacgtaaaaagtaaataaacatgtagaccatgattttagatgaattatgagacttgaacggcctcattctgacttccaatggattaattatgaattttacaagatttaatacaattaaaacctatttaaaaggattaaacagattaacaacacaatttataagtaattttaatatagatctctattttatacaaatttagcaacttgaaacacattaatccgagttataatgaattagatatgatttttctaagtttaatatgatttttgcctaatacagaaaagactttactaatttattaatgtattaaataaaaggaaaaagaggatgaaggacggtggctcgggaaacgaagttcgccagcgatctagggcataagggcgcgaacggagggcactaatgcgaaaagtacaacgcggcgaactcaccggtggctagaacggccgagattgacgacgaacggcgacggcggcgaggttttggcggcggcggccttcgggtagtcggcggcgatggtgctccggcgggttgcggcacaaacggagggcgggacgatgtcggcgacggtcacgcgaacccgtggacgtgaaccccgtgcgactgcggcgaccgaggctacggcggcgctcagctgaagcagctccggcggcggcggcgcaaaagacgacgcgggaacggcgctagagggggcggcgggcgaaggtggaggtgatgaggggtagaggagtcccagggggtccttttatatgggtcaagaggcaccggggagggctatggcaagccggcggcgacatggaaggattagcgtttgattaggaaagagaaattcgaatccgatttgatttgattaatccatgcaaaattggactccaaatcttggggaatggaaggaggaggatatgggaaatatttcccctcaaccaatttttgaaacaaagcacgggagagatcggatttggcgagggggcggcggctgctcgagctcggctgggcggctggaggttgaagaaggcactgtagcgatagggagtcacactagactttttctgcggtttccttcactaggcccgattgaagaagggacgcgaatcagactacgacagagagagggagagggctgctggatcggcagggctgaaggagagagatcggccagattcagcccaaggcatagaagaggattttgattttttttttcaatttaaataaatactgaaatgatctttcatttattaactatacttccaacgctcacataattccaagaaaaatcctgaaaataattggacactcaaagtattcaacaaaattataatcagaccatttaatgattaaaattaggatttagtatttatataattgctaaaatgctctttgtattattaaaattaggatttgagctccgaaaaatacgagaaaattccagagagtataattaatcgtagagaatttaataaaaattaaatctagccattcttaacatttaggaaattttatttcccacatttaactttacttgtaaattaatgaatatttaatataaattgtagaaataatttattaaataatttataaatcctgaaacgaaaatcagggtgtgtgttgatgcgaaaaacacacaccggcctgagatatgcttaactctagtgcaggtccaaatcttggtttcgagttcgagggtatgccagttggtttgatcctgcaacgaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaactaagtgattgggatagatcggacagcttgccgagatagtataaatcacttatgtttaaaagtaacttgaatcagatattatatatgttcatagcatagccggtgttttagatctaacatgtattggctaatactccgataccactttatactaagataacaatataaacaaaatatattaaatagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacaacattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttctactataataaccggaatgccgagtagtgactgcgagagataaccataagatagcttgccagtccactccgtcatatgctcgtcaaaccatatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcaagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagtaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatagaatcccatccataataatccatatttggtgctaacataactgactaacacatcaagcattgtccataaccgaggacgcggctattcaaatagattatactctgattagaggtgtacaactggacccacatgaaatgaacaaagatcaaatgctacacaccccgtcgagtgtggtacacaagtgattcaagctcattacatgcccatttttagccccaccccaaccacctataacatgctggggttcccgacgacttagtcacgtgcgtgcatgatgtgaccagtggcagtagggtataaggacaggggctgcagg

SEQ ID NO: 21076 - DNA, 12783 bp, Oryza sativa
aacggagggagtacattacaattaacatgcatttcaaaccaagatttcataataatgattatttttagagtaaagtacatcactcacaggtcctaagaaaaattatttcacaaccataagtgttgtcattatttatttatggattttacaagttaaatcataggaatgctaaataaacttctaagcatgatttaagaggtagttttgtcaagatcttttccacagaagtgaagagtaccattttacaagttcaacaaaattattttatatttttatcatattccaatatttacttatgcattgtccaagatctagactactaaaaggatacctagatctattcacaattttagaggaaaaaccagtacataagttagccatttttattttacaacattgtagatcacgtttttattaatccatagaaatttggttcagctcaaacggagttcagatgaattttctacacatttttgaagttagtacaatttcagcacatgttgaaaacagttttccattaagagtcctcgaacttcctgaatattacagagtggtcaaggctacagtgttatgtgtcttggtctgttttttgggaaaaaaccctcaagtttatctaattcaccgatgaggtccctggctcgagctcacggggaggcagccatggctggctcagtctagagcttgccgacggcgaacggaggctcggatggggtcgagttcaacagagaaactgtagaggaggaccatgcgaacacgtaggtgtccgcgctgatgaacaagctacagctacagcggtggtctgtagctcgcgaaaaacaagctacagcggcggtggttcttggtatgtgcatgcgtgtcgagctacagctctgaatgggctatatgggtgcatgcatggggtgttcaggggtatgcagtgtctcaccgtgcagctgaaaggggtcggagaggtccaggaagcatcgacggcgttggagatgcccggcaacacaatgaacacgatgaggacccgagaacgactagatctggccataaaaaccccaaataaacgcttgaatgagctagaacattgcatgcagagtctttttggccaaggtaaaggatctggagctcaccggacagggaggaacaaagccaacgtgtctagatcggggctgaggaaagaaggcgagcgttctccacgcctggagctcggcttgggctgattcttgacggtgttacatctgggaggaagatgaattagaatgagcagcaccaccctgtatctcggcctggaacgtcgggaacactggaagcttgggtgacgcgacgacaccggccgcgctccggggctccaaaaagagatgtgcgttcccagagattcactgcatgaaaatcgatgaaattttgaggggagttagggcatgcataggagagcagggaacgagggttggacggcgaagaagacgaccagaaacacggcggcgacgacgaagttctctcggccagcaaggaggaagaaggaagatgggggcgaaatgaggtgctctcaccttgcgtttatttctctggaagggagtgggaggagtggagaaagtggccagaagcttagaggagaagggagagtaaagagagaggtgtcacacttgtctctctcccttgcatggccaaaacgtggcatggctattcttctgcttgtcccctgagtatgagagggttgggccactgccatgtgggccagggactgctggtgggatccacatgtcaaagagagaggggttggagaggaagagacaagaagaaaagacaaaactaagatttattccctcttctcactcatgacctgctaattcgaattgcttaggaggggattcaaattttggcctctggtccagagatgggtcttggaacatgctttctaatccaattggtttcactaaaaaatgttgagttaaataattctagtgaaaaagtgaattcagttaatctgaaagttagtttgaatttttaggaggtctaaaaagagaggaaaaattccacaaaatttatatttgttggtgataaataaactagtatttgaataaattattaaacatgtacacttctgttcaagttattgttcaaatagaagtggtttcaattttaccgattagagttaattttgttatcgcatatgatcaaattgcaatatagtaaatatgcaatctaaaagacaacaaatgcacttctaaatacctggttatgagctagggctattacaagattagagtatcatgaagatagaaccactaatcccgagaacacaaaccgccataacaagttttaccttgtcgtcggagatcaaactgatgcagcccaactcgaaagcaagaactcatcgaaagtaaacgaaagtgaaaggttggcgatgcgtcgaaagtgttattgaactgattgttactttgttacactggttttgggctacttttatacccaaaatacatgatatgcccttgtcggacacgactcctaactctattacaacttaggaaacaaacaagtccttaaggtggactcttaccgactcaaagtacaagaaaattatataaaatatcctaattaatagatacaaattaccttcttaggactcaatccgtgcgtggcaattgatatgaagcatatcaacccaatccgacaatgtttctatcgccatattgtcggaatcgacttcatcggctaccctgtccgacttaaactctaccaatgtagattgtagccgattcggaccccagccgatgtgtactctatttccgaaactgttaattccctttgattctgcttcggttttatctccaattccgatacttgatttaccaaatttggtcgttaacagtgtgacatgagttgccttgggagagtggatatgctccaagcatccaaggagcatattctccttagcttcatctctttgtgacatgtgtccagtgacggtttcttcagtttaaccggtcataaccgccttgggacaaggataactaccagctgatgaagaattgggctaattgggctagctactggttcggccgaaccaggccgaaccctggccaagcccaatcagcccacaactttgtaggtggacttcttgttgattcctcaatccactgatgtgaattattaggcttgtttactcgtgtgaattctgtattattagcccatctgtccacaagtttgcttctcgatggcttccgattgatcgttcgtttgctttccgtcgattctcctccatttatatgtgcttctcctgcatacatgttagtagcatagtacatagtggaaatagacattttaattggaatttatgcattgcaagcatagctagtcttcattaattgggtaatatggacggtcgaaattgttcgataacgactgtcaacagtgcctagtcctcactgtagccgatatgaatagagatgagcctgtgctatcggctgcagcttatttctagtccaatactttgaatgcttttttattcaaccaaggaccaataacaccaactctcctggatatagtcatgatcatggacttagacatcacatcatcggctaacccagttagtatgaataccaagggcaaattctcttacaaaactaggagcatcggaggttggattggcttcatcacccagaacatgggaactggttctgtaacccctaaggaacacacagcctttctaatgatgtggttggaaaagttcttgttctgtggtccaagttgtggccctactaccaactggcagcacatagccaaagcccttgtagacaagaagcaattccccttgggcaaatatctgctaggctcattgtatcaaactctgaattctgcatcggctaagattgctgtagattctgtcattggcactggtggcccttggtggcttttgcaagtatggctcaaccttcataccatcaaggtggctaaatgtcacaccccgaagttctcctcccaagcctaaatttaatttataaatgaccctaagaaaataccggtgcaaagcaagagtaaaccccttttaaatcaatgcaaataataatcggaattggcatgtggaatttttcttgagttctaaatgtcgaaattcactaacaggatttttagtggaattttcagagctcttgaaataattttaaccaattaaaatggagcaagcaatattttaattccagggaaaatccttttctccttttttctttttctttttccctccctttttcgaatgggtcgctggcccatcctctcctttcctccccctcctccctgctgggccggccgcaggccgaggcccagccaagccgcccctccctcctctcccggggtcgcgacaggtggggcccacctgtcgggtccttccccaacctcccgccgctcccgccgcgccaccgcgcccacgtctccgcctcctccgggccacgtcgaccacgcccgcgcgtgcgccgcgttccccgcgcccactcccctctctctcccgttcgcgcccgcgcccgagatggccgggattcgattttcgaatcctgcctctctctcctcccccacttcccccacgttggccggcgaaatcccgcctctcccggccacgtccggccccctctctccctatttaagctctgccgtcgccccctctcgctttttccccatttcgccgaactctcccgagcctcccatcgctcccgcgccgtgcaacctcttgccgccgctgtttccgctactccggccgccgctagccgccgctaggctcgccgccgcaccgcgccgtcgccgccgtcgggttcgcgtggccgagatccaccccgtccacccctccttcgtcgaggtccgccgccggagcgccattcccatcgtgcgacggtgagggttgccatgtccgccgccttcggccgacattcccgtctcctatggcccctctcttcctctcttatctctttcctttcgttctttaggtcgtcccggtcgccgtccgccgcgtgtcgacttccctccatcgctcctcgtcgccggtcgccgccgtcccctccggtgaggactccctcccctttcctttccttccccgattccccgtgcgtcgccgccgctcgcgctcgccgtcgccttcggtcgttgccgccgtccgctgccgccgctttcgcatcgcttttgcgccgtcgcctccgccgccggatgccgtcgccggcaacgcgttcgcgcgcgtgtgctgtcgccgctagccctggccggccggtcggctttgatgccgagccgagcccggcggccgcctttatcgccgcccgtccaatcggcctgagggcgatctgggccgtcggtcccgtggaccggcggtggaccacctgcgtggtcccggtccacggtgaaccgcccccctgagccgctgaccagtgggccccgcttgccggcaccacacccccctccgtgctgacgtcagccctgggaattattgcgcaataaatgatttaaggtttttcttttatagtaataaacacagtgattcttctaaaattcataactaattcatccgagctccgtttaagcccattcaagtctcagtaaatcaagaaaaatgtgtagaatccattaaaaatggttttgttccctgtttcagtagtcttatagtctgtttgcaatgtttgccttgtatgtcgctagattccggttcccccgacgcttcggtgtacttcgaaatagtcgccgaggttcctccagcagcagagcaaggcaagtcatgcttgtcacttgaacatgttgatcctatattgcaaatgctctattgttttctttcaaatattgcattgttttataatgttactatgggatgtttacctattgtcatagccatgctattgttgtaccatgtccctttgtcagcttggggttataacatgactagagattggactagggattgcttagccatgcttagttcaactagttcacaaatggggaagatcctattaatgtttagactgtcggttctaatggtattgttggattagtgccaccgctttggtgttggttaattaaaataaatcacatggtgggctgtgggtgcatggttttgctggtcgcacccatggcagctaaggaccggttcgcgggatgccctggaagaacttatcgtacttactacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgctaatggtcctgtcacgacctctttccggtatgtcatggtggcatgtcagcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagtgtaatcttttgaatttggatagcttaggtggatggttgggcctgttgcaacatgggatagcgttggacagtggatagttaatattaattaattattacaactgtttaatctttcaacttctgtttataaatgctcactttatgcaaataaaccactttagctcttctttgatgattccctgcatcatgcctctattccagtatgacttgctgagtacagtgggtagtactcagtcttgctctaatttttcccaaccccagagcacgagtatgtgtcagatgaaggtttctccgaggagtaggcttcgtccgtgccgtcgaggatgcctgtggagtggtgttcccgctgcagttctagtcaaggcttagctcctgttgtctttctttctttccgctgcatttatgtaagactttcatgatgtttgtaagacgtggatctgaatgtcaacattgtcgtttgtgtaccccggccggtcctggacggggattttaatgcacattctgcttggaattctattcgcgaatttctgggcgtgacactaaaagaccaactttatctgaagccgatttcccatctatcaatgagccaactgtagttggcgagggtaatgagatcacaagccgtcgatgcatgtcttttggagaagcaacatctacctacaatggatcagagctgtcggctgaactcttcttaaattggtatggcaacttttatgatggatttccaaaggattccaaaatttggtttgcttatgaacatgctgaaaattttgaactcccagccaatttcagatttgatgagatcagccatgaaagatttgaaaaatccagagaagtatttacagctgccatatccccttgcatacttcctgtcggcatccaccaagacagaaatattcaagtttcatatgagttttaccatccgatgagcacggctagacaacttgaaataggtcagctatcaatcggcttatatttcgtggacaagatccagaccaggggagaaatcacatcagccctcatgatggatagactcctgaacatcccagggcccccactaggcagtatggataatattgtgctagccttgatgaggagttcaacttttaaccgatggtgggcagagtggaaaaaacatctttttcaccaatcagcttccatatacctgactaacatgttctgagagatggttccgcaagtaagtattcttccttttgtcaaattctttattgctaaccgatatctcttgatatttggccacttcaattgtttgcagaccacggaatcttcacctcctcatactagccaaagtggagaaaccatctgctatgtcgttattccaattttaagctcattcaacctaagtcattttgtgatttagaagtatcttctttaaaattcaatgaagaatacaattcttagtaattaaatccgattatttaccgcgaattaattacttatagagattacccaaaataatctataattatataaaattttgcaattctacaactaaaagaaatctacaactaaccccaattattttaattttctaaacctccttaatctctccctaatttcaatttacctttcctttttcttttttctctcttcatttctttctttttctctctttttctctctctcccggcttcttcttccctctcggccctctgcctacccgggcggcgacgacgaccgaacaaggggagggggcggcggcttaccgacgacggcggcggcgacggcggcgcaaggcggggtgacacatggcgcggcggcacgaagggcggcggcgcggtggagaggaagagaggagaaaagaggggaaaaggggctggggtggtgtgggatggaagggcgaccgggggggagggttatagcgcgcggggaggggcggccggcttaatggcgacgcgacggcgcggcacgtggggctcgagacgacggcgacgggcgagcggcgcgtgacgtgacaggcggggcgactcgacgcgcgcggcggcaaggggctcggcgcgatgggacgggcggcgcggcagtggcgcagggcgacagcgacgagacggccgcgcggcggggcgcaggcgcgaaggcgacgggcggcgatgcgacggcgcgcggcgcgcgggacgcgaggtggcgggcgcgcggcgcgaggcgtgacggcgacgggcgcgcggcgatgggacgtcgacggcgatggacagcgaaggcggctcggggcgcgaggccggctagggcggcgcagcaacgatggcgacggcgcgcggcgcggcagcggcgatgggacacgacggcgatggcgcgcggcgtagcagcggcgacgggacgcgacggcgacgggggcgtggcgctcggggcggctaggcgcacacggcagaggagggggcagggctagggaacctcatcgagcacctactgcacaatgaacagtgctagtcctatttatccctaatttagcctatttcctatataaatttcattctataaatcctaatttttgcacaaatggagtttactcaatatttgtgctattttaaccaaaagattcaccctagattaattttacccatattttatttttatataatttatttgaatttttaattagggccaattcttattccatcgcacttaaatttaattgttaccaatatggttgcgataatattttatttatttctatcctcacctaatctttatttaaaattatatttcaattatttattttgacaatttatttttagggtttattcctaattaattattccttactcacgattaatgaactccgaaatcaaatccaaataaaataggcgaataaaaccggcatgatgcaatttatttaaaaagtttttgaaggtccgtatttttagggttttgattttgttagtcgaattttcagcgtgttaaaataccggggatatataaagaagaatatttcattaattcagaaagtactacagaagagattacaaaagctgctagagccataccgaaactcttccgaagactccgagggactccaaatactattctatttctactccacttagcactaaactattaatactaaagtatgaagaggaaattgcttgcttgagtgtgtgttgaagtgaaatgagctcctctatttatagggccggtatgacggttattgaaaggtgagttgtcggttttgcccctgtaaccgtcattggggatgcatcctggacgtccttgtggagggccgagctgcgccgctgcagccagagttcggttcggccgaaccttggccggcccagcaggcctccaaccttggccagggcactgacaggtgggaccttatgacggttaagcagttaaaaccgtttcccgacggttacacctgacaagtgggccaccatcttatccatggcttgcttgggagtgagttttcctcatttcttttattgtatttggcaattcctgcaaaatgttattttccaagtacaagtggaaatacatattatttagaaataaaatgcattgtaagcatagctaattctccattattttagttaaattgatggtcgaactttgtcggtaacgaccatcaacagagaggattaggtgctaacatttccttggatcaaggcaagttctctcctcccaacctttgaacacattgaatcccatgatttgaggaatgaaaatatttgtttgcaaaagttgcatgtgaacctagactatatcggtatttaaaaatttgaatatggtagctatggccaagttgatgcattccctcctttgaataattgtgttccatgctgtttgtacccttagaaatggttagagtacatcccttgtgctcaaatgagtttatatatgctctatatgcaactacttgcttagccatgcttagaaataagcaaatgcttattccatctacacttcaaatgtgattttaaatatgtggatacttgctggaataaaatgaatgtgatgagtatttgtgaactaaaatgtgtaaaaatgtgattttgacttgggtagcaagtgttgttcatattgtgttagttgcataccgatagggggagtgtttgcccaagtccataaggaccgaacttgtatcaccaacttaaagtaacccgtacgtccacatgtgctagtatgggatggcctaagctaattaatctacttagcatcaagccttgcattctggtaggctagtgtgtatgggttcgaataactcagaggagcttcctatttgccccgacgtggtagtttaggtgactaagcctgttcaatacaacggtattgtgccacgtggtgggttcccatcgtgtccgccaccacggtgttaagtttaaggtgtgggcccaccatttaacggttctaagtattatttccagtatgcctaggatggaggaacacgtatcgtgctggtgcaaagctagatattaagtagtgtaaaggcttcattgtgtcctctagactgtactcaatgtgtagagtatagtggtgtcgacgggtaccggacaaactagagtgattcacatcatgtggataaagctgtacaaactttgcagagtctaaaattaatcgattagccgtgctcacggtcaagagcgatttggtgaagtgtcatgagtatagactctatgttttaaattgtgaacatgtgacatggtttggaaatgatgaaatgtgttgagtagtgtgagtgtggtgatataatgtgacttgttgtcatggatgacaagaagacttcgattatgatggaatttcgatgaactaaatgatgaaaattaaaacttgtttttgttagttgaactgtcaactcttttacaaaagatttgtgaaacaaaacttgctttatgctgaaaatgaactacaaattgccctcctttgaatatatgccttacatgtagtatgttaggattgatttgtgcttgtcagtacattaacttgtttaatgtactgactcttgctgcagatataatctttgcttgcaggtttagacttagcctttaagtgatgcgggttccgattgattcttctaggagttgaacttaatagggtatacccctagtcggtgtgcttgtggattggatagacaagcttccgctattcttatatttatttggccggtcagccattgtttctaatcatagatgtagatgtaattgctttcatctcttatttgtgtttgctatgtatatctatgcttgagatgaaagtgtgaatctagtgcacatcctggggattcacatgagtatgagttaagattatttaagttgttgtagatctttagtcatattgtcaagtctcctgaatgtgtaacacatctggtcgccgccttcgagtggtttgacgagaatatctcaggctgaagttgactggcaggctaaaggcccagcaatgtttcgaataatgttctctcgaggttttaagacgtttcattatgttcattgatgatttgaaatataatcacttcatctttcgaatataatggaaggtcaggacagcctacgacagcattggtatcagagcaagtaccgaccataggaaacccttaagttggtcgtttagaatggattcttaaaattattttgtgggctttgctctcagttacaaattatttgcgaaaaccatattcaaccttatatctcacccttctccagagattactttcccttatgtttctactttgaaattttgaaaattcttatcttgtctttaggatcgaaaccttttaaaagtttgcatctctataaaattgagtttgaaatcacctgttaatctcaactaatcagtcaaaatgtttcgaaaagctttgaaatctatttgcaaactactcctatgtactagcgcggatttgcaaaaaaaattctggaatttgtcaacagttgcattcaacattttgtgtagcccaaaccttaattgataaaatgtgcatcttttcacagtagattgcatatcatggcataaaaattcatatagtaatgcgcatcccaatatgaaaacagtcggtaacccggttgaaaaatttgtgtagcccaaattataagtgataaaatcttggtttctttaaggtaacttacaatcttgcatacccatcaccccgatttttacccaaagttttgagccttcagacccttactcaaatattagacgaagacagtaggccgacacattacagcactgcatcattcatccaaaacactgcccgtaagataaaccgcctcccaaaaatcaccatttcttcttgaaccatagacagggctgcagg

SEQ ID NO: 21077 - DNA, 1160 bp, Oryza sativa
atttcttaaccacaccaactcacttaaactcactaccattgccctgtattctgcttcagcagttgaccgagacactacggattgtttcttgcttctccaatataccaagtggccaccaacataaacacaatagcctgaagttgaccttctatcatcaagacagctagcccaatctgcatcacaatacccttctatcttaagatgtccatttttcttaaaccataagcctttgcctggacttcccttcagatatctcaagattctatacaccgcctccatatgaccacttcttggatcatgcatatatcgactcaccatactgacagcatatgctatgtcaggtcgtgtatgacataaatatatcagtcttcccaccaatctttggtatcttttcctattcactggatctccagactccgcacataacttatgattttgatcaattggtgtagagactgggcgacatccaagcatacctgtttcactaagcaagtccaatacatattttcgctgtgaaataactatccctctaggagatcttgcaatttcaatacccagaaaatatctcaactggcctaggtccttgacctcaaattctttgcttagattccgtttcaacctagttatctccaagcaatcatttccagtgataaccatatcatcaacatagacagcaagaatggttatatgatctccactatgatgatagaaaactatatgatctccattacattgcttatagtccatagcacacattgcatgcctaaaccgatcaaaccatgctcttggtgactgtttaacaccatacaaagatttcttcaatctcaacacctttcctttagtttgtgaagtggcaaatccaggtgggacatccatatacacctcttcttgaagatctccatgtaagaatgcattcttgacatctaactgatgcaatggccaatcaaaattagctgcacaagatataagagttcttaccatgctcatctttgctactggtgcaaaagtttcatcataatcaattccatatgtttgactatatctcttagccaccaaccttactttgtatctttccacctttccatcaggattttgctttactgtataaacccacttacagttgacaattttcttcccttcaggaaatggtacaagatccc

SEQ ID NO: 21078 - DNA, 12211 bp, Oryza sativa
ctgatgaaagaaagctactaaattcattgtttatatactcccctccatatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtagaagccatcaatgcaagacatacatcttcacttgtcgcctttcgatccaaataccaaagtccatcacgcctgacgtcaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgcacccgagtcaagtatccaatttgaatgagaactattgatagacataaatgtttggtttgagttacctgaggaagaatgaacaagattggcaacatcaacatttgtagatccagaacaaccctcttcaagagtgaccacattagctctgtgatcacttctatactcatagcctctacctctattacctctacctgcataacctcttccacctcttgctccacccctatcaccaaatcttcctctcccataactaggcttgcgaggagcgcggcaatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaaggtagtaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaatagaacgctccccctgtctcaaaacacttatcttctcctgtgcctccaccattaacatcacatttccttctcctgagtagagattagtaagagttttccacatctcacttgcactagagatggtctcaacagttgtagcaatagcagggataagtgaggttaacaaccatgctactactaacgagttggtagtcctccaagtcttccattcaacacttgatatgttctcaggctcctttacctccccagtaacatatgcttctaacccctttgtcttcaaaatcaataaagctcttcttgaccaactcaaataattttttacaccctccaacttaatgtcattttgcatcaactcaattttttgcaccgattcagtatgaggaaccactgcactactcgtagttggagcctcattaaacttctttgtaagcatctctaccaatttacccattacttgttccagtccctgattttcccccattttaatcaagcaatacttgcagtagaaagttccttattctcaccttctataagttgtagcaactccagccagcagcagctacacaggcaccaaatcctcccttttcctttcaacagcaacagcacaagcacctcacctcctctctgtctcctccctttttttcctttcaacagcacaagcacctccgtcgcacagctcttctctgtctcctctcacagcacaagtaccaaatccaagcagcagcaacagcgccaagcacactaccaacgcacagctcttctctgtctcctctcacagaacaagtaccaaatccaaacagcagcaacagcacaagtacactaccaaatccaagcagcagcaacagcacaagcacacttactcactccttccttcacaagcacaagcacacctagcactgcagccctgctccctccttcacaccggccgcgctgcagcagccgtcgccgtctccggcgtcgacgtggcctctccgcctcaaccgtcgacgctgccgctccacctcagcagtcgacgggtgcagcactcctccgctcacagcgccgccgctacacgtcctccccaacaccagcgtctccctcctcgacgagctccggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacagataactagtctatttacagcccaacaaggaattctatacctaccttccatctttagttgagggggctgaacacactacctacccagggctgaatgagataggcataggtctgcacaccccacacctccagctagcaggctttgttcgtgcgctagatatgctttatcgctccacctttgctgagctgcaacgcgtccgcacaagggtagcaactttagaaaggagtatcttgcctaggttttgccagggataccatactccggagttcatgtatggagaagatgctatgcttgctccagcgaggacatacctccacccgtcgggaattacttcgagagaactctacccccccccctccacgttgacgttgttgttatttcttacgatcacagataaatccgcaaacgcacggaatataccgatgtagcacttcacccgggagtattctcatgtatcgatttccacagggaacatgtgtgctatctccggttcaggttcaaccaaggacacgaagctataaataggcaaaggatagagaggtttctccaatgaagaacaatgtccaaggaaatgttagctttaatcataatgcggtacttcgggcactggccagctcgctgctcccagatatcgctctactgcgcacccggacagggaggacttcagtgatcttgaaatgttagctttaatcataatgcggtacttcgggcactagccagctcgctgctcccagatatcgctctactgcgcatccggacagggaggactttagtgatcttgagggctatcatcacctctacacacacctcacacctactgtgggatgcggagaaaacactctgcgtctaagcagattaattacttactttaacgctagctacacactaaagcaaatcactatattttaattgagtataatgaatgatgatcccgtactctaattaggaaataacaagaaataattctcaccgaacaaaactatattactcaaaagatatttctattatagccagagtaataagcagagcagaaagtaaagggacaggattaccgacaactccggaagtcctccaacttcttctactttattctcttcctattctaagtatacaatatagtacaatagagtctcttataattcagctcaagcttagagtatgtgagtgaagtgaagagcagtttacaatttcacatactaaatcgaagagcagtttagtttcgtcacaaccagttttgggcttatgtacatcaccaaactgacaacagcgcatcatagccaacttgaaaatctacgtaagcttgtagcatatattacaaataaaacatgaaatgggttttaaaacttcacatgaaccacacgttttgttctttttatttacgggaaagtgttgcctgaaattctgaaatcacaagcgatgccagcatagcacggtaaaaaaccctaaccactaagtattgcacaagctttaaaatgtaacatcaccttctgcaagcagaaaacctgaaaaggctgaatcttgcttagagattcatgagaaacaatcaattgttttgctttttgcaaggcttgtatctgaacaattcatatcaacactgcaaaatacaaccaaaaattgatgtccttctcacagtgaggatttcaaccagcagcagcactagcccagcagcaggaggccagaacggtagcagcagcagcaaaacggcagaacaaaaagtccagaaatcccaggctcaactgaatttccaatacatcatactattttcagcaggctctggacatgcacaaaaatgacaacggctagtgcatctaaacgaactaagttactgaaataaaaactacagggaacaaaactagtggtagcagcattcgcagctgctgaaggccatctcatccctacagaagaaaatcaggcgatcaataattcaaaatcggttagttgatcaattcgtttgtatataatcatcacttgaacctagccctcatagttttaatgaagcaaataagtaatttaataattaattcacttgccttgcagttagaatataacattccagaaaggaaaatttcattgagttttgcccccaccaccagagcacgctcctgcattacttcctgtgtattaagaagcaaatgttgaataaattgtaaattattattagatcatcatagtacccatattcaattagacatccagaaatataaaatcaagtaatttgaatacctaatagttgcatattaacatcatcgtcctcaaccgtatcagttagaattgaatagggatcaccaaaacctaaaacatcagaattccaaagttcaacataaataagtttatggcccataatataagtagcaatgaacaaggtaggctccataccatctgctcgcatctaatcttgaaggcaaaccaatgcctccacagttccattagccagcctactcctatagtcactaatgattctagatccagtagaaaatgcagaatctgatgcaactgaagatgcagggacagcaagcaaatcaagcgccatgcgtgataatattggatatttgcatgagtttaccctccaccactggagtatgtcaaaatcatcatcagggaaatcattttcttgaggaatatcttcgagatagctagttaactcagtctttctttactcttgctttgatcatgaagatattgcctccagtcagcaaattggctgccaccaacattcactccactagttgatgcttcttgagaattgattgcgcttggaccaccaatttgtgaagaatattcaacaaaccaactgcggactatcctcttaattctagacagatatccatttggaccagttgccttatctccaaaacctgctttcagcctaaagctcaaggaatttcaacttaaatctgggataaaaaataacaggaacacaaatgggcaggacgtgcagatcccaatatttgtgaaattttgtatccattttagaacccatgctagcgacaagaacatcctcactgttggactcatttagaagcatcaccttcactttccaaaattcatgaaagtagcgagacacagtgggatatgatgtcccggaaaccacaacagttgcatcatagaagatcttgagatgtttgcaaagaacttctgcattgtcccaatcaaaaaatagtggagcatcttgaaagtttggatcaaaccgatccaatgaatcaaaagccctcctgaataataaggatgaggaaagcatcaaataggtggaattccaacgagtggacacatcaagtgaaggacgcttctcttcaacaattccgactgtgcaatgatttcttcaaatttttgctcacatgcttctgatgcttttatatactttacactttcccttatcctagatatggcaccactgatagtactcaatccatcttgaacaataagattaaggatgtgagctgcgcaccggaaatgaaatagctcccctttgcaaggcatggcaagcttacccaagagatttcctttcaattccacaaccatagaatcattaacagatgcattgtctactgtaatactgaacaacttactttctatctgccaatcctgaatacactttagaatttcattgaagagagctatactatcatgtgggtacgcacttgagtgaatcttatgatcctcttttgaatattccattcattgtcaatgaagtgacaagttatacacatgtaacctaggttttgattagatgaccacatgtcagccgccagtgaaacccgagaatttgttttcctcagtacctcaaacaaagctaacttttgttcttgataggcagccaagcaatcaccctttatagtaattctggaaagcaccctaaagtacgggttcaagcttgcacaaaatcttctaaaaccagggtgttcaacaaaactgaaaggaagttcttgcaaaacaagcatccttaaaagttctgcacgtgctacatcaggatcaaatttccagtcctttagaacagatgcattaggagatagactggaatgcaaactttcaaccaattgttgcactctaattctcagtggacacttaagtaaatgtctatggcattgacttgtccccgaaccacggttagctttaattaccttactgcaatgaatgcatttcccatagagcacctttccagtagaagaataaaatggtttaaattctttccagattaaagatttgagtgttcttttccctgaatcattaaatcatatctaaaattaatctattgagcacaaacaagaacaggatttgtgctgggactgaactaaaagtttctgctaaaattatactaaaaatttgagctgaaactgaactaagagttgtactgaaactgaactagaaacttatgctgaaaccttaactgaactaaaatgtgttctgaaactgagataaaaatttctgctgaaactgagatgaaaattttcttatgaaactgaaccctaattttctgttgaaactgaactaaaaatctctacagaaactgaactaaacttctactagtaaagattcctgatgaaagtgaactaaaaacttctgctgaaactgaattatcttagctacatgaataaacaggggctaaatgaccaaatctccaaattcagaattagaattgcaggtgcacaaacctactaaaactaaccacagaatgtaagtttaatttgtttgggtggaagataaactacagaattatatatgcaatacatcaagagtaaagaactaaccagaacgatgagtcacaacatgaggtgttgattgagttgactcccttggctgagtttcaacatccagctcaattgggatagcagacggacttgatacgaaccttgccactggagacatagatctagctcttggagactctgcacttggggacatctgaccagcaacttgtgatctctccatgatgacttcattttgggaaataatttgtcgcactcctggagacctgactattggcaatgcaataggtgatcgtcttcgctttgctgttggaggattcgatgctgctaactttcgttttgtagccaataactgtgttgacgatgataggcctcccgaagagccctctgcaatgacctctttgatatgtcctccttgcggaacttcagctaatgatgtcgacatgggagaaaaccaaagtactgcatgtagaacaagatggacaaaattttaaataataaattaccaaaatacttgcataatatatgaacctcagcccatccactcggaaatcaaaaacttcatgacaaactagaatgtgccaaactgaagaccgattataaactaaaagatatgccaaactgtgcgctagtactccctccgtcccaaattataaggccaatatttttttacacggtcttcaatgacatactttgaccattaatttattttatgttatgttcccaacaaatatgaaattagcttcacataaaagtactttaaaagatgaatcttgtaatataacatgcataatacttaacatatatatggttagtacgattattagtcaaaagttaccgagtttgattttccttaaaaagatggcgccctataatttgggacggagggagtaatatttaggacttcacaaaactgaaccgtgcaagcatatatgactacaaaactgaattcattcttcacagactaatgcaatgagtaagaaccaaaaattaacataaccaatagtctcaactcctcaagataaaatcatgtaacatttgcagccaaaacactaatcaaaacacaagaaaaggcaaagactgatacgctctgttaaagctagcagcttgaaatgagatacagatacacgacagcttcagtagcaatcaacttggattgctcatatattctatatatgcctgcggtgtcaaaaaaccatgtagcagtgaaatccaagctttatttctcccagttgcaaatattgcaatcctaaactttagggtacgaagaacaggattaaggatcttttagtttgtaaactgtgtgctatatatctaccaatcatggggacagagatacacatctgtgcatgttcttgaccaggcaccaaaccaagcggatcggataatatccatgagaaatcaaaccaaaaacaaacaagtggattggattgttgccacgagagaatcacacctaaaagttggagatacaaatctcaactatacaaatcacacctaaaatgaagaggcaagaactcacctgagccgagagaggggatagacgaggcgtgccggcgccgcggcggcggaggacgacgagcaaggcagcggcggaggacggcgagcgagcgagcgaggcggcggcagagatggcgagccgctcgatctcgtgtgtggaaacggcgacctagggttggggacatgcagacgagaaatttcagaatattccatccgattcgtagcacgttcaggattaaccatccaattcgcatgtctttcagaatccaccatcacaagagctaatttcttcatttcacgccactccgtccatccgaagcagcaccgtctatccatcagttgccgcgtcctccgtccctcgccattcctcgtcgtcacctccagctccggtcagccaacctcgtcgcacacccgtggtcctgccacataagaggggacggttcctggtgcacatgtcggaggagctcagctatcgccgcgcaggatcgccgccaccgtgtggaccacgcgactagtgcgctatgtcggacgagctctcagtgaggctgagcttgtggatgaccaatagaattgcttcactaatagagcttgtggcagttggggatgacggccgagcatggggatgggcggacggcaccaatggcgatggcggtggacgaactcgggtacgatctagcgacgacggcggacgagctgtcagatcccggggtcaaatgtcaccaaaaatctgcagattcgagcaaatttgggctaagtagctacctaataggattcctaagacagaaattaagctaagaaaattaaaggatgccgcaagataagcaagtaggaactagagtttatatttcttgatccccttttcatccacccagatcgccttttatggagtacggcatctgagtgaggaggctggacaactcagtaggctgtgattacattaagttttggagttttaggacaaagcagtacagacacagtaattactgaaatgaaacagctccctcagatttacatcattgaactggtatcttagcatctgggctgcccattcccgcaactcctatttctctttctgataaacaacttcttcagataagcagggcctgacaatgcctcccccattaagacccaggtcctcatgggttaaaccagggaaaagtcttggatataaaggatgcatcctcccaggtagcagcttctattggtagattctcccaaagtatcttccactgcacaactggagcattgtgtcgagggatcagtcgccgctccaaaacagcaagaggggctgttaatatgttgccatcagaatcaatcagaggaagcccaggttctggaactgccttaggaccaatatggtgtttaagttgactgacatgaaacataggatgtatttgaaaatttggagggagcaataatttataagccacggagccaattttgttcagcactcgaaatggaccataatagcaagagtaaagcttgagagaactatgcaatccaagagcattgtggcgatagggttgcatctttaagtaagccatatcaccaacttgaaatgtcctttcagaacgtttagtatcagcatattgtttcatacgagattgagctttgtccaagcttgccttaacagagtccagcaaagctgcttttgcttgcttcctgtttctgcatccagttaacagtgacgcaggtaaaagagcttcaccaaccataggtggttgctgtccataaagtgcttgataaggagtcatattcagagatgtatggaaattagtattgtaccaccattcagcttgatctagcagagaatgccacttctttggtcgagagaaagtgagacagcgcaagtatgtttccaggcattggttcactcgctcagactgaccatctgactgagggtgatgggttgtgctcaagtgcaactttactccagcatcctcaaagagcttcttccaaacatgtgaagtgaagattctatcacgatcactaactatcacagagggtaatccatggagtcaataaaaatgagtcttaaacaggtcgaccatatgctcggaagtgaaggggtggctcaaagcaacaaagtgagcgtatttagtaatctgtcaacgatcacccatatgacgtccttgttgtcagatttagggagaccctcaatgaaatccatggtaatatgtgtccaggccgtttcaggcaatggaagtggttgcaacaaaccaggaggtaatttgttttcaaacttattcttttggcaggtagggcattctttaacaagggtggcaatgtctgatttcattccaggccagtaaaaaaggagcttgaggcactgataagtagctcgttctccagaatgtccacccaaaggagaagaatgaaatgactctttcaattgttgctgaagaagattggtatccttgcccacatatatcatgtccttataccgcaagattccactgtgcagtgtaaagggaggtcgtgcagtaggatgaatgcttaacttggttatcaatgatttacatttagggtcagctggataagtggccaaaacttgagtgatccattctggaacaatcactattatagcttggagagtctcttgctgtggggctcgagagagggcatcagctgccttgttttctttcccttttttgtactctatcttgtaatcaaaactcatcaatttgatcaataatttgtgttgggtgccatctgtaattttctgttcattaatgtatttgagactggcttgatcagttttgatcagtaaagaggaagccaagaagtaatgcttccacttcttgagtgcttctaatattgcaatggcctctttatcataagtggaaaatccagccgcttttgggcccaaagatttgcttaagtaagcgagaggacggccttgctgcataaggactgccccaatcccatagccactagcatccgtctccaaaatgaaatgaagggaaaagttaggtagtgccaacacaggtgcttgagacaatttatccttaattgtctgaaaggcaagttgctgatcagtctcccattggaactcatttttcttaagagcattgaaaaggggtctgcagataattccaaaatccttgataaatctcctataatatccagccaaaccaagaaagccacgtcgttgagtgacattaaggggtgaaggccactgctgaactgcaactatcttggcaggatcagttgctactccttgttcagaaattatataacccaaatattccacatgttgttggccaaatgtgcacttagagggcttagcaaagaggttgtat

SEQ ID NO: 21079 - DNA, 5909 bp, Oryza sativa
ggctttgggcaactaagtgacttttaaatgctgtttactgcaaaacttaacccctattattatccccttgtacccccttgcattaatcatgcatctgccggtgtgacttgctgagtactgtggttgtactcattcttgctcaatctttcccctcttcagtaagagaagctttggagaagaagtcttaggtggagtcctggcttataccccagttgagcgcctgtgaagatggagcagtaggcccgctagtccgctgctgtttatttttgattgtcaggccttaagtgcctttgtaataatgtaaatattatcgatataatacagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagaggataaaacctaaggacatattttataaataaaattatttgcgaaagttccttttttctccttcccctgtgctatttgcaaaacgtttactctttcttccttcttcaaatttcaactagtactagatggtcggctttgtggagaagaagatgttgtcaattgtctgccgaagctccggaagactgcaggatccgctagtaaagtgaaggaagcagtgaagccagctgtgaagcaggagcgaagatcttggagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacgttggtacctcaagctcccgagtgaacgaagcaccagacaccagttgtgtgacactggtccaacacctgattaaccagaaccgattgcttatagagatactgcagcagcatcagacgccaattctgaacctgagtcagatacaacctcaagtgcagttggaggcagtccaagcacccacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagagaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagacgagaagtctccccaaggtttcaaccaggataaaatggaacgtaaggcatgctctcgttgtggagaaatcggtcatgttgccagctcgtgtgccactacatgcattcattgtgaggaagaccatccacccgacaggtgtccaacgagcaggatcacttgtttcttttgtgaaggaactgatcatgtaccaaaagattgtcaattcagttttctgttgacgaagaagatggccaaccaacctgccagttccaacggagagaagcatcaaggccacacaaatcctcaccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaagttattgtcggttacaactgtagtacctgttaaggaaacagacatgccaatcgccaagtggtcactggagcaaatgcagtacctgttaagcctagcgctagtcagaagcaaccataatactcttatatcagtgttcaaatacttttgttttatagttgttccccgtcaatcatgtaataacagagaaacatgagataatgaatgagtttgataagtttatgaaggatccatgttaagattgcaagagctgtgagttgtgtacattttgttgttgattagggggacctagggtctcatttccgtaagctcataatctattatgaatcaaataacctagcgattgatggcgaagaaaatcaagtgatcaaccaaagagacatttgtttggactaagagtttcagatatgtcttcttcggatcaaaggcatgcacccgttgtggagaaattggacacgttgctagcatgtgtctcacactctgcactcactaggaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctccacctagctctgcaataaatcatagcaataatacctttagcaccaaccattctctgcaccgacagcctcagcaaagaattgtcgtcgatggaagaagttgtgtctctccccgacctactccaggccgagcaaagggcaatcaacctccggagggcgataccaagcagaagaccgtcatccgcttcaacccacaatcagaaggaagcttctcctgtgaatgatagcaatatgcagtcctatcacatcatcacagaactaatcaaggatgcagtcactagaacaatgccagctatatctctccagaatcaaaatgagcagccatatttgtggttttcagttcgctacctatcattgtgtaatcgaaagtttgcagcaatcatgtaatacataaatatattcatgtctataaacagtgagcttgctatgcttatggatgattcatgttgaagatacaatgtaccgatgttaagcaccttccctttttgtttaaggcagtgcctcgtattcttgtaatatgggagaaatgtgtaataaagacaagttctatgaggactctttcagaagatgctgatatgggattatgtgtataattgtttactgtcaaaggagacctagggtctcatttcagaggaactatgttctaacctcgagttaataaccaacctgttgatggaaaagaaaatcaattaaactgtgttgggttaaaaggccaatgagacagtagttggggataggagtttggatacgccttttacagatcaagataaggattgttggatgaaacccataagggtacccgccatgcctctacattgataagttcggatatacctgcaaacagttaagaagacccaggagacatcaatatttgagagcatagtagtcgatggttggtaattagtctatcaggtatcagaaaagggtcaaaggtgatatggcagaagaacaatttggattctccccatctcgaggaagcactaaagatgatcatcggcaattaaaccctagtggcatagatacagatagcaagcaatgtatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaggagtgaaatcttcaactcagtatcagatgctacacggagtgaaaagtgcaagcaccggttaccaggtaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagctgcttgttcgtgggagctattcccagttatgaaccaagtgatatgttcgaagatagtctacagaggtcagattaaaatcacctctaacaacgaagcttcagatttggcaggatcacgatcagacaataacaagtccagcagcaaagtcattcgggaagacgtcaaagcatgtcaagggggataaattggttctcttgggaagcataacttatagttaaagtggttgacccttgcatcgaatagcagaagtacctagcaccggagaccaggaaagctaatatgagatagttaatggcaagttgtcaatcatggtatccttagtaagcgggatatcatagtctaaagcatatggtggtaagctggaaggaaacgccaagcatggtattctcatgatgacaagcatggtatcctagtaatgacaagctagtgttgacgcatgagatgaagtggtaacttgtatgaggttgactccgaagatatgaatcatgagaagttctggaacggaagcatcattaaactaccgcaacctagtctgagtcagctaaaaggtgcaccctggttcaagtcaggagaagagaagattccatccgcaacaggagatcgagccaagcagtccagagtggagaagttttgctaggcaagttcgttatagaagacgcgacggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtataagaaaaattcaaatgtggcccggagattttttgttaaattctccttggtctaaaaggagccctcaaattttagtggaattctcagagcacaaataataattattaagaaataaacaaagttaaaatgattttataaaaagaaaaatcctaaaaagtcttctttttccccccttcccctcttgggccggctcggcccatgtccctccccctccctctcctctccccgcggcccactcggcctctccccgcgcgcgcgccgctgacgggcgggcccgcccgccaccctcgctgacaggtggggcccgcctgtcatccctatcctcgcgccgctcccgccgcccgcccgtgccctagcgccgccgccgccgcggattccgccgcatcccgccgtccccgcgcgcaataaagtggggggaatcattccccgtgattccctctcccttttcccccacttttccccctctctctccctcggattcgctcggaatctttcccctaaacctcgccggcatcaatggcggccgcacctttcgcggccgtttcccc

SEQ ID NO: 21080 - DNA, 1259 bp, Oryza sativa
tgcagaaggcgtggctcccttctcaaccactccttgcccttgtttgctattggaatcaaccagcagatcttggattgccttcagatgcttggtaacctcctccttgtgagcttgagccaaaatcgcttgactctggatttcctcataattagcttgttgtctccttctacctctttctgaaactcctcaaagtttaaccgcagttcttctaccgcagcctcccacgccggcatcaagacttcttcctccaatccagcagcatgtcccctccccatggtgagaaatacagatctggagatttcacaggaaagaaccttggcctctcccaaccctctctgcacttctcaattctgcatcttctccaccaaattccaaagcctggctacggaattttacagaggaacttgtcctcaaaccctcaccagcttaggactcttcgaattggagaaaacttggccaattttcgactgatgctctgatacctttgtcagatcccggggtcaaatgtcaccaaaaatctgcagattcgagctaatttgggctaagtagctacctaataggattcctaaggcagaaattaagctaagaaaattaaaggatgccgcaagacaagcaagtaggaactagggtttatatttctcgatccctttttcatccacccagatcgccttatatggagtacgggatctgagtgaggaggctggatagctcagcaggctgtgattacattaagtttcagagttttaggacaaagaagtacagacacagtaattactgaaatgaaccagctccctcggatttacatcattgaaccggtatcttagcatctgcgccgcccattcccgcaactcctgtttctctttctgataaacaacttcttcagataagcaaggcctgacacgagcttgcggacagcatgaatggcgacggtggtggacgagctcgggtacggtcgtacggcgaattggatggtaaatcctgatagggctgcgaattgggtggcatatactgaaaattctgcggacgcgtagtgggctcccagcggacacgcggacgcgggttcatccaatccatctagctatgcggccttctcgtggggcggccttgcgagactttttgcggggcggccttgcgggcaagcgggctggcccgcttgccacctgcacccctaagcgagaggcggatgcggaggccatcgtgacgcgttcaacgtctcgtgcaagcgcaggtggggtcggcggaagacacggtgttagcgg

SEQ ID NO: 21081 - DNA, 7982 bp, Oryza sativa
  unsure (1)..(7982): unsure at all n locations
ccccacaggctgttgaagtcccacattacgaaggaatgtgcttgactttgtcaacacttgggcaacaagatctgtgcaagtcatttcctgctccccttcatgtactggtcttctcaaaatggcttccatatcatcctagcaagacaatgatttgtcaggtttccttcacaatttattttcagtagtttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagagagtatacttcaattagatggagaagtccaagttatgtatttgtttatgatattgtagctaaaattgtacattttttttcctgaagttcaccttttcatgtaagatgtaaattaccattcagtgaatgaaatgtgtgatttttcgacaagtccctccctgattttttttatttataatgctaaagtgtgatgcagtctgatgttctccaaataaaattgtggatgccagaattgaggaggtcttctcttgccacgcgtcctacgacctctccgtccaccgctgcggcaccacatctaccccttcgcaccctccctcgccgcatcccgcttccacgtcgacgccgggggcctccttttccaccacaacttcactgcctcgtcttccatcgtcaaggagttcatcctctcggtggacgctgctggcaacacttccgactgtctcatcaacgcaacggcagcaacatgtgcactgtccgcgattttggtcgttaccgagcctggctgcccttccccacccccagcgtggcgccatcccccaccctcgatgaggtgaggcgcaacggtggacggcacggcgcccttcccccactccggcgtcctccttcaccgggaacactcaacccgccgcgacgctctcccctagcccgagaattgcaaagtgtagttaacaactttttcattaatttaaattcatttagggcctcagtcagttcgaagcactaatatatatatatatatatatatatatatatatatatatatatatatatatatatggcaacatatcctatgcacacaagccctcacgtgtacacacgtgtacaccaactaaaaaatgtcaccaaaaaatctagaaaaaatcatacccatactttcaattgtattacacctagggttaaaatcttaacgtcaaattcattatattttagccgtaacaaaaaaaacaaaaaatctgacagttttaaggttgtaattttgtcagaattttatcttttttgttattctctatgtagaatgaatttgaagatgcgactttgcacgtagatgtaacactcatcgaaagcacacgtatgagattttccctagaattttctgtgatagatttttagttggtgtacacggtgtgtacacgcgagggcctgtgtgcatagaatacgctccacatatatatatatatatatatatatatatatatatatatatatatatatatatatatatatatatatatatatatatataaacgtatatgaaattaatagccatcgtagtaaggattaatagccatcgcattaatgacctttaggcactgctgctaataatcctagtacaagaaaatgccatgtcatggatcatccaagaaactagagtaatgatgcctagagtagaaacaaggcaaaagatggcacagatattccagcagctatgctgtcctctcacaatccagaaataaagtgagagcaacgaatgtcagtacaattccaggcaccaagaacagctggaattcgcatatctcaattaaggagtttacacaattgagttcacaattcataattatttcacggctaacacattaggagctgtttaaaaacaacaatttcatcacaactcagattcacatatctcaattactcgacatcactatactcaccatcatcattagggatcataattgtacattcattttcactatcatactgccctaaggtatcatcatcgtcatcatcattgtacaggtcatcttcttcaacttccagatcccgttgcctgcgaatctgatcaactagggactttggtacacttataccatcttcgttgactggttgtttgtcgaccagagatccttccatggtttcaactcgagatatttcctgctcatcatcttggtatgtcagatcaacccctccctcttgcctgtcatcattttcctcctcattcacattccacaagtgccgatgcgaaaatttttgaacaacttccagggttcaccatgcttgttatcatccaagtagaaaacctttgttgcctgtgtggcaagaatgaaagcatcatccttgtaccaacaacttccatggctgatgcttttgaaatatccatcattcttcatcctagactttttgctacaggtatcaaaccaatcacacttgaataacaccactgtcctttgactgtcagcgtcagagttgtactgcaactgtattacttcttttagctgaccataaaagtctatatcttctccattatgtgtgccctcaaccataactccactgttttgtgttcttctactgctctcacgttccacggtgtgatatcggacaccatcaacaatacatcctgaaaatatacgaactctaagaagtggtagacttgccaatgcatataggtcttcatcgatttgttctccattcacaaacctccgagtagcaagctgcagtatatatatatatatatatatatatatatatatatatatatatatatatatattagcaaggtacaccagaaataatgcaagtactagcagactacttaactctaaaaatttgtaaatagatttttccttaggtccattttttatgcacaggttcttccatattggtctacttgttttttagggagaaaaagacattttctcaaaatgattcaggtaacactagcatgaacctgatatttcttacaattagagaaaaaaaatggtgtgacttctctacttaatataccgtatttcctcgtgtgatggtcatcactgaaaactgcagcttcctccaactattgcactagcatgtgcatgaaactccacacagcaccatagccctaccagctcttttgacaggaacaaaatgctatgtggatgtagccacacagcctgacaacaccccacagatgaacaggacgctggactgggaatctccatcaccaatacgcaacaacaatcatcctatcagacttatatacagggagctatcaggaatgtcatcatggcagaagaggcagctgcacttaatttagtcatctaatctcaaaactaaacatgctgctaataaaatcatttgttgtaaaaaaacaaaaaatgcacacgatgctctattcctctcatgtgcttcattctgccaagcaaggttttcaacagtagaagcaatgatgcatgatagcacagctgcattttattcatgtacatatgtaaatttcatttgcattctcacttcagtaaatgagatatgtatgagatatattcatttgcaatatactggaaatacttaaataatgatatattatcacagagtcaaaactgaaaatacttaaataatgactcacatgtttcctaaaccatcctggaaattccttagcaaggttcccctcaacatcatgactgccagcagtttgtaaatccttcatgtaaatcctacaaacaggtgcacaactcccatgtaagagctaaaattttatatgatacacaaataaaaacaggtgcgctattcaaggacatactctataaatggctcgacctccttagtattgttgaggacataccaaaccatcctatcatactccttctactcatatgtaagccttggtgcccccaacagatttgctccatgctggaaaatagataaaccacatctactcataggaacacgctctttgttcctaccctcacgattgtgcctagtgtcaacatcagcaaaataccttgagcaagcagtcaagcactcatttgcgacatatgcctctgcaatggagccctcaggccttgccatgttccttacaaagcgtttcaaggtcagcaacctacgctctacagggtacatccatccatattgaacaggacctcttaggattgcatcatcaattaaatgaatgcataagtgcaccatcacatcaaaaaaggcaggcgggaaaatcttctcaagcttgcacaatattattgggatttcacctctcatcttgttcaaagcatctaacttcaatttcttagcacaaatttgctggaaaaagttacctaattcagcaattgtttcatatatttccttatgcatgattcctcggagaccggctggtaatatcctttgcagaaggatatgacagtcgtgagttttcaatgcctgtactttgcattcatcaacactaacacaccttgctaagttggaggcatatccatctgggaatttgacattttttatgaaagcacagaaagcttttctctgggctttagtcatcacatatggagcatgtggagcagtgcatgttgaattcccatcatccttcaagtgtaaatttttccttatgcccatatcttctaaatcgagcctcgcagtaacagagtcctttgacttgcctgcgatgtcgagaaatgtaccaagaagggcctcacatatatttttctcgatatgcataacatcaagattgtgtcgtagctttaaattagaccaatatggcaaatcccacagagtcgacctgcgcttccagcattgaccttcttctaccctctttctctttttgttattaggatggttcccaggtcttacatgttccaccctcgccaattgctgcatcaactcatcctgagtaaattcttccggttgcgcacgttcttcagtctgaccattaaaatctttctttctcctccaaatatggtccactggaagaaaacggcgatggccaatgtagcaaatcttgttcctaagtcttttgtagcaaggatttttatcacaacaaacgcaagcatagtagcctctagttactctacctgaaagtgtgctcaatgctggataatcatgaatgcaccatatgattgcagcgtgaagatcaaattctttgccggtcaatgcatccaaagtagggacaccactccaaagatttaacaattcttcaaccagtggctgcaggaagagatccatatcctttccagggcatgtcggaccaagaataagtaggcacatcatgaagttggattgctccatacattgccacggaggaaagttgtaagggataagaaatactggccacatgctatatgaggagctcatcttcccaaatggattaaacccatcagtagcgaggccaagtcggacattccgtgcatcatttgcaaaccattcatactttctatcaaaatctttccatgcctcaccatcagcaggatggctaagctcattgtccactggtttcctcttcaacttgtgccattgtgcctcagctgaaagttctttcgatccaaacatcctcttcaaccttggaatcaaaggaaaatgccttagaaccttttctggaatcttccttcggctatctgcatccttccatcttgaagcaccacatattgggcatgcatcctttttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtcaaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgactttgttcttggtccatgattttgatctgggtacagatcctgtaccatacggtacatttgatcatcttctgggtcatccggaggctcattcgtctcaaattcaacattgcagctaacatcttcattcaaatgctcaacattgcagccaatatcttcattcaaatgctcaacatttccagtgacaatgaccaatggttctccatgatgtatccaccgagtgtatgtgttagacatcccgtacataagtaagtcatcctccacacgtcctttatattgatgtaaccgattcaaacacttacgacatgggcataatatcttctgactgccactcaaatttttacaaacaaagtccatgaactcagtgaccccctcccgatgctccttgctaaacaacttacaattcatccaagttctttccatctgttacatattgaaataagacaagcattgaatcaatgactgatcattgcccagactgctattttcctatttctatcacttcaaatctatggtttcagttcaaaatttaaaaccaaaacataagttcttctcatatgtacctttccttcctaattgaaggggatggggcagtctctggtcgacctcacccgccgtcggcagtgatcccaggctagagctcttgggggcttcctagcggttgagcccgtgaagcccagcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggatggggtggggcttgggatccagccggcggtgccgggctccagaagccgcgttgggcgaagggcgacggcgtcgagctccaacagccgggcgctacgttggggacagggtggggctacagcctgcggcgttgggctccagcgggagcaatgggaaagggcggcggcgtcgggtccagcaggcgcgatggggaaagggcagtggcggcggcgtcgggtccagcagccgcgatggggaaagggcagcggcgttggtctttgctagatgtgcgttgggattcttatgtctcccagcaatagtctacaagatgaaaagaatcaaagattagctcagtggtttgtctgttacctgggatgccagaggtcgtgtgttcgatccctcctcattgcaagaagcgctacatttttagtcttttcaagttaatattctaacttacacatgggtcccacatgtccacctagacatgctcacgtggctgtgccaaggtgttcttttttaaaaaacaaatgatttttaaattatgacaatcatatttattcacttttgtcatgaactattgtcacaaagaatgggaaaggcacatggtgacattttcttatgactaaattacaacttagtcacaaacgcttgtcatccaaagaaaaattgtcataaaggcatcactactgtgactaaaatgtgttttgtcatatgaattttgtcatagaaggccaaatttcttgtagtggcagggggcggcgactccgggttggcgaggctcgcgacgaggccgactttgccaggcgcggcatcgaggtagggcatcgggcagaggcggcctcggctttgtgcagccttgcagcgggatttgcgggcagggtggcgttgtcggcttggaagcgacgacctcggtctcgcatgctaggtacttgttgaaaagtccagaagggagagagaggaagaggagagaaaactgagattttgagggaaaattttggaataattacattgctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21082 - DNA, 1058 bp, Oryza sativa
tcagttgcaggatcaaactgactgcgatgcccgcatatcaccaagatttggaactgcactagagctaagcagatctctcaggcagttgtgttcgtcgacttagttcgcgccaacacagacttggcaccattagcaatacgtaatttgttgtgttttgtggaattttttaacagtagatatttttttatctgaaataaatattaaagtggttgctccggtcattttgatgtcaacaataaaaatattaataaaagaaaattgcaattaattcaagtgtcaagctatattttggatcgctatgcattatactctttggatttctgccaaaagctcattgctttctttctttttagttccaacccaacccgctacctccctctgcttggcctatctctctttgaacccacaagtgtagctgtagcccagctcgtatagccagctatcattttcaacccctggaaaactgtcccgtgttcgtacgataccagaaccgatcctccccatcaaattcggtcgaatctttctcaatctcctaaaattggttgagggttttgatgcactcgatctcctctttccgtttttatcaaaattggagcgaatctgcaaatctcgggataaaaatgatgacttttaaatggagattaaatctagtgattaaagggaaattgaaagggaaaatgatggagaatagtttgagggagtagtgcagaattgatttttgtaatcaattggagaagggaacgcatggagagacagatcgacatgctggcgatgctagggtttggcccgacgaccaaaaaaccggctagcaacgaaaataacttatggaaaaaacccggaaaaaagaagacaagaaaaaagtggatgggaaaaaaagggaaaacggagaaaaaagatggacggaaaaaaaagggaaaaacgaaaaaaagacggactaaaaaaggcaacgaataaaaagcgggtgaaaaaaaaggaaaataaggggaaaaaagactgacaaaaaacccgaaagccttacctaaatgccagtgcgtcacactgggtaaaattttccctac

SEQ ID NO: 21083 - DNA, 693 bp, Oryza sativa
tcctgcagcccagccttgagaagacagctcaagatgactaccaaaagcttgcatctgctgtatatcttcaagttagcaccatcagccaagctcttatctttgtcacaaggtctcgcagctggtcatttatcgaacgccctggctttctacttgtctttgctttcttcgttgcacagctggtatgctctctccctattaccgcaaactgataaattctttctgggtagaattgtgttaatctaactttcttccccttcaaatgcagatagctacattgatagctgtttatgctaactgggcattcacttcaatcaaaggcattggatggggctgggccggtatcgtgtggctctacaatctcgttttctacttcccgctcgatatcatcaagttcctcatccgatatgctctgagtgggaaagcatgggatcttgtcattgagcagagagtaatgctaatgcaccctgcatagttgtcttggctccttacctatttcgactgaatttccatgcatttgtgactaatggcccatcgatttcgacagattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcgga

SEQ ID NO: 21084 - DNA, 1040 bp, Oryza sativa
cgacccgcggtgcgcgctcgcctcctccctcgccgcgcaccacgtcgccccgcgggaccccgcccgggccgccgccttcctcgccgccgccgccgacaacctcgtaagcgtcgtcgcccctcacgttgtcgctcgccgccttaattttttcccccctcctcgaatcctccatttactcggtgagcttgcgctttcgtgttgctctaaacttccaccagggtgcagcgacggagtacgagagggcggtgttccgcgcgctgtcggcgctgatcggggaggagagggacgagcaggtggcgatcgagcggcacttcgaggtttgggggtagcttgtctccattttttgtaaattgagagtatgtgctgctggataaattgattaatggcaagaattgattggtggtgtgtgctttacatgtggcagttgctgaaggaattccccagggatctcatgtctctaaagagagctcagctcatctgcttctacatgggacgccctgatacatcgctcaaatttgttgaacaggtaagttcactacaaaggctcgtgtatgtttatatgcttacaaagtggaaatatcgtatataactaatgaaaccgaagttgaatctaacactgtttgttattatttaaaggaacacccatggtagcaactttattgaatcatcacttcaaaactttggataaaaataaaatattttacaacagttgatcaaaaaagcatcacttttagtgctgggattttgtgtgcatgcgcgtgtgtgtggaatagaagaatgcaggattttctggatgtgcttcaaaacacttcctcttatcaatgtaccatagttctaggtactattcttttcattagctttgttgtactcattcttgatcaggttttgccagagaatcaagaccagaactacatttacggcatgcttgctttcccattactagaacttggaaggatggatgacgctgaaaaagctgctcggaaaggcttggccataaacaagaacgactgctggtcacagcataatgtatgcgggtggtt

SEQ ID NO: 21085 - DNA, 613 bp, Oryza sativa
ctttcataaatatgtaaagctatatgtatacatataattatatttaataatgaatcaaatgataagaaaagaattaataattactttttttaataagatgaacagtcaaacatatttaaaaaaattaaatatttagaaacggatggagtattaatcaagtcagggccatcgaggaatgagatcacgcgcgccggaggtgatcggtgaacaggaggtagcttgccggcggcgggcgtctcgccgtcgccggagcttgctctgatcagtgccacccacctaatcccggacttgtgaattccggcccatccacagggcatggcctgggaagcctcaagccgctccgtgacggcccaccaggctctcgttgatagtcttcggtgcttcaccggcacggccagagcacgatcggacccgggctgaaatcagtcgggttggcacgacccgacctacacggtgggccgggccatgcccacctacttgctgcaccatcagcccaagcacgatccaataagactcgggtcgtgccggaccgacccgaagacacgaaaacccaccgtgctcctccttaaataaagtatatcttgcctccctaatctcgttgggtcatctctta

SEQ ID NO: 21086 - DNA, 650 bp, Oryza sativa
atgaaacgtggataatggcgttcgatggtgcactcaacagccaaggagcaggggcaggattcatcttgacatctccttccggagatcaattcaagcacgcaatccacctcaacttcagggcaaccaacaacacagccaagtacgaaggactactcgccgggataaagctgcagccgcacttggagtcaacgactgatcgtgaaaggggactccgaactagtcgcaaaccaggtgcacaaagattataaatgctctaaccctgagttatccaagtatctcgcagaagtcaggaagctggagaaaaggttcgatgggatcgaagtccgacacgtataccgcaaggacaacatcgagccaaacgatctatcacggcgcgcgtccagacgagaaccgctcgaacccggcacttttctggacgtcctgacaaaaccatcagtaaaagaggtcagcggcgacgttaacctagacgcccccgacatcagctcggaggccacagaggcagaacgcgtcgttgccgatattgaaaccacagacgattggcgcaccccactgatcaaattcatcaacagcgatgagttgcccgaggatgacgcataggctgagaaaataacccgtaaaacaaaaatctattgcataatcggcaacgatct

SEQ ID NO: 21087 - DNA, 644 bp, Oryza sativa
cctgcagccctgttcaatcattctctctgtgagaatagaactactgcagagatccaataagagcgggtgagcaatcgatgcttatttagtcgctcgctttcactctctttccattcattcctactccagctcgtcaatttctccagcatggatgcagtgtagccaacaaaaacgatctattgtacctgctgtatcactctatccaccatccctccccctctccgtagccagttctgcatctcgccttgcagctactcaaggttatatgaggtatcaaaacgagccgaggggaaaatagaagaaaggccaaaccagttgtttttaaaacagagcacagatggcatgtaggagtagctaccaagaagcacaggagaatggagtctacttatccttcagttttgctatgtcaacttatgtgtcaatgagaatcggaggcatcgagaacaagaaatccagagggaccaatcacatatgtaagggagcatctatttagtatctttttcttctagaattccacatttcgcagctggatcagtaaataaattaatgtttatgatattagttcctttctttgaaaaaaaactgtgtttgttcttaacaagctgaattctatgttcaatggcttcttttgttgacatctcacc

SEQ ID NO: 21088 - DNA, 589 bp, Oryza sativa
ttcttctcccctctctcccttcccctcatgttgctcagccacgacagcgatgccaaccttcatcgccaccccacatctccaacctctcatcgacccaaaaactttgttaccatgatccataccatctaaatacataaagccaattatggtcacattttccatcttcttcccaattcttttttcttcttctcccctctctcccttccctcatgttggtctgccacggcaacggtgccaacctccatcgccacccccacatctccaacctctctctctctcctgtggagcagatgacgatagtgcttgccaactcaggcgatactaggtgcctcatgcacatagctctgtccgccaattttgatggtagccccaaggaaacggtcttgagtcgccaaatctccggcgccgggcttgggtctctcatcctcccaccggcagtcgtgaagacgacgacacgatgaggacgagtggaacttgtgaagacgaggagggtgtcaacctaaatctggcgagaaccgtcttcttcggcaccgggagcaagcggggccattgggaggagcttgggacgggtggcagcttatcggcgagc

SEQ ID NO: 21089 - DNA, 683 bp, Oryza sativa
cctgcagcccagcgcaatgcctgcaccttcagtcttagttgttgttgtcgtcgtcgatggtgcgttgccatcgacagcaatgcctaccggagggaggatgaaatcatgactgacatgctcaatggatggtgcatgctcaatccagaggtagtcaaggtaagggagttggcccaagccaccgggcagccggtccagcacgcgtagtcttctagcacagccgcctcaagctccgaaaggcggtcgccgtggccatccactgcggtagccgatgtccaaagtaacctgcaatcgtaagacggtcaattgaaggtggagggcggagatgctcaaaaacgttctcgattctctcgcaatcctcctcgctgataccaccttgcacggtgccgtttgcgctgatcctgctagtgcatctcagctccagttgtgtgagattctgcttgctgctgagctttgatcttgctgccatttggccaagtgttgccttttccagaacctccaaatgtagtgcactgagatttggcaaagatcctagctcttccaagctacaccaatcatgtgtactgtcatccaaatcggttgggaaccccaacatctcaaccaaattttctagctttccgaaacccctaggaactgaagataccattgtgtgtctgatgtccagagatcttagcttccgcagtcga

SEQ ID NO: 21090 - DNA, 946 bp, Oryza sativa
ccgtgtaatcggaaaattaactttccaacttcacggctgggggctaggatcagtgctttctcaaccaaggcaggtcaaaggtccaagagccttgtcccccgagaagaatcctccgacgacaaggctgggggctagggagagtgtacgactcaaacgactgccaaagtcgtgaactgaggaaacactcttacacactatatccagaggtacgaatactaccaagaaggccaacgccagtccatagacttgaaaaccttctccgctaacggtgccatcgacttcgccaggtggtctatctccgcaggagtcctccgagaacgagtgaacccttcatgaagaaactcgaggtgcatttgcggacaatgatctcgtatgcaagccaacacatgccctccggcatatcggctcgaccgacggcactcctgtttcagagcttcgtcaatccgcttgccgacgccttcacccgttcagccacgagatgtatccagccgccgactcctcaggttctccgcagaccactcgaagttctctgcaaactctggccatggatgtgcagcagctcttcaaatacgagttaaccacacctcacgacctcggagcgtttccacggcctgctccttttttacttccaacatggctctctcgagttccgccacttcaaatttcgtcttccaatattggatacgacgatcttggccagcaagtgcgtcctcgaggtctgtccaacacggaaacgactacgtcagactgcttctctctctcgagaacacgactgattaatcggaggagcgaaaagtgatgagagaccacaaacctaaggaagtcgtcgttgtccctgtcctcgcgggcaaaatttcacccacgttgtccagcaacgcgtgtcccacagacgcaagatccggagggatcgctgacaatttaggctgcccacgctgctggacatcct

SEQ ID NO: 21091 - DNA, 724 bp, Oryza sativa
ctgcagcccggatatggagtactcaagtgctaacattcaaatatttaattgacaatagtggctaaattatcggtagagcaaagtaggcgaacttaagtccacccaaaaagaatattgcaaagaaactgagagatcactcgtgtccagtacagattaagggacctagttgctataagacaaaacatttggggacaaaccgcaaaagcaaccacatgaggggacctcaagtactggtatccacaaagaaaagatgcagaataaattggtatccacaaagattcacggatgtctcgccataaaatatttcgaaaaagcaattttttttaccaaaaagaagaaaatttatcgtatgcaattccatccacccatccactgatccacatgacaagcttcaatcgcacacccgtttccacttttgcaaattgatcgaacaaagaaagagaaacggcttggaaaaaaaaatctcgcgtacctcgaattctccaaatgcacggagcctctcaagaatctgctccataggagagcagaacacctgctgagaaaaacaaaaaaaaaatcaagagattgattagaccatatcataatcatagtcaagaaccagcggcgcgactagaaacctcattcctcaagaaccggccaaatcaatcaataggcacccgcagtaacggcaacaaggcgaatcaaatcaagaaccagaaacgcacggcaacagcacgaatcgatc

SEQ ID NO: 21092 - DNA, 642 bp, Oryza sativa
cctgcagccccgcgtgccgcgtgggccgggagtgcacgctaccggcgcgcgcgagaattaggattctcgaaattactctggttgctgctttgctttgctttattgatcgtggtgcgtggctgcgttgctgcatacctgctgtttctctgaataaacgtatctctagtgtagtagtgtatccggtgcggagctagaatgaaattgaggagtgtgttcttgtttaatttactttatcatggatcttgtttaaactggtacggatgtttaagtttgtattgagtggatgtacaaaatatactagctataggttaaaaaaaacctggtcactcggcaccccttcgtatgctcaagttccgccctgactgtactagtagtagtgtctcagcgttcggttactgacttcgtgtgtgtttcgtgtttccattccgaacagacgatatcttaattttactgtgttcgagtccctgttgtttttgagatcacgccatgttcccattcaagacatggccgacagagacgaggatacaaaatagacttattttcagccatataagagaggaaaaagtacaccgaaggtccctcaacttgtcatcgagttacaaaatcgtccttgaaccacaaaaccagatacaacgtatctct

SEQ ID NO: 21093 - DNA, 792 bp, Oryza sativa
acgatgctcctgaatagtatcaacgtccttagtgatacttgcctctgtaaagcatcccactcgacttgcttgtttgaaatacagagccgacgaaacttcagagtaccaagtgcatcacctatggtctgtttctgcatctcgttaatggacaatccctcgtccttcgctacatgttgggcaaaagaccggacaacatcatgcatggtgcatcctagttgatcatagtacccatcacttgggtccaaaaggttccttaagactaactctttgtagtactgagctgctacagcctctggcaatcctgaacccgtgctatcttgcacgaacccttcagcgatccacattcggacaatggttcttgattcgatcacctcacctcgtgggaaaagtgagcagtacacaaagcattgcttcaaatgagaaggcaactctccatagctcaagcagaccactttgttaatttcatcattcacttcatgtttacaccatgcagaatgtctagaaacctccatccaggcacctcttgttctgctcttactaagtaagaggcccccaatcatcttaatcgcgagcggtaaaccatcacacctgtccacaatttgcatcccaatatcctccaactcatccaattcagcttcatcactcttgttcaaaactatctgttggaatagtaaaaagctatcttacttaaaaatgaagtgtatacctaataacatccattgaatataagctattctcaaatacagtaaacaacaacaaaaaaaaaaacctgcaacattcatttttacctaa

SEQ ID NO: 21094 - DNA, 1534 bp, Oryza sativa
cctgcagccctcccctgtgtttagcttactcggtcagtgagttcgtcaacctaccacaaagctgaatttcttttttaattaacgatagtagaaaagaatataaaagtataacctgaatatttttattttgaaaaaaaatggattggaaaaccatgtgtttatatctagaccgaatatacgcagccacgaaaaacagtgattaaaaaagagaacaaaacaccaccacacgccgagttttttttttccatagttgcgtccagactgttaagaggtcgtggtcggcagcagattgctgtcaagatcttaattaagataagcaagatcggtgtcaaggatcttacgataatagacgactcgctcttgttgagtcctcaggggagaaaaaaactgtcactcttgttcttaattattgttcctctttgatgttgcatggccgaatagattgagctggacagatcatttcagaatacagtcaactcgtaccgttattgcttggaatgtaagaatggtggtaaaacatatgaatagcaaataagcagagttttaatataaatacatttgcataacaaaggatccgtataataaaagaagtacaagaattggatcagagagacgggggttgttttaaccttactccaaaatattaatgcattgagcagtccaaaggaatttcatgagatttttagatctccaatcctttcctcaaataaatggaaagattgaattttacaaaactccttgacaagttctttgttattaaacagaggctctccattttgcacattcatgttcaagcaaaaaaaaaagacattttgcacattgacatgatctttcaaacataatattgaccatcactttgcatcataatatatacagtgataaaattccagtgtattttgcttatccatcttgaacgtttaaaatggatttttatttataccttaagtctaaatgcatatctaaagcatcaaaatatggggttaagtatacatttgtggataaatttgtactaaccacagtacaatatttgtgacgagatagagcctagtgagagtgtgactctgagatgggccggcctacatgcaatctgtgcagataggcccagtagatttcatacggcccatgtttcaaatccagccttttcttcaacctcaccaaaaaactagttatacatttgttgtcaaagatgtaattatagcacaattgtgttgtaactatattataatttagtatcatgtaacttgtaagtaactttcaaaaatcaataggcgacatgttatttccatgaaatggaggtaatggaaccgaattcccttacagcgtgtgcaatgtgattttttcttatctaccttgcatgaattttaaagcaaaatcgaacggtttaaaagtatgtgaaagttacgtacaaattacattatagttacatgtgtgattacacatatttacatttgttaaatttttatgagaaaatttgccgataaatatccagaaaaaaaagagaaaaaaaactgacttggcaagtgaagggctgcag

SEQ ID NO: 21095 - DNA, 685 bp, Oryza sativa
gcaggaacctcttctgcctcacggcatgcttcaacgtgtcctcgagcagggccttgtccccggcgcagccatggtagcttcccccaaacgcggcgatcacgccgtgcaggaggtgaacctcgttgacctcctgattcacgctcagccataccttcttgtcgaagtggctctccaacacggcgtcgttgaagaccatcctggcaagcgtggtcttgcctatcccccagcgccggtgatagcgacggcgatgacatcgcctgacgatcttgcgcgcgtgcgaccatccgccagcttgttgccaatcagcagatcaacgaggttccttgtgtgaagatctatcttgtcgccgacaacatcggatcgaatgatggatggtcccgtcttgcggttgcggctgctttctgacgagcaagaacacatgggtctatcggttagacgaagggccgaggaggagtggattacttgggagacaaatccaagcgggagctcctcttcgcgatctcctccaccctccggttgagctcctggatcttcctcccgatcttgcgcgtagcggcagggctgcggcggcagagggcgctccagcacgccgacggcgccggagcagctctcggcgctgagccggggtcttctccgccctccatggcgcggaagaggtcaaggatgtcgtcggcgtcgtacatgg

SEQ ID NO: 21096 - DNA, 1002 bp, Oryza sativa
catgttcaagtgacaagcatgacttgccttgctctgctgctggaggaacctcggcgactatttcgaagtacaccggagcgtcggaggaaccggaatctagcgacatacaaggcaaacattgcaaacaggctataagactactaaaacagggaacaaaactatttttgatggattctacacatttttcttgatttactgagacttgaatgggcttaaacggagctcggatgaattagttatgaattttagaagattcactgtgtttattactataaaagaaaaaccttaaatcatttattgcgcaataaattccagggctgacgtcagcacggggggggggggggggggaacgcggcgcccacatgcggggcccaccggtcagcggctcgggggggcggttcaccgtggaccgggaccacgcgggtggtccaccgccggtccacgggaccgatggcccagatcgccctcggggccgattagacgggtggtggcgacccggctcggctcaagaccggccaagcggccacggcgacggcgacggcgcgcgcacacgcgttgccggcgacggcaaccggcggcgcaaaggcggcgccgacgggcggtggtgctaaagcgaccactaacgggcggcggccctaaagcggcggctacgagggagagggaggggaatagaagggagagggcgcctcaccgagggtggccggcgcggaggaagacgacggcgaacggcgacggcgagccacgggaggacgacggccaccagcggacgggattcggggtgccctaaggaaggagaagagagagattacagggagggagatgaaccacggcgaccggcatttatggcccaaggcggcggtagaggttgaactcaccggagcgcgaggggatgcgaattccggcgatgaatcccgacggggaaggggcggacaagatggagttcggcctcgtgaacccgacggcgactgcggcgcggcgcggcggcgaccctatcggtggcta

SEQ ID NO: 21097 - DNA, 676 bp, Oryza sativa
aatatatatatatatatatatatatatatatatatatatatatatatatatatatatatatatatatatatatatatatatatagtgaaatcatatagtactttgcaacttaactaaatttatagttggttagggaaatcaatactttgcaaattaacttattatgtcaaaaccttcttaaaagcttacctagactaatagaccatatacaaaagttcttaacaggatcaaaagttgcgcaagcgcgactacgtggctagtgttgttctttagaaatcccaagtaacctttcgagttatttttgcgaggtgaattgacatatcaaattgcacatatcttgaggaaatgctccaatggccctttaatccaggattaaagaaagtactttttaatgcttgagtagaaaccttaattaattgcagtatgaataattcaggttcttcattatcctactccctccgtttcaggttataagacgttcaactgcttcaagtttgaccaagtttgtagaaaacaataataatatttcactcaaccacatttattatgaaatatattctattattgatttaatgaaactaatttggtattataaatattactatatttgtgcataaacttagtcagatttaaagtagtttaactttgaccaaaatcaaaacgtcttataacgtaa

SEQ ID NO: 21098 - DNA, 8254 bp, Oryza sativa
cggtggtcggtctgaccgaggctgttcagccggtctgaccggtcgccggtccgaccgcgggacccactgcggtcagaccggtttcctcaagggaaaaccagatttttgccactttgattttgcaaaggcaatctctctctctcctttttctgtttatgaactaatctgaaacaaaaaccaacaatatgtccatctttgccacaaaaagaacaagtatatttttcacgatgattagacacattggtagcactagtagatttatcaacatgagcaacaacatgagattttgcatgcacaacattggattttgaagaagatgcattcatattagatatgacaccaacagatttaagcacagttttgttagtatcaagtttaaccaaaatcttgccacttctagcaccaacacctaacacaacaggaggatgtctaaaattgtgagcataaggattaaaacctaaaccacggttatgtgtgctaatctctgattgatccaaaatcatgttgaggttctttttaccatcagaaaatcttagcaaagaatttttcaaataagaaaccaaagccaaatcctcctcctcgatttgttcgagttgatcatcggatgtggcattaaaaacagcaagaaaagaagacttagatgaagaagcatcaacatccaaagaggaaactaaagcactcgacttagaatcaacttttcgagaaagaacattcatctcatgtgttttcaattttgtataaagtgaatccaaagtcaaagtagacgtgttaatagattcgtgaatagatgtaactttcatctcccaaatagatatgtcaagaccattcaaaaagtggcgagaaatctcagattgtggataattagcatcataagaagaatcaacagatctacgatcactcaaaattttattaaaccgagaaagatagtcatccaaagcttctccaggtttcatctcaaatttaatatactcctttttgaaaagatcacgacgaagttctttaatattatttgttccttgatgaaaattactcaaagcactccaaatctcctgagcagtttgaagatgagcaacacgatcataatctgaacgagaaataccactcaaaagaatattgcgagctttgcaattttgttcaaaagcagttttttcagcagcagtattaatagcttcaagaatcacataaggatgagaaacttttctccaaatatcataatcttcagccataatataagattacatcctactacaccaatgagaaaaatccgttccatcaaaaacatgaggcttagttgaaaacctagcaggagtagccatggcaaaaactttggatcgataaaaatccaaagaagaaaacaaggctttgaaaccacttgtaggatcgaatcacaagaactaagccaactagagggggggtgaatggttggtatacccaaaaaccgaaaactttaagcgaaaataaaagttaccctcgaaatcgacggatcgcggtcagaccgaagttgtcctgccggtctgacagcctggttgccgtcggtctgaccgcgattatatctccggtccgaccgccgagatcagctgctgctcgctgtgtcgccgccgccggtctgaccgccgtgctcccgccggtctgaccgccgaaacccggtaaacacaaatcgaagaaatcttaaagtaaatgatgactttattgattctctctatgtttacaaagtgcaccaacagcactccttacaaaaattctgactaaactcgaaaccctaactcaaaactcaactcaattgctctccaaagcgatacagggaagcctcacgctccctctctatttatacatgaggtaggcagcctaaagccacgaaccaaacttatactaagagtcctaaacaccttaggaaaccctctagtacaagaaagaaactttacataaccaatcataccaaatttgactccgcatcccatacgcatacaataactccatcgtatgccatatggaatatccatcaatcacgtgcatcaactctagcctaagtatcccgcatgatctctgaccaccacggacgtcgtcttatccccaagccgactcccggtccatcaccacaaatactatcccgagacatcgagtcacctacacatggaacaaacaaagaaaccatattccgagaccaagctatctccaacttgactcattagtagcaaacaacagtattacatacgtatagtatccatctagaagtcataatcataaaataatcacggatgtccaaacaaacaacccgaaaccgaaaccaacacagtgtcggccggtcagagcacgggctggccagtctgaccgcgcgcataccgccagtccgaccagctaccagagcccagtctgaccggtcacatgaaataatgaatcctgcgatcacctatgaatccaatcatctccaaaaccactccgtgaataaattccaaataacaaaaccaataatctccaatgcccaattgttcatcatagaataataatcaaaaacacctttgattttagaatttctcgttttggtttcgccaactcccagaagggggccgaatgcacaactttcggcgaacaccctggtagacagtgcaaaaagggcaaaagacgaattgcatagtgagaataggcgaaaaaagtattgcataatgtgaaatgtgcataatcataaatacgccaaagacttcgaccacaaaaaagtggctaagagtgagtcatatattcaaaatatccaatgggcccttttttcggctacaatagggaggattagcggcagcctgccgaatatacatcattcgccattcccggcaaacacaaaaagaagaagggaaactacaaaaatctaaggaaggggcggagggcctcacacctctgggtgatcctgggcatcgcctccacccccttcggctgccgcgtcctcttcttcgcaccggtctgccgcctctgccttcgccagttgctccaaaaggcgtgccttggcggtggaccggccgtctttctgccatatctgttttagccacgcacaaagcgcgggcgaaatgttctgcgcactgatctcccagtcccccttcgcatagttagggaactcggcgacgtgttcatagccgaactgttgtagatggcccgtagtaaaggccgccgatacgcacgcacagcaatcgccgtacgcagtggcgcagtccgaaaccgaaccaccggtctgctgggtccactcggagaagtcgaaggccgaggcaacttcggcagggacccctcgcatctttgcacccatgtcagtaagggcgaggcgaagcgttcggcacgccattctcgcggattcggtagttttcgccatctcccgcgaaaaccgctgcgactcctccacagctgacctccaggcgaagagcctcaatcttcggctcagtaagattaaaataatctgtcagcacggcggaatgggctttttctttcttcaattcggcctggagacgatcaacctcagctatggcctctctccctttctccagttcagccttgagccgatcgacctcggccctagcttcttttcctttctccaactcggattggagccgcttgttttcggctttcgcctctttcagggtgttggcgagggcctccatctccaagttcttgcggcctatttcgtcatccttggcccgaagatggttcttgaatccgtcaagatgggcccgcacggttcgctctgtcgaacagtgagctgcaagaatctggatgcaaggtaggaacgggtaaagagaacaaatgttaattatgtgacatgtaaaaaataagaagaaaatcaagaagagagaaaaagcatacccgaaccgccaagcttctaatagcagaacacccttcatcgaactcattcaattcggtgaataggctcggggtgctagcaggtaagacaagattgcttactccctcaacaaagagaataagctctgctcgggtctcgaaatcgccaggggcaaaatggggcgccacaagggaatactccgaggcagatgtttcgacggccgcacccttccccttcgctttgactagcggcgaaacaaccggctgacgcagagggctaccgaagaccctcgccgcagctgtcacgatccattccgcagaggctgaagccccggcggcggcactatcgcctgccccaccagcgccgaggaaaagaatggggacggttgaaaggtccaggctgcggctagcgggcgaagtcggagtctcgtcagaagactcgtcatcgttgaagacacgagcgacatcgacaagtcctttctttttggagatctttttgaccggacctcccttcgccgccctgcctgccgaaaacgcaattagcgccttcgccccatccaaatcctttcgacgaaggggggagctgttcgactccaccccggtctcgttgtgacctggacttggagtaggagtgtagccaggggtgtcgacgcggttttcgaccgtctcgtccgcggccttgtcagccacgacctccgtctcctcttcttcctctccttcctcctcgccgtcacgctcttcgacgtcctcctcatcgtcggcgtcggaatcggaggaagcaggaacccttcgcttcctagggacaagcttcacttgcccgcgcgttcgctttcgcgaaggtcctgcatcgtcgtccgccttgtgggggttcgcccggggaggcaattcgccgttgtaaacccggttcgctcggccagctgcttgtcacatcagcagctggctatactcgacgactgacacatcgccgatcatcctacgggcttcggcgtcagcctggtcgagggtcaacactgcaaaaataacgggtgtagccacatcaagcgtcgaacaaatcaaaatagcaaagcgcaggagtgcgtagtgaaagagcactcttaccattcgttccctcggggagaaccaacttcggcaaaccatcaacctctttgccttgatcaactgcgacttgccatgattgagagaggggaaagatgtgaagcatgcagaattcctccaccaagtcgcgacagctaaggcaggagcaaaccttacgcagcagagcgaaccgcgcctccatagcgccgtccacggcgatattgggtttttggttcggcgcaatcgccctgcgctggcaccggagggccttcgctgagttagaaccagcctcgaaggagatggtgtggtaaaaccacctcgccatccaatggcggtcccacttcgacatggcggcattcactggccagagatcggaccgctcggggcgaacattaaagttcacgctcccgaacactgttttcttcgtcccagcaggggtaaccactgtcttcgaattcacgatggcgaaaaatatggcgccaaaaagttcggcgctaggctcaaaaccggaagtccaacacgcctagtcgaagatagcgatccggaccagcgccgacgggctcaactgtgggagctccacctggaaaaggcgaaggatctccggcaacaacgcgttgcacgaaaaccggagccccgcctcaaaaaacacggcgaacaccaccgtccggttgtcgacgggctttggtacaacggctttccccagggcgaaagtctgtccctcgactaacgtcccagagctgaccaacttctcctgctcgccgtcatctatgagagaaatccctaaataggcggtggtgtcatcgtcaatcccgccggggtggggccctttcaccgaaaaggggttaggcttgcggggagccatgacgaaggacatatgcagtggtgaatggtgtgtgcagtggcgaacaaagggagcgagcgggggaaaaaaaaggtctgaagggccaaggggtaccgtgagagcaagaacggaggaagagagcacgagcggtgaaagtgacaagtctggcggtgaaaagagaacggggggagaatatatagcccaccgaagcaacggttcgcctacccaccagtaataaagcgccacgtgtcgcgagggtaggcaaaacggtaaattcccatcgaccgagctgcaaagtaaaaagcccacaaagggaaggcccattactgtttccttttggcccgggaaagataaaaataatataccaccgtccgcaggaggcgaagagtggcaaaacaataccagccacacagacaacaaactttatttgcaggaacaatgtaggtttcggcaggagcatcgatcgaaagggggcgccacacaccataccacatggtttgcacggtctcggccgaagctccaatctcacccttgcccgtgaggagcttgttggcggtatggcatgaggccattcgaccaaaatctgccgaaagctatgcgaagagtggggattcaagcccgagacgtcaaagttagtcggggcgaagtccccccatggcgaagactatggaacaaggacagcgagagccgagggatcgcacgggtactctgccaagccagaggcctcttgggcgaaggatgcagcgcgaagagtatatgccaaagggagatgactttgccaaagcaagctcgcccccgcgagggctgaagaagccttttcggcccatcaagcctaggggctattgggccgacgatcgcccgacggcccatcaggagcccatgaacctcaattacactatgtacccatgtaaatttcccttttcataagggtaaccatgtaaattcccctgtataaccaaaaccctagtagtaagaacctgtaataggggctataaatagtctcatagggccatgtaatgggggatcccgaagaaaaattctctaattaatacactttacttctttcccaaccactgttgagtgaccacgtctttcgacgtatgcggttgtcgtttcgccaacaatcattattttcttacaataatagataaaaatttgacatgtatatccataagtggatatactgcagccaaaagttacagcatgactccaagtctcgtaaccaacgaacaataaaagaaaaacaaagaaataaagttagaagattaagcttcaaaactacatccaattcttgcttcaccgctccaacaaaccgtggtgatccagggagcagcccaaccaccttttagcctttcactagacgccaacccacgcgtttcatggtgtgttaacaataatattataatacacgtgctttggatggttattagtgtcaataatataaaagtttattaaaatttgagacaaatgttgaatacgttggttacattcaaattatagttgattactcctttttttaaattatattggttagttcctttttgaactattaaatgtcatataaaaaggaagtaatagatcaaaataacagtcaacttcagttactactcgataattattagttttaaaattgacaattaaatgaaatactatatgaagaacccatcccattttttatgactgaaattcagaatcaatccctttttcactgaaatttagaatccatcgctattttgacagaaattaagaatccatacttaatatattatgttgtttcctatttattttatattttggagttgtgaaattaataattattttatctatttgtgttgtgttggagattcaatgtagtatgtttcataatttaataattacgaaatttagaattaaattgtggatatattatgaatagcacaaatttaattacatcttaaatatgttgttactaaatattgctgaaagtacatgtaaaaatttttttgaagttcaaatgttaaacaaattctattatatttatagttcacggtttaaaatagtaaaaattaaaattgataagtaccaaactatatgtatttggcttcgagaatgtctattatagcttgttacagtttaataattccaaaattcataattaataaacatgaagccatattcggtttagagtctcatttattagtttcaataattcaaaaattatagaatctactgtacctcagtttgatttcttgcttttatattaaggtaaaaaaattaattagtctatagagttgtgttttatttaatataaattttatggctgtccctaagaacttattttagtttgtgcttgaaatcacgtacgaatcttctgagttactgtgcaaaagaactttctgattagtggatgaacatctaataaacacctgaaatttactgggtcagtttaggtgcagaagaactggattagtggatgaacatccaaacactggatgtttttgtgtcaaatgatatagcataagcggataagccgtacttctgcttggtgta

SEQ ID NO: 21099 - DNA, 2246 bp, Oryza sativa
agaaaaaggaatagcacttgaattgtaggatcttcattcttcaagtcacacatgtctgcaaatcgggatgaatttcgctgcagcggctctcgtctctgacgaagtcccacaccacacgtgtatcggccgcgtgaagtctccagatggccggatcatcgtatgcatggttgacgacctcgatccagatcgtataaactaccagccaatgtacgtgaatccctttccagtactccaaatgcaaatatggccaatccatcaacagcatatggtttctaccagctatgataacggtggaaactaactaagataccatttatcaggtatatgttattacttttatcgtaaaatctatctcgagaggcctctcgatctggtcctatcacgcgacgcatctagggccgtccgatcccacacgctggtgtagtcgtctattccacatgccgatattgccgagaaggccagaacagaccgaatcggaagccacgtgacgcactctgttacgctagagagagagtagtttatccctgtgtttcaagcaaataggaaccacctatacttcaaattaaattttctcttaaactacttatccgatctgtggtccgattgcgccgttgtgttcgtaacaattaaatctttataacaagatctcacatgattatactttgatgaaaaattataaattatttttataatatatctaaattacttttagatttcactaaattacttcttagacatataaaagtaaatttagtaaagtctaaaagtaatttacataaattataaaagtaacttaaaacaaaaagaaaaagtaactttatcacgacatcaaaactaaatccgttatagaggtaaaaacatgagtctatatagaaattaaatttaataagcacaaattacgtcactgactaaaaatgattataaaataaacaactcacaatattatgaataacattatgaatgtatagatttcttttaatgccgtaacaagttactttacttttgttttaagttacttctataatataggtaaattaattttaagctttattaaattacttttatgactaagaagtaatttaataaaatctaaaagtaatttagatgtattataaaagtaatttgtattttttcataaaaatatagtcatgtgagatcttgttataaagatctaattgttatgaacacaatggtgtaatcggatcgtaaatcggatgagtaatctaagaaaaaattctataagaagaaaaaaatacatacacttttgagtatactagtagcaactagatagattgaggtagctggttatgaccatacagagaacggtctcgttgtagacacgtcctacttttatcgtgaaagaagcaacttgtatagtgtaggtagcgtgactggagattggataaaaaacgtagggagacgataagatatacgtacatgacgcacaacagatttgggctttagaattggcctacaataatttatattaaacacatgttggattaaagatatacggttgtataatacgatccttctaattaacagtcagattttttctgattaacgtgagagctcgtagataattattatagatagatagatagatagattagcgatccatccaccttcaactgattcctgcttcgtccaactgcccctactgacgaccacatccatttgacaaaccggatagctcccaaccccctagtgccttcgctcgccaacgccatccacgaaaggcagagaagagccattgcccttgaccgttgcatgaacggatcctggcacaaacacatccgatctaggggcacttaggccctggatctagcgtcgcggtctaaccgctactatcgctggcacctacgtcaatctcttcgttccactcctcaccttgctcaccaaaaggatgttgggttcacccacctcgattgtcgtaacaccgccattgaattcgtcattgtactgtcaaatcactgcctttgagcttgcctccaatccacacggctggatctggacacggaagcccacgatctggtaggcactatccctagagccatcaccaccaccatccacgatgccacgctagaaagcactattgcctcaatggttacacttgttgtcacacagcctgatttgggtgtaggggcacccgaactagtagtcaccaccgctagggccatcaccattggaagcactatccctgccaccgccaccatcttcgttgttgcgctgtgaaatcatgcctc

SEQ ID NO: 21100 - DNA, 1345 bp, Oryza sativa
gcaagattaacattcttgattaaatttaattagaaggataaaaaaaagtatatatatcacttgttttttaggctgtaatttattaataaaatgtatacattaatggttagtatgatttttcgtagctcttatcatagaaaaacacagttaggtataatacagtgcagatatcatgttgttgcacaaatagcagccatagttcccatgaagtttgcagctgtagttgatccttaaattacatgctctgtagagcacgggggaaagaatctaatctaacagtatcgcatagccgaccatggaacacaaaacaatctcatcgatcactaggttgtagctagttgcatgggctacatgataaaatggatcagcgctccttgacagagacgtatcgatcatacatatatagatccacttgtgggtacaactggagcgtagaaaagaatcaaatcgcaatgatgcaatcgcatggtacatattacatgtacgcagcagacattgatgcataattatccttaacgagaccaagatcaggggccggaccatgtttggtacattctttctggtggatctgatccaactgacctacaggatagaccaggacacatgcaaggagctagctgtgcatgtaaattgtggatatttctgaacatgttaaataatatcttgttctgataataataaatatagtgagagatctctcttcctttctttggagctagtgtctttgctgccacaggaatctgcctcgagaaatgggcgtgcttagccaaaaatgagacaaataaccaccggtgctgtacatgtactgacttgtttctttccccatgatatgattttggttagttgccagggttgatctagcgttcagtaggaaggtacgtagttcagattcaggctcaacatgttaattcagtagtacaatttaatcagttcagatgccatgcatgtgccacatggaagagccacatgtaggtagtgtggtctgttacattagatttgctgctttagacacttgcaatctcgatcggtttgtgacccgaataaaaataactagaagagaaagagaatgggaggcgaaaacaaaaatgattcaaaaggagcaggtagacatatgaagggaaaactatatgttatgttgtttgtgaacgtctgcgtttgtattttaaaaaaaactataatgatgtacaaatattagagaagggcattagagtttctgtactacaagtacaaagctcccttctctgttcaacattctccccaatggcttaacagtgaattgttccactaaagcaaattcacagccttgtatcaattcttccaagtcctatatgggagttaatatggt

SEQ ID NO: 21101 - DNA, 2916 bp, Oryza sativa
tcatggaaggccaaagttcctccttcagttcttaggtgctggcggcatggcagctgagttgacgtctcgaatgcagtgcaggagattgagagcacagtgcacagaagaggagcgctgcctccacagaccacgagcgaggattcatgcaaggagaagcggcggtcgtcgcacgcgcgtagaggaggatgggcattgccgccgtagatcggttcgcacaaggaggggcgctggctgttgagcgcgtagggaggtggaggggcggcgccgccgtgcccgtggttacttgagccgcgaggaggagttgaggagagaggcgaaggtggacgtcagtcatcaggcggcggcggtcctgagaacggggagttgagcagaacgagatcagtcgtcttgcctcgcgtgggaggctagtaataaattatcaaaatatccttccaccttattagagtaaaactgaaaaacacattttacaatcaagggttggatttgatttttactacactactagtaccagtgggaggtactgtaaaagccctctaaaaaataggaccgtatatgtaaataccataatagcaaacaataatatatgcataactaacagtttgtgaacacaatgacttttgactttataattaaactagaaaaaatgcacgtgcgttacaacgggtgaaagcaatttgtgcattacaacgggtgaaggcaattttagctttattattgttatacgtttagttaaggtgaaatcagaactcgtttggattttttttaagaaaatcatgagctgcaattagcagtctaatcgtttcaagttagcatgtaagtttttttaagagatattgtagatgattcattatgtatttccaaaagcgaatgaacttcaaaactaactcaaatacggatatgtatttccaaaaacgaacaaacttaaaaaccgacaaatgcacggatgacgtactaaagtaccggcaaaaacatctttaatttttaaaatagtagagattatgcaaaagtacaggagaaaaatatgatacatctttctcgtcgaaacttgtgcacaacaaaacatcacttgcaactacagtgtgctaggcaaaacaaccatttttgttatacagtcccaatgaatacttaaaagactaatatgcccatgctaacactacatcgatatttagtaatgcgaattaaacaatcaaatgctaaaagatacatattttagcaaattaagttcaaatgtctcaaaacccaaaaaaccaaacaatgatatatagtatatcgttgtaatatatttggccccaaatataatttcatattcctaaattctcgtacatgtcatagtaacatggtaaatttcaatttaccaaaacctaggctaaacttttcaaacaacacctgctggttgtggtgattttcccttgatcaagcagagcaatttatgcaagcatgtagaaaacaaacagatcatcggagagggaaacagttgtatttacagcattcagaaaaggaaaggccaccctgacattagaaaacttgaaggagagatgttgatttagattagtttgatcctgtgttttctgcattttgatgaaggcttaacaagtaaaaccaaaactcaatattttcaagaaagtgaaattcatatgaactatatcaaattgaatgcacatcattcccttgtacttttattagcatatatcccctaaatttgaactaagttccattcttctatagttactgtacaatagcacaatagttactgtacaatagcacaatagcagaacttggtggaattcttcaactacttgcatacgcacaaaatgctgcacacgatattttccaactctttccttagtgcacaatgttgggttacgcgtaggctacgatagcataaatcaaaattttctatcgcgtaaaccaggaaccatgcaagtattagatcatagatcgttatcactcgacgcgctgcggaagaagacactgagaagtcgaaggaactctcgcgaagtagcacgtgtcgatgtagaggaagtagttgattgcaccggctcgaccttctcctccccgtgcgttcttctcgccgtactcccacgtcgatcagcactgcaaaccagcggcgcctctactggtatccacacgtacagggacggaacgccacgcacagatgtgctagcacccgcgcgtggctagggttttgctcggggagggaagtgacggctagggtttctcatgtgatgtaataccttcgtcggtcacacccctcacgaatatataggatccatcactcgagcctccaaggcccgtaggactcctattcggatccctatccgaattaagctcatattggatctccatccaatccccttattccggcccattaagcgtgcgaccctgtaggttcatgtacactcggctgtaacccgaaaactccttttctgtccacgtgtcaacaacggcccctagcagaacgtatttacccactgggcatacacaaagatcatatcggctgaacctctagtgtatacttgtatgaacccctttgcctcacgatatcgattaagctcaaggctagatatgtgccatcctctaatagctcaatcattcactcgaacctgttgatagattatataacttgtaattgtctcctcaatcacctttagcatggccatgcacttctataatctacaacaccgaggggcctagagatatctctccataggaggggcaaatcccatcttaattattcatatcccactacatgtttcatagcatacccgaaaactacttttataactacccaattacggagtagcgtttagcagtccttaagtaagctactacacatgttgggaaccatcataatctcaggtctaaggattcaacaccaacactaaataagatcactgatgacacaacacatacggc

SEQ ID NO: 21102 - DNA, 2022 bp, Oryza sativa
  unsure (1)..(2022): unsure at all n locations
cgttactgcacttttgacagtaatattgtggtgaattgttgtaaacctggaattggaacaaaaatatatgggttcaaagtctcagatgctaaccatatacttgttactgcacaaaagtaaaagtgttactgcacagcagatacacgttaccacttgatagttacacattaccgcatgtttatgcaataacactatccaagaactgtagtaaaaaaactttattactgtagtacatatagagcgttactgcatcttaatttggcagtaacatcgtgatgaaattgtagtaaaccaggaataaaaaaatatatgggttaaaacaaacgagtaaaccgaaccaattccccatattcttgtagtgatgttatcaagtaattgcagtaacacactatgttactatgaaacttataatcattactacatcttgtagtaacgacatgatgtgattgcagtaacgcaaaacatgcactagtaacaccttttgatatactattactgctcgtggagagttaagtttttaagaacaaatctttgaagggcaatatctctcatatcatgtactacttttaaaaaccgtttgcaccatgatgttcgaaaaaaagtgcttatcaaaagtagatccatcatgactatattatgactgaattttaattttgttactgcaagtaaaacacggtgttactgcacgataaacaagacgttactacgttgttccgatacgagagctaagaagagagggggtggtgggggaagtcattggcgggtttgaccgagatttgaccgatgtgggggaccttggactagcctttgactgaggtaggaggtgggttttgagcccttagaaggaaatgaggtgggttggagggaggggggtgtagaatagctattttataccccgggtgtagaatagtttatatatatgtatatatatatatatatatatatatatatgagcattgcagtttgcagctatttgtacctaaatccctataacgagaaagcatatgaattaaatagcaatctaggaaagtttcttgcaaattggatcttgaaacaacctaggcatatgagggggctggataaggatccatgtctaacatatatcagtagtgccgtactgccaccaccagatccaatcagatgaacatgggagagaatcaccactaaaaaatttcaggagcaaaaattggaacactctgttatgcacttatgcgctgtagcaaagcaagatttaaatccatggaggagggcaccacaagatcaacagataatagggatagagacttactgatgctgtggaggagggcgtacatgcattggcattgggcacaccggcatagtgcgataccaatttttggtgcggaagggatcgacagagctagggggctcagttgcaggtgacgaagaagtgtcacacagggtcaacatcgtcaacctcgtcttccaacctcctccgctctaccacagccaccaccgatcaccagcacctccacctgtggagattatgggtactctatacccacacggcatggttatccgactggttataggggataacttatatctatgaaatatgtaacggatcatgactggggtattacattttcttatatattatggaacagcctaaagttttgatttgataatattgtaaagtagatttaggaaactgatactatattggttaaggtttctatcttgtaatcctgccccccgtcctatataaggtgggcaggagaccctctatggggcataattcacaaccagatcgtcggatctataatacacccggcggattcaaatccccaaataggagtagggtattacctctcatcgagagggcctgaacctgtctaaatccttgtctccgcatccatccacatttaggtctcgtgcgctacccccttttattattgacgaattcttgttttgacagttggcgcgccaggtaggggatggaataaaatacaggagtcgccaannnnnnnnnnnnnnnnnnnnnnnnnnnnnnnnnnnnnnnnn

SEQ ID NO: 21103 - DNA, 555 bp, Oryza sativa
ggccacgtcggcgcggccggcgggaggcggcgcgcccgcgctcctatggtcaccggcggcggccatgggcacatcggagcggcggccgagagaggggtgggaaagggggaaacgaggcggcggtccacggctcaccctaggtcgacggcgacgacgaaaaggcagccggagcggaggaaggcggcggcgcggctcgggtcgacggggacggcggcgctccggcggtcgacgagcgaaacggaggggtggacgaggtcggcgaggatgcggcgaagccgaaggaggcggcgccgaggtgggaggtggtctggggcgacgacggcggcggacgggagctcggcggcgacggcggagagagagcgatggcgcgagctcgattccggcgaggaggaagggcggtgagaggcggaaacggacggaggaggtgcggggagggtttaaatagggttggaagggggagagagcggctggcggggaaggaataggcgcgggaggtccggccgccatcaatggcgccggcgagatttgtgggggcaaatccgctcgtttgaacgc

SEQ ID NO: 21104 - DNA, 694 bp, Oryza sativa
acaacgatgaacgggcgcggcggagacggccgggaacgatggagacgaaaggcgaggggacgacttcggcggcgatccttggacgaaggcgagacgcggccggcgcaacgcttggcgacgcagaggcgaggacgaagacgatgacggggctgcggcacttgacgtagcgaggacgacgaacgagaacggcttgacggagggacgaacgccacgacgaccgggaacgacgggaggacgacgatgacgacgaccggggccggcgaggaggcgacgtgggcagccggcagtggctacacggcgacgaggatggcgtggaacacgccgctgtgaatccgaagacggaggcggcgccgcgagacgatgagccggcgaggacgaacgaccgaccggaggagtcgtcgacgaggacgaacggagacgacaatgacggacagcggaggggttcggatggagggaaggcgatgccgaggacgacgtcgctggctcgccgctgcgatgccggaggtggtggtggcacggccaacggcgcacgggcacggcggaaggggttgccgaaggaactccagcgagaccgagggagaggcgccgcgggcgacggttttccggcaaaaccgatggcaggccggggtggagggcgatgccccgactccgagggaggatggcgatgacgacagccgctgcaccggcgaggcgg

SEQ ID NO: 21105 - DNA, 1831 bp, Oryza sativa
aatccacccctcttacaggaatctcgtccccgagattcgaggaggctagcaagaagataggttgggcagtcttctcttcttgtctgacttcttccgtcgcgtcttctataacaaacttgcctagcaaaacttctccactctggactgcttggctcgatctcctcttgcagatggaatcttctcttcacctgacttgtccctggttgaacctttagctgacttcgactgggatgtggcacttgaagatggggctttagttccagaacttcttataattcatatctttggcatcaacctcatacaagttacccacttcacgttatgcgtcgacatcagcttgtcattactaggataccatgcttgtcatcatgagaatatcatgtttgtcatttacttctaacttgccaccaactgcctcatattagctttcctggtctccgggtgctagctacttctgctattcgatgcaagggtcgataatttcgcctttgaattatgtttctcaacagaaccaacttatcccactattatcttcatgttgtcattatttagcatccaacgtattcctttacaccttcgaccttgaagggttcattcccattggatcatcttccaagacatggcattgcctggtaaccggtgcatgcacttttcactccgtgtagcattctgataccgagttaaagatttcattccttgccttcaaacaaacacttttacctaggtcatcttgcttactcatgaaatttttttttctacctcaatgacaaggtgactattgcagggtgatcaggggtcttcctcgagtgatgcaaagcatgcttctgattatcctttatcaatcacctttcggcctacttctttccggctagagaactgaggtcctttggcctgctgcctttcagtgaaaccttgaagtggttcgtcaaaaagctgcactgactaccttcagggaaatacatcgcttgctatctgtatctatgccactagggtttaattgccgatgatcatctttagtgcttcctcgagatggggagcatccaaattgttcttctgccatatcacctttgaaccttttctgatacctgatagactaattaccaaccatcgactactatgttctcaaatattgatgtctcctagatcttcttaactgtttgcaggtatatccgaacttatcaatgtagaggcatgggaggtacccttatgggtttcatccaacaatccttatcttgatccgtaaaaggcgtatccaaactcttatccccaactactgtctcattggctttttaatccaacacagtttaattggttttcttttccatcaacaggttggttattaactcgaggttagaatatagttcctctgacacgagaccctaggtctcctttattagtaagcaattatacacataatcccatatccgcatcttccaaaagaatcctcatagaacatgtctatattacaaatttctcccttattaatgaatactaagcactgcctaaaaggaaaggtgcttagcatcggtacattgtttctgctatgggttatgattaacacgaggcctcacaggtatggcgtttgctccagtgaccacaatacgattaggatgtctgcttcgtgtaaattggcggtaatgtggaggccgactttgccttggttgtagacagtccctcaagtcatgccctggttctttgcagttgtaacaaatcaacgtcttctttattgagctgtccgtctggggacgatcattctgacttggagttggaattggtggttggaaatccttgctaacattggcatcagtggtaccatagtcgctatcacaat

SEQ ID NO: 21106 - DNA, 14875 bp, Oryza sativa
  unsure (1)..(14875): unsure at all n locations
ttcacattaaacaacgacggttctgtccactatccattatgatcccaaggatagcttcccgccattgagtcggtatggttttctgagggcgtccacattcccgcctctcaggaagtggctccatcagcataaaaatcatcatgcaatatcccatcccacacaagttaaagaatttagagtctagccaagtgtaatacatgtcccggtgctcaataacaacgagcacggctattcgaatagatttggtttactcacactacaatggatgtacactttacccgcactccgcgactgcccaacacatgcgcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaaatctcacacacatattaaattatggttcaagttaagttctctctcacacacactcatggcagtcctaccaatgacaacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagtagtacggttgtacgggggtcgtttcatgcttaacttcatggctcagtccttaattgactggggacgatactagccttttccagataccacccaaatcctccgtccgccccagtcttaaacagttgttttgattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttgcaaatatttaagggtaaacaataaccaaggcatggcataatcacaagtaggatgttcatcattgcatgcaatttttatttgtaaacaaaacaatttcgcaattaggatcaacatgttcaaggaatagtgatgacttgccttgctcaggatagtccttattcttgatataattcttgatcaatcttcacctcctggaagttgctgacattgcctcacgactaaccgatacacaaagtctataatacgcgagaaaaaccaatattcaagcaacaatcaaatatgcacaaacaaaatatatttgttgaggttaaacctaaggttgctcatattattcgcgcttgctaatgggttccaacatgctaagggctaaagtttcttaatctttctgttatcatggtggtctgttatcatggtggtctatttaggagctagccaatgtagtatgaatgagatacgtatctggctactatgtggtttagtctagcaaatggctattcatgcatctatctaaatagaacggttatacactagaggttttgttgccggatagatttggatcggtcaaataattactgtgaatcatttgtattattattttattgatggaggctttattttaattatgtacatattttacttgtcaaaataaattataaaggttaacaattacccttgctttgtatgttagaattgtttaggttaatcatattatggttacagattatcccatcacataattttacaatgaataatcctaatttacagttgaactataattataattatatgaggtcaagatttataactagtatttatctaatatacatgtttgtcatacactccctcttaatttcatatatgcaatacgcaaattaatactataccgtaccactataatgggatgtatagtatatgtgtaagcaacaatatcttattattggatcatatatttgagtagtttctttttactgtaagctatacaatacatgttgattttaagatggctctatttggttaactaatggatatcaaccgactatatatatatattctacttcacatgacattgtatcaactaatttttttaagtggtccaaatacaactagctctgtgattactctcctaaacaagttaaagactcatctatgtgtgtttatattttagttacaaaatatgaggataaagtaatatgaggctaaactttatgtaaataatttataagtcatggaattagttatatttggacataggctagtaaatggcactaatattttcctttacacccattaatttgaaggattgattataactaatttatttggttgctacagtgacaagacatattaaagataattatgctactgtacaatatccatttttttttatttattggcacactatttaggttaactattatctaatcatttgatattgattaatttataattataaatatattttattgaatagtgaattatatatcattggaaagcttatgaatttagatgaatttaggttcaagtttcactcaaatccgagttaaaatgaataagttatgctagtgtaaagattcaactttgaattaatccgagaaattgcgaaaagctactgttcataatagatttatttttaatccaagacatatccattgacaagtgggaccccgggtttattcctttttcctactgaattattttctaaagggaaataggaagagctaatgacaagtggggcccacatgtcataaactcgagaccataaaacttctataattagatttttaaccacccggacccacatgtaatagactcaactaataatgattaagaaggggattactattcactaaacacgtggggcccactctaatttctcctctcctttctctctctcttttcttttcttctcctttctctctcttttcttttcttctcctttctctctcttttcttttccggtttctctcctccttccctcttctttctctccctcggcttctcccttcctctctctttctcggctccctctctacccggcggcacggcgacaaatagggggggggggcagcggctcaccgacggcggcggtggcgacgacggcggcggcgacgacggcgcacggcgcggcacactgaggcggcggcgcggcggtcacgaatgcggcggcacgacagcacgagggcggcggcgcggcggctcgaaggcggcggcgcggcggtgcgtggagagggggaagagggagaggagggggaacatggagtgaggagaggggagaacggtggctcttataggggagagagggaataaggggaacagggaagagaagggagggggtgacgcgacggcggcgcggcggcgcggggctcggggcgtagcggggctcggcgcgcggtgagggcgacgggcgacgcgatgacgacggcggagcgtcgacacgacggcgacgggacggcgcggcgcggcacggggctcggcgcgcggcgatggcgacagggcggcgcggggctcgagatgacggcgacacgacggacgcgacgcgcgggcgcaggacgacatgacagcggcggcgcgcggcgcgaggcagtgacggcaacgcgacggcaggcggcgcggcgtggggcgcgggcgcggggcggcgtggcagcggcggcgcgcggcgcgaggcagtgacggcaacggcagcgcggggcaaggacggcgatggcgacgtcggcgcggtggcaggtgacagagagagggggaaagaggaggggctgggttaggggacctcgtcgaacacctggcggccgatgaatagtgtcttttcctatttaatccccattttagcctatttttttgtgtaaatttgattttataaatcctagattttgtataaatgaagtttacccaatatttgtgtcattccaaccaatggatttattctagattaatattactcatattttatttatataatttatttgaatttttaattagggttaattcttattattattatatatttttcaaagttttcctatttttcttcttttagggttttggttgatttataaattgagaaaagttgcaaattaaatttgtatttactcccaagcatttaggtgaccgtattaagtgttcaaatgtgaatttgcccaaaatttaatattgtccaatatttaaggtttattaaagattctataattttctaatgagaccgttattaacacaatagcacattacctcaatttatctatatgttagtttattttatatggaggggtttaatatatcaaatttcaatccctaaatgcaattaggaacttggtgcaaaatcgatctacatatcgaattaaatactcccgtaattctattatatatacagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccataaatcatatctattgcttaaatgtagttcttttctttactttcttggtgatcatttacagtttggcaagtaatagcaatcataacaaccagcatgatgcaaaagttttaaaaagttcgaaattttcgtgattttcattgtcttgaattttcaggatgttacagaagttctctggcctcgtgcagttgactcctggtggcttcgaaggttccaagataaggaactagtttctctagggttgcggttttcgcctcgttcctaagatgaatcctttgcggagcagtttaatcagcgctcgagccagacggtaaacaagatggctgaggtcaggcgttaaggaacttacatttacaatgcgagtcgcttgatttagtgcctttttcagtaggcatacctcttcatcttctttttgccggtttattacaattccttgaggttgcaagttgtcatcccaccacttgaccagaatgggagggcacgaaccttcggctgcttgtatgcggggaatttcttcttcatcactgatcattggccctaatgtatccactaacaaaggttagacaattggtcagagttatttgggtcgacatggtttcagacaatgagtggactcggatgcttttaaaggagatccagatctccggtcattgctggcgtcttgtccacgagggttgtctgcatgggttttgacttctggaatctcttcgcttgcccctgtgtccgactggtttccggtcaggggttgatcaccgggttctacattatcggttgccggctgattgtcacttggatgatcctcagcagttggtccggtttctttggaagaacttgcgtccacgttagtcgggttagagtctttcccggacggatctatatcagatggtttcctgcaaatttgattatcagtattattgccgcaatggatgcgcatcaatgcaagagagattgttatatgagttatacctagaagacttcctgatctttggcgcagggcgactggatgctttcttccttggagtagcctgttttggtagtttcttggttgtctctcggtctccaggcctcctggtggtatcatcggcttcgtcgtcacttagaaccagcttgctctttcgagaatctgactggccgactggatcagaagcacttggctgagtttcagaccgaattcttggtcctccactcccttgcccagtttggtggcggggagatcggcgttgagcgattgggagatccgacttcatcaaagcaaattcctgagtgtaatatccttcattgttaactgattcaacaagaagacaagatcatattttgagaaaggttgaagtgtatgaatacgtaccggtggaggaggattgaatgcattgaacggtacgactggcagcaagtgtgagtagctgacaacaatggcgtttgaaatgatcttatacatcatttccttcatgaccttgaagtcaagagaatctgggtcttcacggtttgggtcatgcttgccgtcaaattcgaaggctgtgcgagatctttctttgattggagctaatcgacttttgatgaagtgccgagtgatctgttctccttgcaaaccttgttacttcagttttagcatgcgttccatcaattccactgcctgagcagcttcatctcccataggcaatgagttccatgtgtcctggtaaactggaggaagacagcagtactcggggagtgcgcgctcaggattctgaacatagaaccagtttgcatgccagcctttgtttgaggttttgaaaggcatggagaaatatttttggctcaaggttcctctgagttggaaaccagctcccccaacaacgcacggtgtgcttttgtttggctggggcttgaggaagaagatgcggcggaacaaggcgaaatgaggcctaatgcccagaaaagcttcgtaggcatggataaatttggcaatatgcactatggagtttggattcaagtgatgcaagctaatcccgtagaagttcagaatcccccggaagaatcttgaggttagaagagaaaatccgccatagaagaaatgagcaaataccacgatttcgtgtgtgtcgggggtcgggaatgcttcgccgaacgccggtcgccacccgataatctccttcgctgggagaacgccgtgcgccaccatctccttcagattatcttctgtcacatcggagggcgcccactgactctcgaagctttctctttcttccgccatgaatgtgaactggatgttttaatttggtccgagatatggctggagaggaatggggaatcggagtggtggacgtggggagaaatttcgtgaagtttttgagggtgggttggagcagattgatgaaccctagcttcgtcggcgcggttctgtactgtagcacggagtggggaatggcgagagtctcagcggggaagacgaaacaatgtttggacttcggtgtttttagggtattgggagtactaatgggcctgggcctgtacagtatttcagcccaattatgtttttagcgtggcccgttgtgatccctagggacttaggcgctttttgctttggcaatatgtgctcacaatgatgtggcccgatgctgttaaaatgcttttttacgcgattcaataattctttggaatgattatgatgcacatgaaaaggtgcccgacagaaaggtgttataccatttttgtaagcttttttaggctacaaaagttgttgggttaatttgagatgactagtttattagtagtcattctcctagcatgttatatgcttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatattttttgtccttgatatattcaagtaagaaggagtcggctgggtattttattgagtaccatgcatgcttcgatataaaatcactcgtttcttgactatatgtttagtttttcaactaatcacatagtcgggggtacacctaattaggtgcatctactcgatgcaccatgttttattttcgcccttcacagtcttttagcactcggcaagccgaagcaagttgaattgaagcactcggattattgttttttgtttcgagaagactattttggtcaactgcgaaggtctcgggggctactgtggagattatggttaccccatatctacatggcggttatatttcagctggatatacggtactaaatatagatagaatatctttatgaggactcgggttagattctaaacttgtatgtcaagaaaatacccgggatcctagtcggttacgattgtattttatctgtaatcccatattccgttaggatatggactgtactttgtaatacggatcccttcccctatataaggaggggtccgggttcctctcgggacgattcttttttctcccaatcatacaatcaataatacactcggcggaatcatccccggacaggagtagggtattacttcttgaataagaaggcctgaacctgtataaaattccttgtctccaaacccatccactttcctagcttgatagccaccccctttattattgtcgaaatcttgtttcgacagttggtgcgccaggtaggggtagcgtcaagttctcaccgactaagtgcgatgggtttcgtttctggcatcgacgacttcgcgttccctcccgggcaggcgttccggttcggcagtttcaacttcatcaccaacgaccttagcaagatctctctcctcgactcggaccatgtccccgtgccattcggtattccgaactcggccgaggcctactccaagatcatctatcccgagtcggcttcaaaccactcggacaagatccaatctactcttccgcgaccagatgaagacgacgggtcctatccctcaatcctgatgaaacttcctgatgatttggccgctgtcttcactaccaggacatctcccactcgaagatctaggcgagctccggcttcggccccgatccaatctagatccagagaggttggcgttatactccaacctcttgggacagtctcgacggaagagttggatggttaccttagctcccccggcatcagttcttgactaatcgagatcctcgactacgacgatttcggctaccactactacctcagcgacctcgacaacttcgacgacagctatgaggataactacacgcccctcttcttcggcgtattcatggctgacaacgaaacggaggaacagcgccaagcccgagaagcggaccaagatcgcgtacggcaagaagctgaacgtcgccgactggaggaagagcgacagcgacaggagtgagaatgactacagcgtgagcaacaagatcgcgaacggattgcaaaggaggctgaagatcgacggcaacgcgccttggaatctgggcgccgagggagagagctcattgggcaacaagacgtcgatggaacagcggtcttcgcaaaccccagcagaacgcggttgcagcaatcactctcctcgacaccccccctcaaggaagacgcactcaaccaagccaatcacgttgtcaacatacgaagaccatgatcgttgcctcggttctagccaactccgcaagcacccgcaccccgaccggtagccgagtccctcacctccgatctcatgattatcatcagccaagcctcagcatcatcggcataggatctaatcgcaggagcaggggtcacgacgaacgatctgttcactcgcctcccgaacgtcacagggagcgccgagtcgaacggcctcgctctccacctcaccagcgtctcatcgaccttcgcgacacgatcaaccagcgccgtgcagcacgaggtcaccgccattcaccaaatcgctacgacgacgacgttgatggagtagctgccttcactaatgacctgtcgagtggattggccagccggctctaagccgactggaatcaagaagtatgacggcaccactaatccggagtcttggctcaccgtctacggactcgcaatccacgcagcaggaggagacagcaaggccatggcaaactatctacctgtggccctagcggactccgcccgatcctagctccacggactaccccgtggcatgatcggatcatggtccacccggggcggtaccccctggtactagacctagtggttcacaatgtcaagctccgacggactctcatcgatgatggcagcgcactcaacatccttttcgctaagaccctggacgatatgcagattcctcgcacggaattaaaaccgagtaatgcacccttccacggtgttatcccaggattgtcagctacaccactcggccagatcactcttccagttaccttcggcactcgggagaattttcgcacagaaaatgtttgtttcgaagttgctgatttcgagacagcatatcatgctatacttggacgaccggctttagctaaatttatggccgtcccacactacacctacatgatgatgaagatgcctggtcctcgaggagtcatatcactacggagcgacatcaagcaagccgtcacatgcgacaaagaaagttgcgagatggcccaaacccacgagactactcgcccgcgaagagatccgactggctgcgaccacggcaagcgagggagaagtgcctgcaaccaagctgacgaagactgaagaaaatgatgccaagacgaaaaagatttccttagatccctctaatcctgataaagactgctgtaataggcgctgtgttagattgtaaataggaaagcatgctcatcacctttcttcagaataataaagatatttttgcgtggaaaccatccaatatgcctggtatccccagagaggtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcctgactggctggctaagtcagtctggttcagaaaaagacggggcaatggcgcatgtgtgtcgattataccgacctcaacaaatcttgtcccaaagacccttttgggttacctcgcattgaccaggtggttgactcaacggccggctgcgagttactcagcttcttggactgttactcgggatatcatcagatccgactaaaagaatccgactgcttgaagacctcgtttattacgccctttggggcctactgctacatcaccatgccctttggattgaagaacgcaggagcaacctatcaacgcatgattcaaagatgcttttcaactcagatcggtcgcaatgtcgaagcttatgttgatgatgtagtcgtcaagaccaagcagaaggatgacctgattgcggatttggaagaatcctgaaaagtgcatcttcggagtaccgtcagggaagttgctcggatttatggtatctcagagaggcatacaggccaacccggagaaaatcaacgccatcctcaacatgaaaccgccaagctcccaaaaagacgtccaaaagctgactggttgcatggcggcgctcagccgattcgtctcacgactcggcgagcgggggatgcccttcttcaagctgctgaagaagactgacaatttctagtggggacccaaagcacaaaaagccttcgaagacttcaagaaacttctcaccactccaccagttttggcctcgccacatccacaagagccgctactgttatatgtgtcggcgacctcccaggttgtgagcacggtcctgattgtcgagcgtgaagaggaaggccatattcaaaaagtccaacgaccaatttacttcgttagcgaggttttagccgactccaagacaaaatatcctcaggttcaaaagttattatatggtgccttaattaccgtcaggaaattatctcactactttcaaagtcactcggtcacggtggtcacatcgtttccactcagggatatacttcataaccgcgaagcgaacggacggattgcgaagtgggccttagaattgatgtctttggacatatcgttcaagccacgaacttcgatcaagtcacaagctttagctgatttcctcgccgagtggaccgagtgccaagaagacatgccagaggaaaagatggaatattggactatgcattttgatgggtcgaagaggctcacaggcactggagctggggttgtcttgatttccccgactggagaaagattgagctacgtattgtggatacatttttctgcgtcccataacgtggcggaatacgaggcgctactccatggattaaggattgcaatctgtttaggcattcgccggttaatcgtccgtggagactcgcagttggttgttaatcaagtcatgaaagagtggtcatgtccagatgataatatgaccgcttatcgacaagaggtacacaagttggaaaataaattcgatggactcgagctcacccatgtcctccgacataacaatgaggcagccgacagactggccaattttggatcaaaacgggaagcagctccttcagatgtgttcgtcgaacatctttacgaaccgaccgtgcccagaaaagagacagtcgaagccatggatactcgaggcataagcatgatcgaagctgactagagagaaccgtttataaaatttttgagcaaagaagaacttcctcaagacaaaaacgaagccgagcggatttccaggcgcagcagactttacattattcatgagactgagctgtacaaaaaaagtccatcaggaatactgcagcgctgtgtgtctgtggaacaagggagacagttgttgaaggatatacattccgtatttgtggtaatcatgctgctgcacggaccattgtcggcaaagcttaccggcatggttttttctggcctacagctgtgtctgatgcggacaagattgtgcgcacatgcgaaggttgtcaattttttgccagacaaactcatttgccagcccaagagttgcaaaccaacccgttgtcttggccgttcgcggtctggggccttgacatggtcggcctatttaaaagggcagtcggcggttacacacatctctttgtagctatcgataaattctccaagtggattgaggctaaaccggtcatcacgatcacagcagataaagctagagattttttcatcaacattgtgcatcggtttggggtgcctaatcggacatcactaataatggcactcaattcactggcggagcatttaaagacttttgtgaagacttcggcattaaaatttgttatgcctccatggcacaccctaggagtaacggacaagtcgagcgcgctaatggcaagatacttcatgggatcaaagcacgagtttttgaccgactacgtccctacgctggcaagtgggtagatcagctgtcgtccgtactttggtctttacgcacaactcctagtcgggctaccggccagtcgccgttctttttggtttatggcgcagaagcaatgttgccgagtgaagtggaatttgaataactatgatttcggaacttcaacgaggagggctatgaagaaggccgagtagatgacatcaatcgactagaagaagcccgagaagcagctttaattcagtcgactcgatatttgcaagggttgcgccgttatcataatcagaatgttcgatcgcgagcctttttagtcggtgacctggttctgaggaaaattcaaacaacacaggatcggcataaattatctcccttatgggaaggaccgttcataattgctgaagtcactcggccgggttcttatcgactcaagcgcgaagacggtactctcatcaacaattcttggaatattgaacaccttcgttgattttacacttaggcatttcgtttgttctttcctctttgactgctaacttcaagtttttccttgaagttttcagtcagggggctactataataataatggtgtgtgatttatatcaattcaatttgcttacttgatatatcattgccctgtttgatttcttggcttagtcaatgaggactgaaagttttttaacaacttttgtgggttttaggatcaacaaggtttgacaaaaacttttaagaaatcaggaactaagttaagatatcaagcatagcataaattcatcagtattgtacaaattgtgcctccgtcatcattaatcatcaaaattattgttatatcaatcagtatcagttttttcatcatcagacttatcagaccaagtcggccgaaggtcgacatcttggaatctctcaactannnnnnnnnnnnnnnnnnnnnnngctttctgcgcatcactgatgaggtcaagagcagcttcttcgctcgtccgtctgcaaagccatcgatggcatccatatcaacccttggataaagggatttggtcatcgccaacgccagacttgctcccatacttccagcttctttgatgttcttgaaataagtatctggagtgactctcagcttgtcgaagatttcggtagcatcaagtgtacttgaaccggcgttattgaagaacatggcctggatgaggggagtagcggcattagcgactttatccctggctccttcaagattgttgatcttgtcaactaagacatcaaactgtgcttgagacttgatcttgcggtctgcatcaacagattcacattaatgaatcagcatatataagataatggcttttgaggtattgattattggtaccttcaacctcctttatagccgaatccctctgccttgccagctctgccttgtcattttccagagtatggatctgcttctctagttaagatatcttggcagcttgcactacatcaactttggttaatcaagattacagagataacaaattagttgggcagagtttgcgcgaaccttttgatgagccactcagttcgaaattggactcctggagctcagcaatccgatccctcagatcgtgttcattcttcttggcaagttgtggacccccgattttggaaatcggaaatcatctgtgtttatccgtaccaatccctggatcagtagttggtacacacatacatagttgaatcacaacatatcacgaatgaattcaggctaaaagagttaaatacttacattacggccaggtaggccaacaactatcagagaacaacagcggaagaccaaataatataagggtccggttaacatgccacaggcagtcgactggggaacgacacctagaacaagaccgcactccgatcatc

SEQ ID NO: 21107 - DNA, 22405 bp, Oryza sativa
actaggttaagtggtttggatcttgttcgtggtttgcctaaacttaagaaagatcttgatttggtttgtacaccgtgtcgtcatgctaagatggtttctacttcacatgctcctattgtttctgtgatgacggatgcaccgagacagctattacatatggacactgttggtccagctagagtgcaatctgttggaggaaagtggtatgtgttggttattgttgacgatttttctagatattcttggcttttctttatggcaactaaggactaagcttttcaacactttcgtggtttgtttcttcgattggagcttgaatttcctggttctttgaaaagaattcgaagtgataatggtggtgagtttaaaaatgcttcgtttgaacaattttgcaatgaaagaggtcttgaacatgaattttcttctcctcatgttcctcaacaaaaagtgttgttgaaaggaaaaaccgtgttttggttgagatggctagaacgatgttggatgaatataaaactcctagaaaattttgggctgaggcgattaacactgcttgttatatttcaaatcgggttttcttgagatcaaaacttggaaaaacttcttatgaacttcgatttggacatcaacccaaagtttcacatttgcgtgtttttggttgcaagtgctttgtcttgaaatctggaaatttggatgagtttgaggcacgttctaccgatggattgtttcttggttaacccgcacatactcgtggctatcgtgtacttgttttggagaccaacaaagtttcttttgatgaggctagttcaggtactagacccgatattgcaggtacactctcacaggtttagggggaggatggtcatatttttgaagacgagagcgacgacaacgaccacgacgaggtcagctcggccggtcagactgggtgccaggccggtcggactgccggcacacctccggtcagaccgacccatgaggagcggtcagactggccagggtcgtcgggttcgggtactgttgatgctgttcgagatggtcctccagagattacaacttcgaccagtactgatacagaacgtggatcaacttcagaagtcgctgctcctttgcacatttagcgacgacatccgccggaacaaatcattggtaatataggtgagcggactacaaggtctaaggtaacggctcatgatgtttgtgcaaattctgcttttgttgcttcttttgaacccaaagatgtgtcacatgcattaactgatgaatcgtggattaatgccatgcatgaagaacttgaaaattttgagagaaacaaagtttggactttagttgaaccatgtcacaccctaaaaatcccaaatatataaattgttgtctaaattggaattattagaatttattttaaaagcctagaaaagaagatctagttttaattaataaattccaatataaaatggggccagataaaatttcattaaatactttgcttaaaatttcattaaatactttgcttaattctataattgctagatttttctgggatttatttgagctaaggaagtatttttaataaatggaattgcatttcatgaataatttaaattggaaaaggttttaaattttctcttttggctttgggccgaaagtcggcccaaaaccttccctctctctctcctcttcggctcagtcagcccgcgcgcgcgctcggccgctgacaggtgggtcccacctgtcggactcgtcgtcctcctcgcgtcgaaaccctagccgcgccgcgccgccgccgtctccttccaaattcggccacccctttccttttccggtgaaatcaatagaggggaaatgatcttcggaatctcctctaccttttctcttttggaatcgtcggctaaaatcgtttggaaatccgtggattcgagtttgattcgaatcgatctctctcctccgaaccctagactttccttcgcgtcgccggtcgccgtgggccttcgccgccgcctcctaacccctataaattgacccccaagcccgccgctacccgccgccaccctcgccttcgcctctcgtcgccggtagagccctagcgccgtgtagcctagcgccgccatcgccgtcgttcgtccagccgtgcgccgccgccactccggtcgtcatcgtcgctcggggatgtcaccatcgtgatcgccaagccgtcaccaacctcatccgcccctccgtaggtcgccggagcaccgccgtcgtcgtcaggccgaaggtcgccgctgcttcttcctcgacgccatcgccgtccgttgatcttccgccgccgttttggtcaccggtgagttcgccgcgtcgccctctacgtgttggttccctccgttcgcgctgtcatgccatcgttcgccggcgagcatgcatgcccgagccgccgccggtggtggcgtcatcgccgacgtcatcgttgccatctgtcgtaggccgctcgtggaccgatagatctcggccgttcgtttttggatggatcggtctcggccgttcgtttccgtgagccgtcgccgtgcacccggtccatcgcgaaccctagctgctgacgcaataattcccttttccttttcaaaaataattcattattgcgtcataattcaattaaaatccatataagtgttttaatccgatttaatctttaaaaattcataactaattcatcttagctcggatatagttggttgaagtctctaaatttttctaaaattgagatctacatgttaaaaatatccacatgtactgttcatgcttgtttatgtgctgttttggtgattttgctcttttctctttagattccgacgttttcggagagtctgagtttgcaggagaagaatttgaagagtcccaaggctagcaaggcaagtcacacagatcccaaacaaccctttgagcatgttgatcccatttaaagctattgtttctattcaactattgcatttattttcgaatgtcattgggtggaattaacctattatttgttatggcacttttgttcttgattactttattccttgataccttgggatattgtaacttgactagttgagctttatatattggttcaactagatattagatatgattgcttagccatgcttagaaactttagcacactattgggataacttatgactcactattatttaatgatggcttaatgatagttcacgatggtcaatcgtgattggttaattaattaaattgccaactaaaacctgattaaaggtgggttgtgagcacatggttttgttggttgttctcatgacaattaaggatcggttcacgagtttcggttgtgagacattaaccgtgccaaccacaagccagcgtgggcaacggctttaccttttgtataacatggttcattgcggggcaccagactaagaagtggcggaggtaagcccacgggggttgctggggagtccatgccttgtttataagggggtgattatgatccaggaacggtgcgctgtggtggattgtgttgtgtgaggggtactgtcacagctcctttccgaggtaccgtggtggtattgaggcacatggtgacatgttgtggggctgtgtcttgtgggtatagtggtacacctctggccagagtaaaactattcgaatagccgtgcccgcggttataggcgggtctaacaatgtctttcgtgattagtctcacacttctcatcataataaaagatgctataattggtaataatttgattagctcctggtttggaatggttaattcctggtttggagatagaactgtgcagccgggatggttgttcagaatggttgggcctatgcaatagggtatgttgtatagcgttggattaatattgtttaattattacttaactgttttaataaattctgaaatgtttattaaatgttgtttatgcaaatgaaaccctactatgccatcctttgttatcctgtgcacttgcatatttgctgcgtggcttgctgagtatgtcatatactcaccttgcaatcattcttcagaggaggagttctacagtgatgctgatggtgtggaggattaggtgtagccctggtcaagctgcctgtggagtagagtcgtctgcgccgtttatcttatttttccgctgcttagatctttattgattgagaggaactatctacctctgtaatgacattttattcgcttattaattagagtaataattgttctctattattgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcattaagaagaaatttgcagcggaaaataaaatctagcgaagctccggctccactcccacaggcagctcaactggggtataagccaaacgtcttctccttctggatcctttttcttcaactgaggttgattgattattgcaaggatgagcatataacatactcaacaagccacacagcaaatatacaagtgcacaagcataatataggttcatttgcaaaagcagcatttagcaaaacttttaagagaagtaaaaacagtggagtaattaatcagaaattttaatcaacactgaacagcacacccatgctgcacaggcccaaccagctaaacaaattattaccaggtataacatccataattattgtgagaggtgtgggactaatcatgaaaaacattgctcaacccgcccataaccgcgggcacggctattcgaatagttttactctggccagaggtgtaccactgtacccacaagacacagcctcaacatcatgtctaccatgcgtcgcgatagtggaaagtacccgaatagaggctgtgacaataccctctgcacaacacaactcaccacagtgcaccattcctggatcataatcacctcctcaataaccagaggcatggactccccagcgacccccgtgggcttatctccgccacttctcagtctggtgctccgcaatgaaccatgctgtacaaaaggtaaagccgttgcccacgctggcttgtggttggcacgattaatgtttcacaatagtagctcgcgaaccggtccttaattgtcatgagcacaactctcaaaaccatgtgctcacaacccaccattatcaatttttagttggcaagtaattaattaaccaatcacgattaaccatcgtggactatcattaaaccatccttaaataatagtgaataataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcacgacgcactcacgaaccttcgcaacgacggaaacgacaagctaacacgcaaaacgaaaaaaaagaataataaaaaccaaataaacaatacataaaaagtaaacaaacatgtagatcataattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccatgatggcgacctcgccggagattggatggtcggctgcgactttggaggacatgtacacgtagaggacgacgagacgaacccaaaggtactcaccctcgaaccaaacgacgaacgacgacggccggcgacgaggtctagcggcggcgcggcttcggtcgacggcggcgacggggctccggtgaccggcgacagcggggagggagcggccgagcttgcccacacctcggcgcaccttacagcggtgacggcgaccgacggcaacggcggaggcgacggcgcgacacggccgaagttcggccggcggcggcggcgaacttggcggcggcggcggagaggctatggggcacgggagaccacgggagaggggcaaacgaaagaggaagactagggggtcctatttatatccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaacaaaattggaaaaaaggagcaacggggaggcgagattggtgggaggaggcggcggcactgtgcacgggctggagagctcgggctctgtctggaggtagaagaaggagcactgtagcgacagggacgaaaaacagacttctatgcgggctgagaggaagggagagagaaggggaggcaaattagacttttcgtgttgggctggctgaaaacaaagcaaagaaagaaagagaagggggaagctcggctgggccgacttgggctgtacggccgagcacacaaaagagggagatgggctggaaagggcccaagactaggaagaggattattattacttttcgaattaaattaatcaatgaaatgatctttgaattgttaaaaatacttccaatgcccaaataatttcaagaaaaatcctgaaaatacttggactcaaagtacttaacaaaattataattagaccatttaatgattaatttaatatgtgggtaattactgaaatgctctttgtatgattaaaattaggaattgagcttcgaaaaatctgagaaaattccagagagtataattaaccatggagaatttaataaaaattaaatccatccatgctttatatttaggaaattttatttcccacatttaacttcacttgtaaattaaagatcatttaatataaattctaataataatttattaaataatttataaatcctgaaacgaaaatcaggatgtgacaattatcaatttgttattgtgtgcctcggctgattcctggacgagggttcacacatatgtaagcgtttggaattttggatagaaattccgggcgtgacaaaccaccttctggacataatattattggaaccaagtgggttttcaaaaataaacaaaatgatgatggtttgattgtgagaaataaagctagacttgttgctcaaggtttggattttgatgaaacttttgctcctgttgctagaattgaggcaattacacttttgttggcttttgctacttcaaaaggttttaaattgtatcaattggatgtgaaaagtgcttttctaaatggttttatacaggaagaagtttatatcaaataaccaccaggtttggaaaatccagattttcccaaccatgtttttaaattgtctaaagctttgtatggcttgaaacaagctcctagagcatggtatgataggcttaacaactttttgcttgcgaaaggttttacaatgggaaaggttgaaaaaacgctttttgttcttaagcatggtgataatcaactttttgttcagatttatgtggatgatatcatctttggttgttcgactcacgctttggttgtagattttgctgagattatgcgcagggaatttgagatgagcatgatgggtgagttatcgtactttttgggattgcaaattaagcaaacacctcaaggtacttttgtgcatcaaacgaagtatatgaaggatcttttgagacggttcaagatggagaactgcaagccaatttcaacaccaattggttctacagctgtgttggatcctgatgaagatggtgaagctgttgatcaaaaggaatatagaaatatgattggatctttgttgtatctaactgcttctaggtcagacatataatttgctgtgtgtttgtgtgcacgctttcaagcttctcctcgtgtttcacatcgtcaagcggtcaagcgaataatgaggtatttgaatcatacacatgagtttggaatttggtattctacttcatcttctatatgcttaagtggatattctgatactgattttggaggttgtagaattgataggaaaagtactagtggaacatgtcattttcttgttacatcattgattgcatggtcttctaggaaacaatctagtgttgctcagtcaactgctgaatctgaatatgttgctgctgctagttgttgttcacagattcttggcttttatctactttgaaagattatggtcttacttttgagaaagtacctctcttttgtgataatactagtgctatcaatattgctaagaatcctgttcaacactcacgcataaagcacattgatattcgttttcactttttgagggatcatgttgagaagggagatgttgaattgcagtttttggacacaaagttacaaattgctgatattttcactaaacctttggattctaatcgctttgcttttcttcgtggtgaattaggtataattcatccttttggtatggtttgagggggattttgtacctcatggttttatcgagcaataatatgacaatgagaaaaattgagaaaagagagctttgtttatacatatggtattttcttgtacatgctagcaatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttgactgttgattcaagcataattgtaaaatctttggttcatggttatactttaatgcatgattgttatattatagatgggtttatattctttttattgcaacacatgacttgatatgctatatgtatgctaaactcttgaacattaatgaacataattcctatgcttgatgaaatcattgtccaaagggggagaagtaatgtgaaaatttttggatttttggagaagcaagatgaatttttggagagttgttgagaagagcatgtttctggttcaattgggaatttcttactttttaaaaacggggagaagttttcttttggatttttgagcacgatgtgtacatttgtacgaagtgtgctttttaccacttttgtttttatttttccaaacaccaaaacattttttatgggtttgccaatgtgttcatcaaggtggagattgtaaaatcaaaggtgtttttgattattattctatgataaacaattgggcattagagattattggttttgttatttggaatttattcacgaagtggttttggagatgattggattcacaggtgatcgcaggattcattatttcatgtgaccggtcagaccgggctctggtagccggtcggaccggcggtatgcgcgcggtcagaccggccagcccgcggtctgaccggccgacactgtgtcgatttcggtttcgggttgtttgtttggatatccgtgattatttcatgattatgacttctagatggatactagatgtatataatactgttgtttgctactaatgagtcaagttggagatagcttggtttcggaatatggtttctttgtttgttccatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgatggagttattgtgtgcgtatgggatgcggagtcaaatttggaaggagtccaaattttgtacgattggttatgtaaagtttctttcttgtactagagggtttcctaaggtgtttaggactcttagtatgagtttggttcgtggctttaggctgcctacctcatgtataaatagagggggagcgtgaggtttccctgtatcgctttggagagcaattgagttgagttttgagttagggtttcgagtttagttgaaatttttgtaaggagtgctgttggtgcactttgtaaacacagagagaatcaataaagtcatcatttactttaagagttcttcgatttgtgtttaccgggtttcggcggtcagaccggcgggagcacggcggtcagaccggcggcggcgacagcgagcagcagctgatctcggcggtcggaccgaagatataatcgcggtcagaccgatggcaaccaggcggtcagaccggcaggacaacttcggtcagaccgcgatccgtcgatttcgagggtaacttttatttccgctaaaagttttcggtttttgggtataccaaccattcacccccctttggttggcttagttcttgtgattcgattctacagaaatttgtggcattgaaggatttaccgaaggtgcgatgcccatttcggcctgtttatcgtgaaatggtgataaacggccgcagctataaggtttttaaggttgccgaatggcttcgggtgcaccccgggcgaaccttagaagactacgatctttgttcattcaagacgtttggaggatatggctcacttttggcgaaaccatcaaaagactgatcggcaggaggcgatctcccagcatcgttacagtctagtctgtgtttcaccctcttctcctcttagggttgtgtatgatattagtagtgatgacgaacctagttcgcctgattattcctaagagagagagaatgtgatcgcgggggcgaagatgtaatttatctgtaagctgggctgtaacgccattgctattttcttgtcacttgtatcattgtaatgggtttgtatttttcgatacatttttatttaaaatcaataaaggtgcgttttatttccttttcgctatttttgcattgtcacttcgcgtgcttttcgttgggtcggaacgtgtcggctcctttgcatatattagcgaaataggttttgacttttcagctttcggcttccgttttcgatccgttttgttctacgttgtaggaagcactcgtgctttccttttgatcgagtgtaacggtgttcggctagttgttctccgaaacaagctgttgcggtttcaatcgtttggcgagcgatgcttcgcctgattcgtttcgcccccctggcctttttcgctgatcaggcgtttgccttggggtttttccacaaattatcaatcgcacaaacaaataaaaagaaggcagaggacatagagattttatactggttcgggccttcgtggtggataatagccctacatctagttttttgtctttttttcattttcatcttttttttctcttttttttcttaccgaagggcttacataacgatatatacatttttacaagttggcgatatgggtgccatccgttctagacataaaaacgcttgagagaggcagcgttctaggaatggtcgaactcttcgccttccagtgtcgccagtcgaaaggaccccgtcctggacttgtgcttgatgaggtacggtccttcccacttcgattcaagcttgccaacggctatcgggttcgccttcttccttaagacaagatgaccaggcaacagctccgtcggtcgaacttttttgttgtaagttgccgaagtgcctatggcatacttgcgcatgtgctcgagtgcttcgactcttaccccctccaagagttcaagcgacacctcgcgcccctcttcgcccccagagaacgtcacccttggtgagttagtccttagctctgttggggtcattgcctcatcaccataaagaagcgtgaacgggctgaacttggttggtcttgtgggggtcgtccgaagggcccaaagaacagatagaattttctctggccatttgcccttcgctgccccctcaagccttttctttagtgcttttaggatcttaccatttgtatgtatggccgccccatttgactgcgggtgcatgaccgacgcgaacctgatttccaggttaagcccttcgcacatttctctgaacttgtcagagttgaactgcttgccgttgtcagtgataaactcttttggtactccaaaacggcaaacaatgtttttccatacaaacttctgtactgcggccgaagtgatatgagctagcaggctttgcatgtattgctttatctcgtcgaacgctgcttggcattcgggtgtccagttgaattttcccgtgccctggagggttttgaagaagagcaaacctctttcggctgcctttgagaggaatcgactgagtgccgcaattcggcctacgagcttttgtacttaacgtacgctcgacggaggcttcatttgctgaatggcatcgattttctcgggattcgcctcgatgcctctttcagaaacaaggaaacccaacaacttgcctgcgcgaacgccgaaaacacacttcccaggattcagtttcatacccgctgcacgcaagttgttgaaggtctcctgtaggtcggacgcgtggttgaaagccttccggctttttacggcgatgtcgtcgacataagcttccacgtttcgccccaatttcttgtaaaggaccttgtacaccagcctggcgaaggttgctctggcattcctcaggccgaaaggcatcctgaggtgacaaaaggtgccaaatggtgtgatgaaggctgtcttggggatgttggccgtgttcatgtggatctagtgatagccggaatatgcatctaggaagctcatgagttcgcagccaactatcaaatccacgagctagtcgatccgtggcaaggggaaatcgtccttcggacatgctttgtttaaatatgtgaaatcgacacacatgcgccatttgccgtttgacttccgcaccagcactggattctccagccactcaggatggtcaactcaggatggtcaatctcttgaatgaccccagccttgagcaatttttggacttcggcttttgctgcctcttggcgatcagcggacatcttgcgtagcttctgtttccttggcttggcatccggcttgactgctaggtgatgcatgatgagatctgtcgaaacacctcctacttcatcggggcctcaggcgaagatatcaatgttcttcttgagtacctctaggatgttctcagcttcttcttcgcccatgtcgccccccagcgatacgagctttgtggggtcggcatcatcaatctgtatcttgattatcttgtcgtgtggggcgggctttggcgcgtgcttcgcacggtcatgcggttcggcctcaacattgtgcactacttatggccagatcgccttttgaagcagccaaaggctgaagccccttgaccacgatcactcctgtcgggccgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccatgctgaaggctaccatcaactgtgcttggccaagaacttgaactgcttctccgctatcagggcgggcatcttgagcttgagataattgtggtgggaaatggcttcgaacttgttcaaggttgcacggccgaagatggcgttgtagttgtacgggatgtcgacaacgtcgaacaatacttgctcttcgcgtctgttttccgccgtgcggaaggctaccatcaactgtgcttggccaagaacttgaactgcttctccgctgaaacgtcggagcgatgctggtgctggggtaagggcttgggtggctaaccccatcttggcatatgcttcggcgaagatgacatcggccgaagtccctccgtccaccaggattcgccggacctcgaaaccagctatctcggctgagatcaccagaggatcttgatgcgggaacattactccttcggcatctcctggcctaaaagaaatttgctggttcagatactgcggggccccttcgccagccaaagtgatattgtggaccgttcgtagctgcatcttcttttgtcgcttcgacagctggatcggcgggtcggcccttgtaatcacttggattactctgcgctgcgcgtcttggcactgttcggggggtgcttgttcttgagctgcttcacgaggtgcttcgacagctgctccctgctgcggccttggatcttgcccgctgacacgttgccgaatgtttcggcattgctctgtggtgtgtgaagagcgtctgagaaaggcgcagtagaggtcttttcggaccttcttgcggacaggctgctgatggttgcttgcttgctgggcgtcgaactccttgcggagggcttgcacttctttgacagccatcactgccttgcccgcacggtcggttctgaacttcctctagatcatgggggggggcttgaccttgccttggcggttgtccttggatggctggggctggcgaacagcgagaggaggtggttcggcaacttgaacttgtgcttgggcttgggctgcggcgacggaagccttatgatactcatcttgtattgcttgccatcgcttggaatcctcttcgccccttgcgtacccgtcaatgatgcaaagtaggtgctcaagcgtctgtggctccttattggcgatttttcttatgagttcaccctcgagtagaccggtcgaagcggcgtttatgacagatgcctcggttatgtcttgaacttggcaccgggcttgcgagaagcgacgcatgtactcccttatcgactcccccggcctttggcgaatgccgagcagatgttgctgcgtcttcggctcctcataggtgcctcgaaagttaaggacaaagatatcgcgtaattgctcccatgagtaaatgttattggctggtaaattgaaataccaagcacgggcaatgccgtctagagcgagatgtattacctttgccttggtattttcgtcgccatgagccgcttccatcgcggactcataaatggagaggaattcctttgggtctgtttcacctgagtagcgtgggacgggtgggaacttgaactagggtgggattggacgggtcttgattcccccactcagcgatagccccttttcgctccctgccctgttcacggcaccttgctgcgggtatggcgtggcgaagggcgaaatcatggcttgcgcgtgaggttgggccatggcattcggctgcccggctccgattggtgatgcttgctgagctaccatggatgggtcaaaagttggctgtgaccgtgtcatggcgacctggtttggtgcctggtttgctccgaagcctgacgttggtgcttgcggccgaatggttggtgcctaagaagcattgatgaagttgaactacggtccttgactccacggcgaagctcccagacttggctgattcgacggcaaccaactcggtgcatcatgacttgtattcccctccgggtgtgctgaaggggctatacctgaaatgctatggggttggctgagctgctgaaggaaagcttggagctgcgcccgcagagccgaagccccttctgccattgtttgtggtgcttggccaggtggttgaggttgtacttgtgtaacaccctgcctccaaaatccgcattagtccactctacacgttgagcggacccactttcgcatggtatcgtgcttacactttcgtcctcgcttcgtgtaaaagggttaacctggggataccatggttggagcaccaaggcttataagtaggccttcacccacctaaacttccaaggtggtactaaaccaccactacacatccacttctgggccacatgggccaaactcacactactaacaggcttcaaacgggttggggtgttacattcacccccccttaagggctgacgccccggcagctcaccgtttacacggcagaggcctagaaccccctccggtgcagaccatggccttttaccccccttaagggctgacgccccggcagctcaccgtttacatggcagaggcctagaaccccctccggtgcagaccatggcccaaagcacatgcatcacacaacggaggtttatgctctgataccaactgtaacaccctgcctccaaaatccgcattagtccactctacacgttgagcggacccacgttcgcatggtatcccgcttacactttcgtcctcgcttcgtgtaaaagggttaacccggggataccatggttggagcaccaaggcttataagcaggctctcacccacctaaacttccaaggtggtactaaaccaccactacacatccacttctgggccacatgggccaaactcacactactaacaggcttcaaacgggctggggtgttacaacttgggcagcgaccggctgagcttgcagctgcacgtgaggggccggatgcgctgctgcggtcgatggctgcccgacgaagtacattggcgcttgcgcgacttgtggcggaaggggctgggtcggcacttgtggatagacttggggtgggacataacctgccgaatactggaggattggtgctgaagcgaccttggatcgtcttgccgtctcgtatgcttgctgttgttcttgcatttggcgaagcatgtcttggagtcgtgtcatgttctgtcgcatggcttccatgttggcttcggtttgtgtttcggggttagggttgacttgggcttgcacagcggtgagcgcagttggggccgctgccgactacgacggagcggcttggggcaccagcagttggcttgtcaaaaggatctccgccctggtctggagtgcccttgccgccgcagccgccttcgccataccagccatgttcggcacctgcacagaggtggcaggggccgaaggcggtagtgatggtgcaggtgcggaagctgatggcgctcctccatcttcggcaacgggcgccgaagtctctgctccctcttcggtggccatatccgccctgacgtcactttcctttcgccttgtaaccttctccttcacgaccttcttcggtggcattcgctctcaatggtttcgcttggaggtccccacgatcgacgccagctgctgtcgaaacgacaaccgcatacgtcgaaagacgtggtcactcaacagtggttgggaaagaagttgtcacgtcctgataaatttatcccgaaataaaaatcattctctaaaaggaataatagaattaattaaaaatcgaaaagaaattgacaaacactaaaatacgtacaagaaaaattcgaatatggtccagagaatttttgttaaattctccttggtctaaaaggagccctcaaattttacttgaattttcagagcaccggaaataattattaagcaacaaaaacaattaacaaagtttactaaaaagaaaaactaaaaataatccccctcctccctttgggccaagtctggcccaaagtcctccctctctctctctcggcctgcggccaaagtcctcacttcctccctctctttctctccctctcctcctctccctccttctcttgggcctcctctccttcccctcggcccagccccctcctcctccctctctcccccaggtcgcctctccctcctctcctcctgggccggccgcccggcccaaaccgcgccacccagccgcccctcccgcgcacgcgcgttgcacgcgcgctaactgcgcgcccgaccggtgggtcccacccacccggtcgtctccttcctcccgcccggcatcctttctctcttctctctcccgtgaaacctagcgtcgattcctcccctaaatccacgcgaatcaatgcccttccttccaaattgattggggggaattaatccccgttccttccacatcaattccccctaatttcccccttgattcgtgcccccaatcgtcgggaacgcccacgccaaccccggccaccttccaaggccgccggccggcttttccgccgttgttccctcctctcccgtccccggctccctctcctaccctataaaatggaacaccctcgctccgttctatcgttttagccccctcctgcgctctcccgtggcctcaccacctctccccgcagccctcctctctctcccacaccgccggccaactccagccgccactgccgcgccgctcaggtgcgggctggccgtgccgtcgccgccagcggcctcgcagccgcctcctcttccccggcgtcgcctccgtttcgcgggaaattatcggagcgacgtcctcgcagacgaccagtggtgtcgccaccactccaccgcctccagccgcctgtgccgcctcgccggtgcagcggctgtcgtcatcgccatcctccctcaacgtcgccgcgtcgccctccacccaggactgccctcggtttcgccggaacgccgtcgcccgtggcgcctctccctcggtctcgccggagttccttcggcaacccctttcgctgtgccagcgacgcatcacctccggcatcgcagcggcgagccagcgacgtcatcctcagcatcgccttccctccatctgaacccctccactgtccatcgtcgtcgtctccgttcgtcctcgtcgacgactcctccggtcggtcgttcgtcctcaccggctcatcgtctcgcggcgccgcctccgtcttcggattcacagcggcgtgttccatgccgtcctcgtcgccgtgcagccactgccggctgcccacgtcgcctcctcgccggccccggtcctcgtcatcgtcgtcctcccgtcgttcccggtcgtcgtggcgttcgtccctccgtcaagccgttctcgttcgtcgtcctcgctacgtcaagtgccgcagccccgtcatcgtcttcgtcctcgcctctgcgtcgccaagcgttgcgccggccgcgtctcgccttcgtccaaggatcgccgccgaagtcgtcccctcgcctttcgtctccatcgttcccggccgtctccgccgcgcccgttcatcgttgttgttccctcgcctcgtcacgtggtggtaaggatctctctccctcatcgccctcgtcctcatcctttcggtgtcgcccgtgcccgttgtgcggttgtcggccccggtacccatgtattggtgtcggtagtcgttcgcttgtgcgtgtggtgaccgtgttagtgtgcccgctcggtagccgcgtggtttccacgtgtgcagcccgcgtagtgtctagtggagtccgtttgtcggccactcgcctcggttgacacacagggtccgcttccgtcgacccgtggaccgtctctgtgtacccggtcagccgtggtcccttaggttgacaagtggggtccgcatgtcaacggcgcagccttcctgtcttttccaggctagcgcttatacatgttttatagttgtaaaacctaattataataatccgcaaatctccatataacagcattaaacttcggatgaccatgcattggtcatacgagctccgaatcgatccgttcaagtctcctaatgtttgttataacctaaagaaccctgtgctttatttttatgtattgttattgcttctttataggcttgtagctttgcttgtgtgcttcgcgtagcttctgtcgttcctgagtttcccgaagcgtggttcgcggtcgtcgccgaaggttcggaaggccattatctttgagcaaggcaagtcacatcatccttgagcatattgaatcccagtttataaaattattttgatttaaattattgcattatcgctttattcaaattcccgcattatcactattttatttagccatgcctatttatctttgttatgaccttatcattgttgttattgttattattgccttgttcaccctaggataaacaaaactccaactagtgggtaccctattcatggttccactagtatgaatttaggtagatgcttcgctgactaattaggcaacattaggtggttttataactttagactttgggaattctcatatcatttggacactatggtatggttggcttatgttggaattggacacacacctccccctctattcaaaacccccaaaatggttttaggctgggctcgaggtccgtggttgggttttgttagtcgtacctcgggtactataaggattaagctcgggcctctgttggaaagcactaccgtacttccacatgtctagtgggtaaggcttagtttgtggctcagtctggttataaacaaaggtacacggatggagatggacgaagtcgggggtcgatggacatctctaggacaaataaaggctacacgagctgcggcccggtagtcgagatgtcatggcacagggctggtgtcctgctgctaggagctcaatcttgcctgcctgtcccggaggttccggccgtaggcggggctgggtcagtactcttgtttatggctaggatgggttgggaactatgtcacatcttcagtccgtatgccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttggattaaggcaggttcgtgagggtttacggccttgattaataacactgtgtagctctaggatcatctttataaaatggctttgggcaactaagtgacttttaaaagctgtttactgcaaaacttaaccactatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagtgcctgtgaagatagagccgtaggcccgctagtccgctgctgtttatttttgattgtcaggccttaagtgcctttgtaataatttaaatattatcgatataataaagatgtgccttttgtatcatgtttgtgtggtgtaccccagcttttcctgggacggggattaatacactagtgttcgggaaaatgtatttttctcggtcgcgacaagatggtatcaaagccatatcgactgtaggataagccaagtggataaaacctaaggtcatattttataaataaaactatttgcgaaagttctttttttctccttcccctaatgctatttgcaaaaggtttactcttttcttccttcttcaaatttctagtagtactagatggtcagctttgcgaagaagaagatgtcgtcaatttctgccgaagctccggaagattgcgggatccgctagcgaagtggaggaagcagtgaagccagctgtgaaggagtgaagatcttggataacccgtcgcagaacctaagccaccctctagggtagagtcgttagtcgtgtgttcctttgcttgtatgtgtagcgcgtggtttgcatcagtgggttgtgatgtaaccatgctaggttgtttgcttaatcaacttgcagaataagcaaaacaaacaacacatcaacaaaaagagttagttcctttaaggtcttgtccctagttctggtctattctttccttgtttgcttcctctctcaacctctacattgtgacagatggataacactggtaacaaaggctatgtgaatgatggatccgatgactcaagaacccaagccaatgggaatgagaaaagcatcaacgaaacctcaccagagctaatccaaattgtggttaaccaaaccaacatgttggcaacagcatttcaactattac

SEQ ID NO: 21108 - DNA, 9258 bp, Oryza sativa
  unsure (1)..(9258): unsure at all n locations
ttttaattgttggaggctttcacaaagattttacttattcttcgcatgattttgaggatgtattttagaggcgatttgggacgcgacagtttattagagtagaagcctttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattattattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttatacacaaaagtacacggatggagatggacgaagtctggggtcgatagacatctctaggacaaatgaaggctacacaagctgcggcccggtagtcgagatgtcatggcacagggctggtgtcctgctgctaggggctcaatcctgcctgcctgtcccggaggttccggccgtaggcggggttgggtcggtactcttgtctatggctaggatgggttggaaactatgtcacatcttccgtctgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaactactaaaatgtggaatggttggcctgggttggcttgggacgagctgggacccagggtcgggttgccagttcggtctaaatcatcgtaggccttggattaaggcatgttcgtgggggtttacggccttgattaatatcactgtgtagctctaggatcatctttataaaatggctttgggcaactaagtgacttttaaatgctgtttactgcaaaacttaacccctatattattaccccttgcacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccatagtcccgctagtccgctgctgtttatttttgattgtcaggccttaagtgcctttgtaataatgtaaatattatcgatataataaagatgtgtcttttgtatcatgtttgtgtggtgtaccccgacttttcctgggacggggattaatacactagcgttcgggaaaatgcatttttctcagtcgcgacagaagtaaagtgtattaattagagaatttttcttcgggatccccccattacatggccctatgagactatttatagctcctattacaggttcttactactagagttttggttatacaggggaatttacatggttacccttatgaaagggacatttacatgggtacatagggtaattgaggttcacaggcccctgatgggccgtcgggcgatcgtcagctcaatagcccctagacttgatgggcctgaaaggcttcttcggccctcgcgggggcgagcttgctttggcgaagtcgtctcccttcggcatatactcttcgccctgcatccttcgcccaagaggcctctggcttggcagagtacccgtgcgatccctcgcctctcgccgtccttgttccatagtcttcgtcatggggggacttcgccccgactaactttgacgtctcgggcttgaatccccactcttcgtatagctttcagcagattttggtcgaagggcctcatgccataccaccaacaatgatatccatcaaaactatccaaaatgcgagaggcagattaccatagtaactctcggtaagcacttggctgagtgagttgcaagtactgttcatgtacttaatgatacctaaggaattaatttatatacggagaaattaaacatagtgcagcctgttggtctgtggcgttgtgctcattttttcagaccaccaccctttcctcgatcttacttgggctagcgctcttcgctggtccagcgaaaaggagatagcagtcgagagtcgagatcgaaggcctaattatttttagagagcaatggaacgaacattgatgggtatagatcagtcatttaattaggtgttgttagctccagtttagtctcatgagtttaattatgcttgtactccatccgtttcataatgtagcattgtccacatttatgaaagtaatttttataagactaatgatgacaaaactatagaaatcttttatcaaacaatgatttatcataaaactatatatttatagcaccgaagttattatagaactacatatttgtggtgcagtactacagatttaataataaagttaccacaaaatcacatgttgagcatcaatttaatcagaaaacttggatgctaattattcaaacataacattattgctagggatttaaaccctaaattttgtagttttggaataattttattattattattaaatatgtagtcttaagatatttagcctttttactctttttaaaatttggttgccctcatgggtcggtcagtgaaacactgcaggatttaaacgacagctagagctataatttaccttatcagatcaagtaggtcctgtctgattcatggttcgatgcttgaactatcttaagttcttgacacacatgaacgttacaaaagattagtatttggtgtgtagaagggtcaacgccaagccggttaattagtgcaacaaactatgtgtttgcttgcggcacgattgcagagagcacaccatcgtcatggcatgaacacaaacagacccgtaggcttaatcatgtgtgttaggtgaaattaacttgatagatttgcagttcattatctgcaattgacacgataaattacatccttaaacctgctggcaattgtacttagataatggtagcgtatcctcacagatttagcacagctagcaaggcgggaaggaaacaagaaagcattgggatgccatcatctgtaaagtacacagcacagtactgaatcaatggcaatccatccgttgcctcccatgtatgcctattgtctactgtactaaccaagaagacatggaggacaagtccagcgcatgtacgcatggtgcccaagaggacagatggaggatcagatcatggggcaggcacatgcatccacatccctcaaaatcatgcccttgtctccagattcccgggcttggctgttaatgcgtgagttgtctgaagaagctcgcatccctccaaggcaggcggcatatatacagttcaggatcatccatttcttaatgctacttcatcattctgatctccaaaagggcctttctcatcaggacaccgctggtgatccccatccgtgtctcagatttatcatgctagctgattggagtccattgtcgcacgtggcgacgatcgggtttcttggaaagctgggggaacattgttggtgctgggtcactaataatttagtttgataagaaaagagatggagagaaaaattaagccggaaagggaaggtaggacatgcaaacatctaagtagaattattctgtagttcacatgcaataagtgcgcgtcatttttcaaatatcgaattaggtggattggaattagcatcactaattaatgtgaaacaccgtttatagtttaggttgataacaccaattaattactaacatacatctcccgtcagaaaaaaaaaacaaagaaagaaagagggggggggggtcatgttattcagttagagaagtgtgatacctgaaactgaatgtcatgttcagtttcagactttaagaggaggaacagatcatcaaattaacttgaagcttaagctctccaggacgactgcatttactcatggaagtcgacaagatccccagatccacaatggttataaacaatcttgggtggcaattattaatcagtcatgtcattcaactagattgagaaataaaagaaagaaaaaagggggtccgtactgttgtagtatattcctgagtgggggaggggaggtctgtgatgtcaacaagttaggagcgaggagcatgattccagggcaggcaggcatgcacacatgtgaagtgccttggttactttagctgttcctgtctcttggttcgggtgattctttcttcctttctggtgtagtgccttcctttaaatctatttctggatagatacaacacaagatggatgcacacatatttatagcaagtgggggttgctatgtctccctgcttttctagtctgcttgacattttgtggtgggggcatcatccctttcactctcaaatgcttcagatttcagtcaatccacactgtaatccccattgctagtatctctctctcgctctctctccgcctttaaaataggctcttgtggattgttgagaaagttaagtgcccctgttgcaaggttctttgaggcttcgatcccgataagcgttcgaactggtcggcctccacctattgtgagtaaaagccactcaattcctttctcatagtttccattttccttgcatccatctataaagatagctagggtgcaaaattttatatggttggtttgttactgccatggcagaaaaaaattgagcgtatgcatccatcgagagagagagagagagagagagcaatctgttgatctcgcactgtattttgcagctgtgatttggcttcaaagccagccaaaaaaggtctaattctccggccacaagaagatgtcaaggtacctgaagcagtacgagaaggaacacatgaagatggccatgttgaggcaggaggagacattcaagcagcaggtaagataagaacaccactccatactgaaacttccaaactcttgcttccttatccagtaccgaaccttcaagccctcaagcaaataacagcagctttgttcaggttcaggagctgcaccggctgtaccgagtacagaagctactgatggacgccggctctgcaatcacaatgcaaggcatcagttgcatacctgaagacgattatcatgcagaggagaacgaggcanggtcgagcaggccatggcacaccttccctgggagcgacaatgacaagccacaggctcacactagtgttcttgaagagagcgagctggacctgacgctagcgatcgggaggacgacgacgaccaagaaggaggcgccgtcgtctagcgtggactcgaggacgagcaactcgtcgtcgtcgacgagtccggcagcaccaactgcagggcggtgatgccgcaccggccatctcggttggggtcgtcgtcggcggtgaaggttgttgctggtggccccggtgttgggacgacgcagcagcatttggacctggagcagcaggacgcgctgaagcagcctccttggctccaccgttgtctcaatttggcacgataagaggatgtatagcacacaacttcttaatttcttgccgtgtcatccctttactattctcaatcatgcttgctgctcgccctcgcatttctcgatcgtttgtcctcactttacttcacttttttttttacttcttattttttttacttccccaccaccgtcatgattaagaagtcgcgctcagcaggggaaagaaaaaagagtcgtgcacccggagccgacccgcttgatgattccaagccttatcgttttccttatataaaatcagccgctataaaaatttaagtttcagacttacttttgctgttgataactagccggcggctacaagtcgtcggatagttattagcgagtactagttggttggcaagattagttagcttgctgcttgctccaccattataatttgtgagatataaattataaatttataattgaattagggctactacctatctcgggggtctgaatcaacacaaaaattcgttgtctttagattactttaccgcaatctcacgtatagcttagtcccaacgtccaccatactatatagataccgtagtcaggtataaactgttgatagtagcgtgccaagtagggggcttgatgaaaaaagtttcgacgagatgggtacaagagacggattttctaacaatggcctctataatcagcttggccagggcggtccaacccagctgatgttcactcttctgcatgttggatccgtcacattcccagtcttcgctgttacgtcgttgttagtatttcttacgatcacagacaaaatccgcaagcgcacggatataccgatgtagcacttctcctacggagtattccaagggtatcgaatccaagagaacatgtgtggtcagatcttcctccggttcatccaaggacaccaagcaaatgataagccaggatagagaggatttaatagtgagaaacattgttagggaaagcttaattttaatcctaatgcaatatttcaggcactggcaacccgcagttcccagatgtcgctctactacgtacccggacagggaggacttaagtgatctcgagggctgtcaccacctctacacccacctcaaacatactgtgggatacgcagcaattactggataataattacctaaacaccacgtctaagcaattactatctactttagtgtttataactcactaaagcaatcattatattttagttgattatagtgaacaataatcccgtatgctacttcggaactaaccaagagataattctcacaagataaatctaaattactcaagaagaatattatattgaattcacagtaataaacagaataaaagaaataggggaagattactgacaactccggaattcttccgactcctactctactcccttccttcctattttagtatacaatatagtacaatagagcctcttataattcagctcaagcttggaagtatgtgtgagagtgaataaagtgaggtctatttataggacaggtatgacggttgtgagaaggggaaatgtccgaactgccccgcaaccgtctttgggagagcatctggagcgtcgatgccaaaccctaggatcaacggcgatcagaggggttcgcccgaacctaggctgggccctcctggcctggccttcggtctatggactccctgggctcttctctatccatttctcagagttttgggttaattcactgatgttttgatgaagttcacaacccctccttgtatagatatataattctcctcactttagtctaggtttcctcccaacatcagggtatatcatctacatacaaatatacaccaacacttgtggaatatgtgagattaagcacctatcactatgttggatgttttattatccgaactttatgcagatgttggcggtatagaatcgacatttaacagccgccaacagtcgttgatctaccatccgacttccaccgagaacaaggagccgactgcgaagtctattgggtttactcccacatcggtaattgaggatgggggagcactttttaaaaggtggagggagtcctcacccatcagactagttttttgggttgtgtaggcctgagacctaaagttgtggctctggttgagcctgtggtggagcaggcccaatatgaccgggtggcccatggttggtggactgggctgcgcactctaacaagtaatatcagagtccaggtttagaacctggaacaatttccatgggtcacatgatgggggaggccaggtaacaagtcttcagggtcacatgggttaatgtgacataggagattgttgggcccgatgtgtgacgacggtggagattgttgagtttagtctcacatcggtaattgatgatgggagagcacgacttaaaaggtgggggcaatcctcacccatcaaactagtcttttgggttgtgtaggctcaagacctagagttgtggcttcggttgagcctgtggtggagcaaactcaatgtgacctgagtggcccatggttggtgggctaggttgcgcactctaacaaagtccaatcacaagattaggaagaagtggtgccccattaacaaaacgagttctcactctctagatgggtgcagtgttatgctgaaggacaaaactggatgcaacggttgcaaacttgatgatactcaacgcatctcctcatacaaattatgccccatcgacaagacctgagtggcccatggttggtgggctaggttgcgcactctaacaaagtccactcacaagattaggaagaagtggtgccccattaacaaaacgagttctcactctctatatgggtgcagtgttatgctgaaggacaaaactggatgcaacggttgcaaacttgatgatactcaacgcatctcgtcatacaaattatgccccatccacaagacaaaatgcgtactttgacagggtttaaggtattcatcaaagttgtcgaatccatgacctcgtctacgtcggccagttcttctcccaagcattgtctgatccactcccgatgacatcaatccatcaatttgggatcatacgatgatatgtcagatgacttagcttgtttggtcggctatctgggactagacccccatgaaccatctattctccatagtctggatccgctcgagtcctaggtctcaattcataccgtagggtgaacatcgttgagatcgtggacctagcgtcccgtgacgacattgttgacggtcgttatcgattagtttcgaccgtcaatattactaaaatagaggagaactagtggtgcttgcaatgcatatatttgttagaataataatattccattagtattaggtatactaaccttttgcagagaatgacaataaagtggaggagaatcgacatcaactcagacga

SEQ ID NO: 21109 - DNA, 2341 bp, Oryza sativa
tttctcttctcttttgtaagccttgtacttttactagaatactcttctaaatatatttatggtattgaaatactttccgagtatatgagtacctactttacattatgttcatgttatgctgaatatacggctagcttatctgggagatgctttggtgcgggtatagtgtttccttatgcaattactctatgtcatgacgatgatattagagtagtacgtggtagtttagacgtggtgtctagattacgggatatcattatttagggttatatattgcggatgagaggtgggccgctgatggtgacagctcagtacgggtattcctccgtgccggtatataatcctaagttaattccctgggagggtattcctccgtatttagccccggttgtatggtcatgacgggctgtcgtaaggaactcagcagtcaggggtggcttctcgaagtaccaggagggtatcggatagagggtattagctagtatatcggttaactagaatgtatgtatactatgtatattaaaagtataggaattgatttttgaagtataggaatagattttctctcttttctttccacttagcttagatgatatattatgagaatgagtagttaatgcttgtgtgtcactctacccttggattatcttaacccctacttagaatatgattatcacaagtaatatataaattattagtcaagttttctctacatgatcttcccacgggataaaataaatacgatacccttggaatactctcaggtgaaatgctacaatggtatatccgtccgcttgcggatgaactctgtaaccataatataccagaagtatttctgcgccattgttgggaattatatttctagtaatatcgttaagaaataccaacaagcatttctggtgccgttgccggggaagatttataatagtgattacttgaactaatactttatttttacctttgtataatcattttcctttgcaggataaaccttggttgtttttactttttgttctgaaaacaggttagtgcatgactggtttcaatttgccggaaaacttcaaagaaaatccagaaactttctttcggagcgttaggccgcgagtcgttgctccgcagaaaactctaccaatagagaaaccagccataccggcgccaccaaccttcaagactatggctaacaagactctccgcgagttcgctgctttctctgctgacaatttggccatttggcagctggtcaacataggggacgtggatttcgacttgaagtccagcctcatcacgatggcgccggctagctcattttgtggcaagcctaatgaggatgccaatgctcatttgcaatagttcctggagatctgtagcatgtacaccatcaagggtgtcagtcctgacgccgtcaggctaccactgttttcgttctcccttctcgggagagcgaagcaatggttctatgccaaccgtgctgctgtcaacacctgggataaatgctctataacattcctctcgaaattcttcctgatgggcaaaaccaatgcccttcgtggaaggatttcatgtttccagtaggcaagcgatgagtctattcctgaagcatgggaacgtctgtaggaattcgtggccgcttgtccttatcatgggatggacgactggctgatcccggttgacttcgtggtgctggacatggacacggggaaggagacaccgctcatcctgcgacgcccattccttagcaccgcgggagccaacattgacgtgggaacggggagtatccgtttccacatcaacggcaaggaagagaagtttgagtttcaaccgaggatggaacaatgcttcatggtcagattaaagtacggcctgaacccaaaaaatattcaaggtggtcgaagtggagccacccaaaatggacagcctggtgaaattcatgcaaaatttcctagagaaggaaacaacgatgcctaggaaccgttattggaagacgccggtaaaaccacccataccagccaagaagatagagcagccgactcagaagaagccgtcttccacaccaaagccaaggaatgtgtggaaggagaagccaaagacgcccgctccatcacctccggagacgggtggaaaatccacgaactgaactggatggaggtacagtcttgcacgtcggactttaaatgacacgaccttcaccaacaggtaaattggtatgtatccgcatatttgctttcaacaatttgaatttttgtatcatcacatgtttgaatttcaaagttgcatataggatttttgaattttgaggaaattcttcaaatgaatttttcagagcaaaccaaaataaaatttt

SEQ ID NO: 21110 - DNA, 1924 bp, Oryza sativa
ctttttccataaggagtacacacttacatgaaaggcttaagtacacttcttggttttcacgattcctgtaaaatcgatctctagaaaggaatttctgggttcgagaaaaataggttttgggaaaatatttctggtgctccaatttgcaagaaacctagaacgaatgatatccataatcctacacttaggctcatgcacaaatggattgctatgactttgtttcctagaggtgatctaaggcccataggggagatgaattgattatcatgtttgccttggttagaaagatcaaaattgctcctgtgaattgtatgataaggcaattgttagaaagtataaagttctctgctcctgttgagtgcacttctctgattactcggatagcaaaagggctaagggtcgttagcgacgtgttgatgaaaaacacgaggcctaggagatctgcttaactccagtgtaggtccaaactcgccttcgggtatgctagcatgccagttgatttgatcctgcaatcaacaagaaataaaggcaaagaaaccatggttaaatctataaatgatacccgatcagctatgtgccgatgacatatcatttatccttgagccgatgtcatgtgtaaatcgatcggcagtcataaataaataagaaagaactatatccactcgatcggctgtagatattaacaatatatattccttatatcgatatatatttaaataaagtgattgggatagatcggtcgtcatgccgagacagtataaatcatttagatcgaaatatatattaataataggattatatatgttgatagcatagccgatcaaatggatctagcatgtatcggctaatactatgataccactctatactaagatattaagagaagtagaatatatcaaacaaaagtctaatatacttaaatgcaacaagatcataatataaagggtagatttaacatatcaatgaagcatatggagtaaatatagttaaatcaggtaagatcggctgaaactccgatactaccctaatcggcaaccagatggcaggctagagattgatattctaagcacgacttaatagatcaaactcaactgatgcagcattaagtatgaaaacaataacaatatctagacaatcaagcccatggaagtttcatagagtggtggatatcctatataatctaagtcaacatcgatgtttaacctaatcggctgccctctaccgacagatgttagccgaatgtaggttatatagcgatattgccagagattatgtaagatatatgataactcgacgaattacataaacaagatcagagtatcataaagatggaagcactaatcccgagaacgtaagccgtcataacaagttttacctcttgttgaagatcgaaaccgatgcagctcaacccgaaagcaagaactcgtcgaaataaaactaaagcaaaagggtggcgatgcgccgaaattgtattgaacgtgtgtgttaattgattacatggggttcggggtctatttatacccgaaaattacaaacaatgtccatatcggacacgactcttatctctaacaaactctaaaataccataagtctttacggcagacttttgcccaaacatatctctaaggaaattacataaaatatcctaattaatagatacaattgccttctcaggactctatccatgtgtggcaatcatcttgaagcatatcaactcaacccgatgtcatacaccaagtcgtattgtcggaatcggccgtatcacctaacccagtctgactcggacttagccgatcccaatcgtagccaatccggactccagccgattcttacactattctcgaatcgatcttcgtctttgactcagctttgacctaatcctcttttccgatgctgatatcaccaaattcggtcattaatacaa

SEQ ID NO: 21111 - DNA, 6128 bp, Oryza sativa
tttttactgctgaaacagactttgccctctctctctgcggcgactccgccgacgcaaaaggcgattccaaagcgattccatctcctgccggacctccgcctgcgatgatgtcgtcctccgccagcccgtctaccgcgccatcagccgagtacgccgaggtaagttctcatcggctagatcccttttcttcgtaagaattcgatttccccttccctcatcttgtttccttcttctcgaatcctttggatttgcagcacctctccaatttagttgcgattcccagcctgtcgcatgaaaaccattactttcttggtccaatcggcaacttagaccctactgatttcatcatcggcgaaaccaacagaatcccctttagattagccaaccctaacctaggtcactggaagaatacttttaagtcttggccatctcttgagaaaactactcctgagaatagttggaccacatggtacaagcgcctatcagctagcaagcgaacacattgggatgaaatcggaatcggccaagcgcttgcccttaccatagccaattcagctaaggatgaacctctgatggccgccgccacttatttctggtccaataccatcaatgcctttctgttcaaccaagggccgatgactcctactctgattatgatcaccggactagatgtaacctcatcggccaaccctatgagcatgaataccaagaatcaatttgattttagaaccaaaagcataggtggctggtctttctatgtggccgcatacatgggccaaggatctgttactcctcgagaacatgtggcctttctactcatgtggctggaaaagtttcttttctgtggatctagctgtggtcctacaaccaagtggcagtttgcagccgaagctcttgagtcaaaacgagaatttcctctaggcaaaatcctcctcggctacttataccaaatgctgaacaatgcatcggccaaaatagccatcggctcagtggttggagcaggtggaccatggtggctgctacaatcctagctcaacttaatggtcatgaaggttgtcaattggccatcagtaacagaagccgaattcccaaggctggagccgattgtagaagatgatggagaagaacgaacccatcgtaggtgcatgtcttatgtagattatgcatccacaccaaccgttgccggagcaaaactatcggttgagctgctcaaggattggttttgcagtgtcacgcctcgaactagtcccaaccggaactagcccgtgacgctccaaattaacctgttaatcaataccagtcccaggaaacagtgctggtatcacaggaagacagaatatcacagcaacagaggtctctttattatagagtaggagtacagtcatgttgggctgcggacagatcccgagctcacaactgcattactaaatggaagcggaagccaagacttggaccaaacatcacaggcgcgacttgggaactaggccgaaaccctaaaactcatcgtagccggcttgctcctggaagaactccatcttcttcagcaactgggggggggattatttatatagagcaagggtgagtacaggagtactcagcaagccatgggaaataagtgtttaatgcaggcttcaaagaaaggccgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggtacccggccaacagctttcaaacggccacccgggcctggctgatcccatcagccgtagattttccaaacatcaaacctattccacaacagcaaatttcacaaggcagtagtcaaacaaaactacgctaggaatcacctcacatccgcccatgaccatgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacattccccgatccgcagttttggaaattcatttagtttgcaagcaccgacccaggtgtcgggttttctaagtcttttgtaaaacccaagttttacccaagatgtttctcagattttaagtttgaaggcgaccgtcgatacccgtgcagagtgcacgattaccgaggcgcaactaggtgggtacaagcgaacatggtataacaattacaatggaagggtcaaatgcaacaaattaggtaggtccgccaattgccttgcagacgggacaagcagattaagtgtgatcctatcaatgcataatatttttcaggcaacataattaagttcaaatataggctcaagatgttcaaaggtggcttgcctcgctcgagatcttgagcttcatcctcgaaatcatcgcactgcgggtcttcgggctccgaaactacacacgaaacgggacaactcagcaaacggcgaaaataaagccctattattgacctctaagcatgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcggcccaagagaatggggcggctcggccgagcttaatgggccggccggccaaagaaggcggcccaaggcgcgcgcgggcggggaggggagagagccggtgggccgggtccatcccgcgtggtcccgggtgggacccgcttgtcggcgactcggctcaccgtgagcgaggtgcacgcggggcgtgctagggtttggggagggaggcgcggcacatgcgcgcagttcgcggaggacgcggtgcggcgggcccacgcgcagcctcacggctcgcggtggaccgcgcgcgcgagggggcggagggaagcggcggaccggggtctgcttgtcgcggccgaggtggcgccaacgtggcgcctacgtggctgccacgcgggccggcgggaggtagacgacgacgccggccggaacggacggcggacgacaacggcgagcggcggagcgaaccatggcgatacaggcgaaggcgagcacaccgggatgttgcacaggacgaggggagacgagccaatggctcggattcaccgggggatgctcgacggcggcggattgcggcggcggcaaccgacggcgggagaagggggaaacggcgatgaggtcacgaggggccgattcccggcggtgagagcatctacgcggctacgggaatccattgctagtgtcgaattgggcggagctacgccgaacgaggccggtgacgagcgggcgctacggagcacgggcggcgacggtggtgagcacacatcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacgacacgggagtgatctctccggcctcgggccgggggagaggaagaagtcgagcgcccggagtccccttccttgtcctcgctcgtgccggctcctccgacacgcacgatggcgaacggcgacagcgaacagagcacgggaggcggcgacaagaggcgaatgggagaggaaaggaaagggggggaagcttgggtttatatgggcgacaatgtcggtttgggagaggggaaccgagtttggacggtcaagccagcgagctggcgctccggctagcggccaaatcggcgacagggaggaggggaatgacgccggtggaggaagaaaaaggaaaaggaaggaagaaagggggcttgccccttgccactttgggaaaagaaggaggggatgggggcgacgcggcagagggaggaggggctctgcctccgtcccttggtggctagcgcacggagagaggcggggccgtgtcgatgacgacggcgatgacagcggggcggtttggagcggagcgatgacacgggcggcaggcgcgggcaggcgcggcaggcgctgacggcggcggcgactggccgatcggccaccacggcgcgcgcgcgcgggcggcacggcgatttgggcggcatcggcgggaacggcagcgggggcggagagggaggagggctcggcgcggctcacgggcagagcggggagagagagagagagagagagccggggagggagggggagatgggccgagagggattcggcccatcgaacccgagagaggctaaatagacttttgcggagggatttgatttgggaaggatttggattcgggattgaacttgacgatagatcggggattcgagatctgagatggcacggacacgacaacaagcaaagaaacggatttggcaaatagggtttttaagagatagttttcccgctaggcgccacgacggaacgggcgctacaattaggctcttgtttgatatattttacttgttttagtatcctgatatagagtagtatcggagtattagccgatacatgctagatctatttgaccggctatgctattaaaatatataaggctgttatcaatatatattttgatctaagtgattcatactgtctcggcatggcgatcgatccatctttggaagaactagtcccaggaatatccgcaaccacctttaccttatacttctgcaccatagttcccttacgggtttgcataaatgaactcaagaactggttgcgtgcttgctgcatcatcgcttcaaaatccttcttttgatcgggtgtcagcttgtctagagtgatgttcacgatgttgccttcattaacttcagataggcccaactgttgtatcttctcattaacaggaccggggctagccgaggacggcgatgctggcggcttgtcatccatgagaaaagacttctgacttcttatatgtcccaccaggcgtgccaaaagcgtgttaatgaaaaacacgaggcctgcgagatctgcttaactccagtgtaggtccaaaactcgccttcgggtatgctagcgtgccagttgatttgatcctgcaaccaacaaaaaataaaggcaaagaaaccgtggttaaatctataaatgatagccgatcggctaagtgccgatgacatgtcatttatccttgagccgatatcatgtgtaaatcgatcggtagtcataaataaataagaaagaactatatccactcgatcggctgtagatattaacaatatatactcattatatcgatataaacttaaatcaaatgattgggatagatcggttgccatgccgagacagtataaatcatttagatcgaaatatatattaataatgggattatatatgttcatagcatagccgatcagatagatctagcatgtatcggctaatactccgataccactctatactaagatattaagacaagtagaatatatcaaataaaagtctaatatacttaaatgcaacaagatcttaatataaaggacagatttaacatatcaatgaagcatatagagtaaatatagttaaatcagataagatcgactgaaactccgatactaccctaatcggcaaccagaagacaggctagagattgatattctaagcacgacctaatagatcaaactcaactgatgcagcattaagtatgaaaagaagaacaatatctagacaatcaa

SEQ ID NO: 21112 - DNA, 774 bp, Oryza sativa
cgaaaccgatgcagctcaacccgaaagcaagaactcgtcgaaataaaactaaagcaaaagggtggcgatgcgccgaaattgtattgaacaagtgtgttaattgattacatggggttcggggtctatttatacccaaaaattacaaacaatgtccatatcgaacacgactcttatctctaacaaactctaaaataccataagtctttatggcagacttttgcccaaacatatctctaaggaaattacataaaatatcctaattaatagatacaattgccttctcaggactctatccatgtgtggcaatcatcttgaagcatatcaactcaacccgatgtcgtataccaagtcgtattgtcggaatcgaccgtatcacctaacctagtctgactcggacttagccgatcccaatcatagccgatccggactccagctgattcttactatgttctcgaatcgatcttcgcctttgactcagcttcggcctaatcctcttttccgatgctgatattaccaaatttggtcgttaacacgaccaaattgcttttatctcagccgctcgtctgtgtattgatgagacttatctagtgcaagggcatattctgaaacatggagtagatggatctttgatttactttttctctggttgtacaaatgaaatcccgttgccaaatgcggggtatcatttgtacaactgccgtgaactaaccattcccctgcagaccatagaagaatctcgtgcaggtggagcatacagggagacgcgcaacatga

SEQ ID NO: 21113 - DNA, 24643 bp, Oryza sativa
atacagtgcaacctcacggaacacatagcacaaacgcaaggatggcaacaatctgctgatgcgcagttcgccaacttcaggaacatgatgcagcaacaggacgatgaccttcaagagtacttccgctttcaggggttcaatccttatcaaggaccctgagcgaaaaccatgcttgggggggggacatctcttccccccactgaggtaacttgtatcacatcgcatattttccctttccaattgcatcttataaaacttgaaaacaacataaaaatttgcaaaatagaaaataccaaaaagataggatatgcttgagtcatgctaggtaagacaagctagttctctttgttgaaatgatgaatagttgctctgttttatatctcttatatatgggttcttggtaagtgctctctcaaaggtcaaatatgagtagccaacaattatctgggaacatgagataaatgagttgcacttgctgatctaagtctaagttattgtgagctatgatatagtaaataagagttactatgatcctgatcctagtttgacttgaattccggatgttttgtttttcaaaattataaaatggaaagttcctcatttgatataaattcctaccagagccaaaaatgtgctatcatgtttaaaccatatacattttggttacttgtcattccattgaactctgtcaaactcttgtgacttgtgtagaaacttctcatgctctatgatcaagatcatacatccacatatatgcagatgccaaactcctacactgggagctaagcaatattccattccatttccttattaccaccaaaataaattctccatgctttcatgtgctttctcctcctagaaagaaagaaaaaaaaagagaggagggaaaggcatgattatgaaaaaaaaaagttatgctccatcaagcatgagcatgatgttgaaaaaaaatgtaatcataccctctcctaatcaataaaagaaggatttttgggagaagaaagtaagcgcaaaggagaagctttttctttattttccttcatgtaccacttttatcatataccacacacattttgcacgatcttgatcttgagtatgtttagtcatctgctttagtctaagtttttgatttagtaataaatgtgaatacaagtatgccatgtttgatccctactgaggtctacatattaaaaccttagagtaggaatcaaaaaggcaacaattggtaaggaattcattttgatacacttggagagactgagtgaatcatttgaggaacttggctttcttttgcaaaatcatttgaaaacttccagaataagagttgaataaatattgggtgattgatgctctaattactgttctatctttcaatcgctcaaggcaaggaaaagcagtgtcttgtgggaatcaggggtaagggtaagccaccgtgccaaagattatttaatttgagagatatgcagcatagtagcaactcctgatcaacaaccaagtctttgtttcctttcgtccttcactcgggacgagcaaaggttcaagcttggggggttttgttgatagtcgttatcgatcagtttcgaccgtcaatattactaaaatagaggagaactagtgatgcttgcaatgcatatatttgttagaataataatattccactagtattagatatactaaccttttgcagagaatgacaataaagtggaggagaatcgacatcaactcagatgataaatcaatcggacgatgtcgagaactagacttatgtatgaatgggccaagaactcagaaataacacgacacattgggcccgaattcacaagtctacggaggaggacaacaaaggaggtcgctagccgaagataggcatatatgctacgggacagtagaggtgggccactgatggtgacagctcagtacgggtattcctctatgttagtatatattcctaagaaaaattcatagggagggtactcctccgtatttacccccggttggacggccatgataggttgtagtaaggaacttggcaacccggggtggactctcgaagtaccaggaggacactgttagggggtattggccacacgattgtatagtaacatatgtaaactagatattgagtgtatacttgaagtataggaattgagtgctttatgtttcttgttccacttagttaaaattaatttattatgaggatttgaacagctttgcttcttgtcactctacccctatattaaatataacccctacttagactttgataaatacaagtaatatatgtataaagtgtattagcaaagtccactcatatgatctttccttgggattaaaaatacgataccttggaatacttccgggtgaaatgctacaatggtatatctgtgcgcttgtggatttacttctgtaaccataaatatacgaggactatttctggcgccattgctgggaatgaatatttctagcaatgtccttaagaaataccaacaagcatttctggcgccgttgccgaggatgaatatttctagtaatgtcgttaagaaataccaacaagcatttctggcgccattgctgcggaagattaataatgagatgactataagctaaccttgattgttttcacttgtgtcgtgaaaatagggtagtgtatgactggtttcaacctaccggaaaactttaacgagaatccagaggccttcttctggagtgtcaaacctcgcgtcgtccctccgcagaagagactctccgaaaagaaaccagccatcccagtgtcaccaagtttcaggaacaaggccgagaagactcttcattaattcgttgccccgtctattgacaacgtgcctgctggcccagctgtcaacatcggagacaccgatttcgaccttaagaacaggctgctaactatagcataggcaagcccattctatggcaagcctaacgaggacgcaagcgctcatctgcagcacttacacggaaaagggtgtcagtccggacgccgttaggctatgtctgtttccttgctcactcctgggaaaggcaaagcagtggttctacgtgaaccgggcgacagtcaacacctgggacagatgctccaccgcgttcctctcaaaattcttcccgatgggatgatgccgcttattttctgcagtgatccatgtggaactaaatgaacagtagatagagcaaagggataagcacttgctggtagcaacttgcaatgatcaacaatattgttgaggcgcattttcacaaaacaataattttctagagtatggcatgaatcttggcacatctaaataagtgaaaagatagtcctttcttgcaaaactatgcatccacgccggtggcaaaatatagtccattggatatagacgatcagaaatttcaaccgttagatcatccacatcaaaattttataaagccccgattgagagacttctatttcagaagggtcctctgaccttcatgtcggtctctgttgtcgaaacgacaactgcatacgtcaaaagactggttacttaacagtggttggaaagaaagtagagtgtatataattgagaattttttcttgggatccccctgttacatggacctagaaggctatttatagcctcattacaggttcttactactagggtttaagttatacaggggaatttacatggttccccttatgaaaggggcatttacatgggtatacagtgtaattgaggtatatgggctcctaatgggccgtcaggcgatcgttggcccaaaggccactgggccttcgtgaggccgaacttgctatggcgaagttgtctcccttcgacatacactcttcgccttacatccttcgcccaagaggtctttggctctgcgaggcacccgagtgattctccgcccttcgccgtctttgatccatagtcttcgccatgtgggcttcgccccaactgatcttgacgtcttaggcttgaatccttactggtcgcatggtttcggcaggtttggtcgaagggcctcatgccaaaccgcgaactagcccctcatgggcaagggtgagataggagcttcgggcgagaccgtgcagaccatgtggtatggtatgtggcgccccctttcgaccgatgctcctgccgaaacctatcttattcctgcaaagaaagtgcgttgtgtcttttcggttggtattgttttgtagctttcacctcttgcggatggtggagttatttttttatttttcctgggccgaaaggaacagtaatgggctttcccttcgtgggcttattactgtgcggctcggttgatgggaatttaccgtttcgcctacccttgcgatacgtggcgctttattactggtgggtaggcgaaccgttgcctgggtgggctatatattctcaccctcttttcccttttcaccgccacacttgtcatttttgccatgcgcactctattccaccgttctttcctttcacggtgccccttgacccctcatatctttcgcccattccctttgtttgccactgcacacacccttcgccatggctcctcgaaagccaaaccccgcttcggcgaaagggcccgatcccggccggattgacaacgacaccacggcctttttggtgatttctctcatagatgatggcgagctggtgaagttggtcagctctggggcgttggttgaggggcaggctttcgccctgggaaggccgtggtaccaaagcccgtcgacaaccggacggtggtgttcatcgtcttttttgaggcggggcttcggttcccgtgcaacgtgttgttgccggagatccttcgccttttccaggtagagctcccacagttgagcccgtcggcgctagtccggatcgccatcttcgactgggcgtgccggacctccgggtttgaatctagcgctgaactctttggcgccatattttttccaccgtgaatttgaagacggtggtgaccccggccggaacaaagaagacgatgttcgggagcatgaacttcaacgttcgccccgagcactccgatctctggccggtgaatgctgccatgtcgaagtgggatcgccactggatggcgaggtggttctatcacaccatccccttcgaggctgggtccgagtcggcgaaggcccttcggtgtcggcgcagggcgattgcgccgaaccggaaacccaagatcgccgtggacggcgccatggaggaacggttcgccttgctgcgcaaggtctgctcccgcatcagctgccgcgacttggtggaggagttctgtatgcttctcattttcccctctcccattcgtggcaagtcgcggttgaccaagatgaagaggtcaacggtttgccgaagctggttcttcctgaggggacgaacggtgagattgcgctttcgctatgcgcttatgtgtttcgctatttttcctggctcgacgcttaatatggctacaccttttattttcacagtgttgactctcgatcaggccgatgccaaagcccggaggatgatcggcgatgtgtcggtcatcgagtacagccagctgctcacacgacaggccgctggtcgggtggaccgggtttacgacggcgaactgcctccccgggcgaacccccacaaggccgacgacgatacagggccttcgcgaaagcggacacacggacaagtgagactggcccctagaaagcaaagggtccatgcttccttcaattctgacgctgatgacgaggacgacgtcgaagagcgtgacggcgaggaggaaagggaggaagaagagggggcggacgctgcggccggaaaggctgcggacgaggcggtcgaaaaccacgccgagacccctggctacactcctactacaagtccagggcataatgacactggggtggagtcgaatagctcccccgttcattgaaagtatttgcagggggcaaaggcgctagttgcgttttcggcgggaaaggtggcgaaggggtgtccagttaagaaggccgccaagaagaaaggactcgtcgatgttgctcgtgtttttagcgacgacgagtcttctgacaaatccccgacttcacccaccggtcgtagcttagatctttcgaccgcccccgttcttccgatcgacgctagcggagcgggtggcagtgccgccgccagggcctcagcctccactgatcgtgtcgtgaaggctgcagctagggtttttggaagccctttgcgtcagccgattgtttcgctgctagtgaagccgaaggggaagggggcggccgtcgaaacatctgcccctgaatattctctcgcggcgccccacttcgcccctggcgatttcgagacccgggcggaacttattccctttgttgagggggtaagcaaccttgtctctcctgtcggcactctgagcctattcaccgagctgaatgagttcgacgaagggtattctgctattaaaagcttggcagttcgggtatgctgttcgctctctcttcttgtttgtctttattttcttcttacagatcccacaactaacatttgctctcttcgtccgttttaccttacatccagattcttgcggctcactgttcgatagagcgaaccgtgcgggcccgtcttgacagatttaggatacatcttcgagccaaggatgatgagattggccgcatgagtttggagatggaggccctcgccaacaccctcaaggaggtgaaggcgcaaaaacaagcgactccaagccgaactggagaaaggaagagaggccagagctgaggtcgatcgccttaaggccgaactggagaagggaagagaggctagagctgaggttgatcgcctcatggccgagcttaaaaaggagaaagcccattcggctgtgctgaccgactattacaatcttactgagccgaagatagaggctcttgacctggaggtcagcaaggctgaggcaagcgctgcggaggagtcgcagcggttttcgcgggagatggcaaaggccaccgagtccgcaaaaacggtgtgccaaatgctccgccttgccctcttcgacatgggtgtgagggtgcgaggagtccccgccgaagatgcctctgcctttgacttttcggagtggacacagcaggctgctggtgtagtttcggactgcgctactgcgtacggtgattgctgtgcacgtgtatcggcggccttcactatgggccttctgcaccagtttggctgtgagcacgtcgccgagttccctaactatgcgaagggggaatgggaggttagtgcgcaggacgtttcgcccgcgctccgcgcgtggtggagcagttctagcagaaggacggccgatccactgccaaggcgtgccttttggagcaaccggcggaggcagaggtggcagaccagggcgaaggtgaggatgcggcggttggatggggtggaggcgatgcctaggatcacccagaggtgtgaggccctccgccctttccttagatttttgtagtttttcttttttttcgtttgccgcaaaagacgaacaatgtatatttggccgatggccccttacccttcttaatgtagctgaaaatggccttttggatatttggaatgtatgactcagtcttagtcattttttatggtcgatgcctttggcgtatgtgcttgcgccattttcgtattacgtaatatttgctctttttcgcccattcttactatgcaatttgccttttgccctgtctgcactgtttagcagggtgttcgccgaaaattgtgcactgccccctctgggaattggcgaagcaaaaacgagaaattcgtggtgttgaagggtctgccaaaagtgcgatgcccgtttcggcctatttatcgcgagatggtaaaatacggccacagctataaggtttttaaggttgccggctggctgcaggcgcaccccgggagaaccttagaagattacgatcgtgttcatacaaaacgtttggaggatatggttcgcttttggcgaaatcatcagaagaccttagaagattgcggttttaacgtttggcgagcgatgcttcagccgattcgtttcgcccccctagcatttttgctgatcaggcgtttgccttagggcttttcccacaaattatcaatcacacaaatagtaaggcgaaaaacacaaagattttatactggttcgggcctccgggatggataatagccctacatccagttttttttgtcttttttcattttcctctttttttttgcattttcgtgccgaaaggcatacatagtgccgaaaggcttacataacaatatgtacatttttacaagttggcgattcgggtgccacccgttctacacatagaaacgcttgagagaggcagcgttccaggaacgattgaactcttcgccttctagtgtcgctaggcgaaaggaccccgtcctggacttgtgcttgatgaggtacggtccttcccacttcgattcaagcttgccgaccgccaccgagttcgctttcttccttaggacgaggtggccgggcaatagctccgtcggtcgaacttttttgttgtaagttgccgaagtgcctgcgacgtatttgcgcatctgttccagtgcttcgactctcaccccctccaggagttcgagcgacacctcgcgcccctcttcgccccaagagaacatcacccttggtgaattagcccctagctatgttggggtcattgcttcatcgccatagagaagcatgaacaggctgaacttggttggccttgtgggggtcgtccgaagggcccagagaacagatagcatttcatctcgccatttacccttcgctgccccctcaagccttttctttagtgcttctaagatcttaccatttgtgcgttcggccgccccgtttgactacgggtgtgcgatcgacgtgaacatgatttccatgtttagcccctcacgcatctctctgaacttgtcaatgtcgaattgcttgccgttgtcagtgatgaactcttttggcactccgaaacggcaaacaatgtttttccatacgaacttctaaactgctgccgaagtgatcgcgccaagtggttcggcctcgatccatcaggagaagtattcaatagccacaattgcgaacttgtacccgtttcgcgccaccgggaacggcccaatgatgtccagcccccatctggcgaaaggccaaattggtgcgataggctgcagctcttattggggcgcagtttagcttcggccatggcgctgacagctttcgcatttcttgacttgctcaacacagactttcagcacggtgggccagtacacaccttgtcgaaacactttggaggcaactgttcttgcggcctgctgtgtgcctctgtgaaacaaattttcggcaatatgcaaagggggtagcgcacgagacctaaaagtagatggatgcagagacaaaggatttagacaggttcaggccctcccgatgagaggtaataccctactcctgtttggggatttgaatccgccgggtgtatattgatctgacgatcaagttgtctcattctcatgccccctagagggcctcctgccccccttatataggatggggggcaagattacaagatagaaaccttaaccaatacggtatcggtttcctaaatctactttacaatcttatcaaaccaggactttaggccgttccacaatatacagggaaacgtaatacccaagtcatgatccgttacatatttcataaatataagtcatcccctatagctagtcggataaccatgccgtgtggatatggggtaccataatctccacagtagcccctgagaccttcacagtcaaaaagataatcttctctcgaactagattactccaaagctgagtgctttaatcatcttcgctatggtctccgaagtacttttaaatatgaagactgtggagggctgaaaaataaagtcaggtgcatcgactagatgcacctaataggtgtagccccccgactatgtggttagctaaacaaactaagcatatagtcaaggaataaataatccaaccaaccgagtggttttgataattgtaatcaaccaagtgacttgatatcaatatatagcatatgcggtgtgaatccctgaataacatgatccgagtgatatactgactgttttgtaaaatatgatgagtgtaacctaaagttggctacatcattgaaaattcacatagcaaaacagctataaagaagtttgtatgttgtgaataaagaaatttccaaagtattgggcatacaccatgcgcacacttctttaacagatgtgcttgagtccataaaagacacatggtttcaccacacctagaaatatatgccatatgtggtataaaatccgagtaaataaactcataaggatttatcaatcgtttggaaaatgaccaaaatatataatcagcctaagccataatattggtcaataaaaatgcacacttacgtggcaaaaagcaatgatattgtatctaatcaattgctttatgaacccaaacagcgccttgacttatataaaaaagtcagcggggagctatataaagcattattgtttggcaccttttaaaatgtattgtaccaactcctaaaaagttgagtaactgcggtataaaaggattttaaggtattgggcacataatcacgcgcacttttgcctaagcaaaaagatgcctaagtccctaaaaaaacgtgacaggccacacctgaaaatatgggctgcagacatattaggcctaggccaaaaaatatgcctttgacaccctttaaaggatcacgcatgtaacatgctcccgagtaataaatctttcgggtgatatagaccaagtgtagctcatatgaatagcttctgatctgagggattatcctttatgggatactccaaaatagatataacaattgaatttcgactggcgcaagtattcggttaataacccatacggggaataataaatagtccagtctttgagcatagaaaatagacccatgatcatcaaattcatgttgcatgtatccggaacaagtccaaattggagatataatcctcacgcttgagttgatgagcccatgagcatatagcttgtccttctgtcatagtcaccattgtccattgatggtagctgatgcagttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaaccgttaggtcagccagcaatgaatatgaaggcacccagcgataaagttgtgtaccataccagcgaaataattagtcggtgacagacgatgcagctggtgaagaagatgaagatgcccattagtggcgacataatgagccatccatgaagggagataccggtcggtggtgacgaaagccagccgacggtgaagatgtaggcacgcatcaaaggcgatgacgaaatccaccaatcatgaagatgaagaaaatagtcggcgacgacaaacacaaccgacagtaatgatgataagcagcaatcatagatgatcaaatataatgacgaagttgcccatcaatagcagtagagtgggctatgttgaagaggcttgataggatgttgataaagatgacgatgtcggtgatccagtcaatagcagtgtagcagccgatgataatgacgatgactctcatcagcgtttgcatagtaggtcaaccgtgaagacgaaataacaagtcggtgatgagagttgatgatgataaaagtaaccgaaggcgaagacgtagtcgccccttagcaatggtgtaaatgtcagggccgatgaagtacacatgctggtgatgatgtcagtgacaataatccatcaaattggtgttatagctgttgcagatgcttcacttggaggaaagtagatgatgttgtccaactggtcgaaactgagctgattggttgataactctgctctaaagcaaagacgaagataatgactcctggaattgactcgttggctgattaattgattacttcagcttgtcgaattttaagagtcttgtatttgtgtagcccccgactctttggttagttgggaaacaactgaacatagagtcgagaactgtaacttcttgtcgtcgagtagtcattacttgagtgaagataaatattaaagattggaacaccacttgttgtaataaaataacacggcatcatatttggtgacgtatgccgaggtgtcgaaactcttgtagtcgtcatggttggtgaagtagaggcaatagagtttgccgatgccgaagataataaaaatgaagttgctccaccatggtgacaaaattgcatagccgtgatgaagtcaacacgactcggtggcaacagaagcaaaccggtagtaaagacgcgcatttgtgaagataaaagcaccagtcggcggcggcataaccagtcgatgacggaagacgatgatgtccatcagtagttgtagttgtgttgaagatgctgacgcctattagcggtgacggcgatgtagccagccgtgaagaagatagcatcagttggcgtcataacaggccagccgtgcaggcggtgacaccagttggcggcggatgaggcggccagtcggtgaagcggtcggttggtgaagacgtagacgcccaacaacaccagtcggcggcggaaacaccagtataataggccagccgtgcaggcggatgttctgactgatccattcctggagcgtaagagataagcttaaagccatgaatcccttttatgcatatctggatctggatcctacagaacaaacatataggatgagtagtatctgatataaatataatactcgagaaaaattcaagtattttaaaatatttataaatatatatttcttctcttgtcaattttgatttccccgagcagatgactcattacgtttaaacattctgcccgactagtcatagccaccaaacaccgggagtcggcctaagcactttccaaacatgcatatgagtgacatgagttcgtcattaatggaacaaagtttcacgggtcggagtttactactcgggtacttttgcaattattaagagcagaaaataaattatcttatctctatgcttttgatttattctgaataatacttagcaccttgcgttattcggtccatccaacaagcccccgggtgctaggaatcagcccaaaggcaactatccattggcaaaccaaacggaaagcataggaagatggaactccataactcgataggcacttttgtactcagaatatgtcgcaagcaatcaagataaatattatgaaaattgtttaaaaaaaatgatataacatctatagcccccgactcactagtcaacggcgaaccagttgatgtagtgaggcaaaggaaaaggcaaaatatcatataaagaataaaataaatgatgacttagctttattgtattccctcggtgacagcaaaagtagccgatgtgggaacgaagcagtctatcaatggtgacaaaaacaccagtcggcgccagtggaaccaagccagtggtgtagatgatgaagcccattaacggtggcgaagtccgccaaccatacaggcggaaacaccagtcggcagcggacgaggcggccggtcggtgaagacgtggatgcccatgaacggtggtgtgaccaaccaaccgtataggcgaggacactagtcggcggcgacagaggcaagccggcggtgaagttgttgttgctatcagcaatggcggtggcgaggacaagccggcggagtggactcgcggccgatcgaccggaaagctgagacgcctcgaatccatgaccagcatcaatcgcctcaatagtgccgcgtaattatatgcgaacaacaacaaaaaatagcaagagattaatctgacattaaaaatcaatatgataaataatgataaaactaggcgtccggcgctagacgagtagttagcatgagtagatataaaaaattgctcaatggaaaatatcacataaagaggaaaaataaaggcacttagcttttttctcagtgtcctccgtatatgtgttaatggatggacaggagatcatatcggcagcttgtgacagacatgcaatacatgcatgagtgctgcacttccttgcgcgaaaattgctcctattggttggctcacattccacgtcgactccaatttagattggtaattgaatatcaccaggagatttaacgtcatctaaaaaaaacgctggcggttgagaattgatccgttgcttggtgatccgggtagattgatatcgccgaacagattaaaccagatgatggacacggcatgtcatacgatcaagttgacgactgacgtcccatcggaattttcggtggtggcgatgcaagccaaactccagaagagaagaaccagtccgaagatgaaggtggtgctgacggcagccataggagattgaatctgaaacttgccgtggtagattgttgtaatccctcgattgagtttccccctgactaatttggatcaagtcagagaagaggagcttgaagaagttatcgacggaaaggaagtgaaaactcccgaagctaaaacgaagtcggcgactcatgaagttgattccatcgcgctcgttgataggaaactcgacgcagcccctacctggcgcgccaactgtcgaaacaaattttcggcaatatgaaaagggggtagcgcacgagacctaaaagtggatggatgcagagacaaaggatttagacaggttcaggccctctcgatgcgaggtaataccctactcctgtttggggatttgaatccgccgggtgtatattgatctgacgatcaggttgtctcatgccccctagagggcctcctgccccccttatataggatggggggcaaaattacaagatagaaaccttaaccaatacggtatcggtttcctaaatctactttacaatcttatcaaaccaggactttaggccgttccacaatatacagggaaacataatacccaagtcatgatccgttacatatttcataaatataagtcatcccctatagctagtcggataaccatgccgtgtgggtatggggtaccataatctccacagccacaaagcccctggtgtatttcctttgccatttcctcaacttcggcgaatgagatgcagcgaagcaaaggttggagcaccccagatcgatatagttggcccgagaccatcttgtactttgcggctctgagctgtaagctctttgcttctgcttcgtcctccggaagccagccgctcttgaggtaccttatgaacgggggtcgccagtcttctggatcttcgcccagttctacctggtcgattgccataatatccaggctctctatgggcacgcttggtgcgtgtaggacttaaaaaagatgccaggcgaatgcgggcccctacaagcaacagatttcgccaaggcgtctacttcctcgttctggtctctaggtaagtgttcgaccgttatgccggtaaagcatttttccatagaccgaacagcctccaaatacttcttcaatccttcttcttttgcctcaaaggacttatcaacatgacttgccaccaacttggagtcggttcggatgagcaagtgccgaacccccaatgctttcgcatttttcaggcccagaagaatggcttcgtattctgccgcgttgttggttgtgtcgaaatgcagccttgcggcataccgaatcggcacgccccctggcgaagtgagtactgccgtagcgcccgcccccttgtgcgaccacaagccgtcggagtacatcacccagggttgttcgacgggctcaggctcagggtcgaacgccggtgtccattcggccacgaagtcagctagaacttgtgacttgatagcagtgcgagcgacaaaatgcaagtcgaagggagatagctccgccacctatttgctgagccggccagtaacttccttgccccggagtaccacgcccaaagggtactgtgatggcactgtgactttgtgggcctggaagtagtgtttaagcttgcgcgaagccatcaccagtgcgtaagcaagcttttctatttcaatgtatcttatcttcactccttgcaaggcttaggagatgaaataaactggtttctggcctgactctgtctcttggacatgggcagcagtgactgccactagcgaagctgccaggtacagtagcagttcgcttcctggtgctgggcagatcaaatcgggtgggctttgcagatattgctttagctcgtcgaacgctgcttggtattcgggtgtccaggtgaattttcccacgccccggagggtcttgaagaagggcaaatttttttcggctgcctttgagaggaatcgactgagtgccgcaattcggcctgcgagcttctgtacttcacgtacgctcgacgggggcttcattccattttctcgtggttcgcctcgataccccatttagaaacaaggaaacccaacaacttgcccacgcaaacaccaaaaacacacttctcaggatttagtttcatacccgccgcgcgtaagttgtcgaaggtctcctacaggtcggacgcatggtcgaaagccttgcggctttttacgacgatatctggtggtagccggagtacgcatcaaagaagctcatgagttcgcagccagctgtcgaatccacgagttggtcgatccgtggcaagggaaatcgtccttcggacatgccttatttaggtctatgaaattgacacacatgcgccatttgccgtttgatttccacaccagcaccggattcgccagccagtcagggtggtccatctcttgaatgaccccagccttgagcaattgttggacttcggcttttgctgcttcttggcgatcagcggacatcttgcgtagcttctgtttccttggcttggcatccggcttaactgccaggtgatgcatgatgagatctatcgaaacacctcccacctcatcagggccccaggcgaagagatcaatgttttaattgagcacctctaggatgttctcaactttttcttcacccatgtcgccccccagcgatacaagctttgtgggatcggcatcatcaatctgtatcttgattaccttgccatgaggggcgggctttggcgcgtgcttcgcccgatcatgcggttcggcctcaacattatgcactgctctgttgattatggccagatcaccctttgaagcggccgaaggctaaagccccttgaccacgatcactcctgccgggccaggcatcttgagcttgagataattgtggtgggaaatggcttcaaacttgttcaaggtcgcacggccgaagatggcattgtagttgtacgggatgtcgacaatgtcgaacaatatttgctcttcgcgtctgtttttgcctatgccgaaagctactagcaattgcgcttggcctagaacttggactgcttctccgccgaaaccacaaagcgaggccggtgcttgggtaagggctagggaaggtaatcccatcttggcatatgctctggcgaagatgacatcggtcgaactccctccgtcgactaagattcaccggacctcgaagccagctatctcggccgagatcaccagagggtcttgatgcgggaacattactcctttggcgtcttccgacccgaacgagattttctggtttagatattgcggggccccttcgcccgccgaagtgatgttgtggaccattcagagctgcatcttcttttgtcgtttcgacagttgattcggcggatcggcccttgtaatcacttggattactctgcactgcacatcttggcgctgttcggccgggggtgcttgttcttgaatggcttcgcgaggtgcttcgacagctgctccctgttgcggccttggatcttgcgcgttgccacgctgccgaatatttcggcattgctcggtggtgtgcaaagagcgtccgtggaaggcgcagtaaatgtcttttcggaccttcttgcgagtaggctgctgatggttgcttgcttgctgggcatcgaactccttgcggagggcttgaacttcttcgacagccatcacagccttgcccgcacagtcggttctgaatttcctccaagtcatgggagcttggccttgccttggcggttgtccttggttcgccggctgaggctggcgaacagcgagaagaggtggttcggtgacctgagcttgtacttgggcttgggcagtggcgacggaggctttatcatactcagcctgaattgcttgccgtcgcttggaatcttcttcgccccttgcgtacccgttgatgatgcgaagcaggtgttcaagcatctgcggctctttgttggcaatttttcttgtgagtacgccctcgagcagccctgccaaaatggcgttgatgactgacgcctccgttatgtcttgtacttgacaccgggcttgcgagaagcgacgcatgtactcccttatcgattcccccggcctcaggcaaatgccaagtagatgctgctatgtcttcagctcctcgtaggtgcctcgaaagataaggacaaagacatcgcgcaattgctcccatgagtaaatgctgttggctggtaaattgaagtaccaagaacgggcgatgccatctagagtgagatgtattacctttcccttggtattttggtcgccatgagccgcttcgatcgcggactcgtagatggagaagaattcctttgggtcagtttcgcctgaatagcgtgggacgggtgggaacttgaactggggtgggatcggacggatcttaattcccccactcagtggtagccccttttcgccccctgccctattcacggcaccttgctgcggatatggtgtggcgaagggcgaggtcacggcctgcacgtgaggttgaaccacggtgttcagttgcctggctctgattggtgctgtttggtgagccgccatggatgggtcgaacgttggctggggccacaccatggcggcctggtttggtgcttggtttgccccgaagcctggtgttgtttcttgcggccgaaggtttggtgcctgagcagtgttgatgaagtcgaactgcggtccttgactccaaggcgaagcccccagacccggctgattccacggcaaccaactgggcgcaccttgacttgtgttccccttcggctaggctgaaggggttgtacctgaaatgttgtggggttggctgaattgttgaaggaaagcttgaacctacaccgaagccccttctgccatcgcttgtgacacttggccaagcggttgagagtgtgtttgggcagcgaccggctgagcttgcagctgcacgtgaggggccggatgtattgctgcggtcgaaggctgcctggtgaagtatactggcgcttgcgtggcttatgacggaaggggctggatcggtgcttgtggatagacttgggtgggatgtagccttccgaatactggaggattggggcctgaaagtgtatctaggcccctaatgattttgatgattgattacaatgcgattagagaggactaacacttttattcaaacaagtgtgaaggttgttatgtcctcgacatgttgtaatgagatgcataccccatgaatgcgacatcacgatgcaatgcggcaatgatcaaatggtatattgtatcttttaccttgcattatgtcgtactattaagagggataccacatgcatataattggtagaacactagtgctcaaaatgcttcatctttgtgtgagttgaaaaacctaagccaaaatttcaattccgagttgttcacttgtcacaacacttacaccaggtttctttgcaagtttttcaacatctcttgaaggttttggaccatgttttatgttggttttgatagcccacgaaactagctttccatagagtctaagatcttcgaaatcggagtttggagtaaaaagttattgcatttttactggagcaacatcagactatccgatttgaaatcagactatccaatgtatcggactatccgatttttcacaaaacttcactctctgtctttgtttgaaaaatactttcgagtgagtttttctatgtgtcggagtatccgatgttggatcagatagtccaatggtacagagactccgaaatttcatggaacttgagtctctgtttgaggacgaagtttttgcttctaaaatatcggacactctgatttaacatcagatagtccgatgtcttggaaagtccgaaatttcatcgaacttcgttctctgtttctcgttgtcttggaggtttaaaatatcggactatccgatcttgtatcggactatctgacgtgggatgaaagattcccctccaacggccacattttgggggggtctataaatatcccccacctaatctttttctagggtgacccaactcattcattcacattcactttgggttgagcttggtgctaaggtgctttcgatctttgagctctttctccctttctcaaatccctcctcattctttctgtggtggatcttggtggttgtggatttggtgtttgagggcctagtgtgtgtttcactcgatcttgaacactagggtttgaccaagagttgtgtggtgtttgttactcttggaggttgaggactcctagatggctaggtgtcactctcgagccaccgatcaacgtgtggttggccgggagaagtttgtgaaggccggatctcgcctccgcaaagaaagaggtaccccttagtggaaggaggagtgcttagtgcaacctcttgaggaaagggttagtagagacccggctcttagtgagctcctcaacggagagtagaatcccctcaaggatttgaactccgggaacaactccgggaacaacggagagtagaatcccctcaacttcatcgttggtgatatctcttcatcttctctttagctttgcttaattgtgccgctatagatctagctgttgtttgtgctatactcttgtttgtgcactagatctgcttgttgtgattctttagtggatcagacagtctgatccaacatcagactatctgatattttcggatagtttgactgtggatcagactttccaaccctaactcaggtttagcttccgcataaagttttaaattagcctattcaccccacctcctctaggcctaattgaccctttcaattggtatcagagcctaatctcctaattaggcttaaccgcttggagagatcatgtcggaccaaacgggaatggcaaggatggtgaaaagggagctacgttttattatgactatccatccacatcaacctcttatgtgagtacttatagcggcaaagctccgtacttcaacggcacggactatgccgcttggaaacataagatgaagatgcatttgaagtctattaacccatctatttggagaatagtcgaaaagggctatgttttgcagaaacccgaggatcccaccaatgaggatgacgagaacgagcattagaacgctcaagccgctaatgcaatacttagcgccttgagcggaagtgagtttaaccgcgtggacggcattgagagtgccaaagtgattcgggacacgcttcgaaattttcatgaaggcacggatagtgttcgcgagtccaaggtggagatcctcaaagggcaatttgagaggtttctgatgttggatggagagagcccaagctacatgtatgaccgtttgagcaagatcgtcaatgagatcaagggaattggctccaaggacatgaccgatgaggtagtggtcaagaagatggttcgagcaatcattccaaggaactctaccttggtaactatcattcgtgagcgtccggactacaagactctcacacctcatgatttgcttgggcgcatccttgcccatgacatgcttgtgcaagagtccaaggagttcatccaatacattaaccaaagctcaacgacaagcatcaagaaggaagacttggcattgaaggcaaagtaagaagaagaagagagtcgcaagagcaagagcaaggcggagatcgatgatgaagagatggcactcttcgtcaagaagttcggcaagttcatgaagcaaagtgtcttcttcaagggaagttcgtccaagtattcccctaacaagtcaagtggaagacacttcgcaagggtgtgctatgtgtgcaaagagtccgggcacttcattgtggattgaccccacatcaaggattgcccccacttcaaggaagacaagaagaagcttgagaagaaggagaagcacaagcatagctgaacgtgtagagatgtagcctagagagggggtgaataggctttcctgaaattttctcaacaatcacagcagttaaattaatagggctcggaacctcctggtgatgaacaccggaacatccgggcaggatgagtagcccggaacttccggagttcttgagctaggaacttccgagcagcagagataaattaaaactgagatgaaaaacaggtcctagcaagggaagtttaggcacacagaggaacaagatgaagattgcagaatatcagcagattcacacaaagatcatgcacaagagagacaaagacgattttttcccgaagttcggatcacatgaatcctactctccgttgaggtgctccaaagagccgggtctcgattaaccccttgcctcacttatgcaaagatctcagaggaggtccacagccttcaacttaacacttgttggcggatgacatgaggctcttcgaccagatctgccgaaacccgtggcgaaggctatggagcaagaacggcgtgaggtgaagagtcgcacgagggccttgccaggccaggggcgtctcgggcgatgggtgcaaggcgaagactatctgccgaaggaagacgacttcgccatggcaagttcgcccccgcaagggccgaggaagcctttccggcccatcaagcctaagggccggcaatcgctagatggcccatcaggggcccatgagaccctataacattatgtacccctgtaaatgtccctttcataagggtaatcatgtaaattcccctgtacaatctagatcctagtagtaagagcctgcaatagggctataaatagccccctagggccatgtaatgggggatcctaagtgaaattcaaaatttagtactcaacatccttcgacgtatgcagttgtcgtttcgacaacaacacttctaggtcattttctagaattgagtgaccaccaagatcaaactcaaaattccttctagaaaaggccacaagtgcaagttgctctacataggacaacctctgaaaactcagcacaagaatctttactcacttatctcgtttccttgtggaggtgaggaaaaccctcacaaactttcccgggacatccacaagatctttggaagctcacgggcgacacctaaccgtctaggagaagatctctgagagtatccaaagtgacagcccacaaggtatccaaagtgctcaattaaacgtaatcttcaagccatctccaaaacactcctacactctcatctaatctctcaatctcacaagatagactacagatttgagtggaggaagcaaaggaagcttgggagtggctagaaaaccctagaacatgacagaactgaagtggaatggccaaagggtgacctggggacgaaatccatatatataaatgctaggtgacgtcatctagccgttactcacaagtttgaactggaaacctgccaggaggttccgggcaaaagtgccaggaacttccgggcagaacttaggaatttttttgtaaataaacggcgcccggaagttccggccagaacctctgggtagccctctctgtcccggggtgaaaatcatttttcaaaaatgattccaaaaatcttttgactcatggatatgactaagagcactttgtataccctagaaccacacttgaaacccctcttaatagtacggtttttcctaaactcaatttcgaaagtgaaaaacctagtctaatcaccttcggtgtttttcgcacttaggaacattcaaattgggaggtctccttgcattcttagccatcaaaacttggtttgggactaaactcctatgaataaacttgataaacacgtttgtcacctttaaccaccttgtcattaatcaccaaaacccactagggggtttaagtgcatcttcaatctccccctttttggtgattgatgacaacatggttaaagcaaataaaaagacaatagaatttaaattttgaatgatgagagaagtgtgaagctccccctaaagatatgcatataaagaactagaaatgaaaacattatgcataagatgaaggaaagctcaaaagaaacctcacactacccttatcaaagaagagatgcagatgaaagtgcttgaatgattagtgatgcaaatagaaagactagatgacatggcaatcactcaaaaagatgaaaagaacacaatcatcacatcaaaatgcaacatccatatggtctaacttactgacaaaaagaataataaagcatctaatagtcattacatccaaccataatagaatacgattacatgtccataagagagggaaaatagaggggagatctgcttggccggaacccccggatcacaggacccggaacttccggccaaatgaccagacaacagtcaaggcagcaaaaaagatttaaatgacccccttc

SEQ ID NO: 21114 - DNA, 1459 bp, Oryza sativa
  unsure (1)..(1459): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtgcgagaaggctggtttagcgatgtctgccctgctaaaccaaaggaagggtcttctttggcatatacccatggacaattcagggcatagtgtccttgttctctacaatcatgacaaatggggacatcctcttctggcattggaagctcattgacctagggggcaaatgctcgatcaaacacatactgattttggtcttgacttcgaaccaatggtagctgtgaactaagcagcatgcttggaatggaccaagggtctgcccttgttaactctcttgaggccagtggtggattgagttgaaaacttgagttactagaggcatacccgctgacattctttcctttttctctattaaacatctattacagggattgaggtgagagaggaaacaagccaggaaagaatagaccagaactagagacaggtccttaaaggaactaactcttcttgttgatgtgttgtttgcttcacttattctgcaagttgattaagcaaacaacttagcatggttacatcacaacccaccgatgcaaaccacgcgctacacacacaagcaaggaaacacatgacaaacgaaacactagagggtggcttaggttctgcgacgggttctccaagatcttcactgcttcttccactttgctaacaaacacaacagccttctggagcttcggcagacaactgacgatttcttcttcttcgctaagttgaccatctagtactagttgaaatccgaagaaggaagaagggagtaaaccttttgcaaatagcattaggggaaggagaaaaaaaaggaactttcgcatagttttatttataaaatatgcccttaggttttatccacttggcttatcctacagtcaacctggctctgataccagcttgtcgcgaccgagaaaaatattaatcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagtagcggactagcgggcctacggctccatcttcacaggctctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatatagtggt

SEQ ID NO: 21115 - DNA, 11893 bp, Oryza sativa
gcacttgtgggtgtgtcttgttgagtacggtggttgtactcagtcttgctcaatttttcccaaccccagaagaggagttcctggaagatgaaggcttcggtgtctagctcgtgcctgccgtcaagtgtctgtggtcgtcgccctagtcttccgctgtttctcgtttgtctttgtgtgtgctgggccttcgctgcccatgtaataaattaactatttacgcttccgcttgttaaactctgatttgtatcaacttttggtgtaccttgcctcctgggacaaggattaatgcacgcacgtaaggaacgcccgttgggttatttccggtcgtgacaagttggtattagagcccccttgaccctaggacgagccgtagatcccaagccttagcaatattttcaaaaataaaaatcctttgctatttgtgaaaactgtctagtctctctctgtcttgctgcttcatttactgccaaaatctggcctttaaaatgttgcttttctttttgtttttgtttgtagatggccggcagcatcacccgtcgtggtttggacatgactggcttcgtcttggagctgcggggcatgtgcgtggtcctggggtatccacacggagtggactaccaggccaggccgcttccggagcaggagggtgacgatgcagagccccacgctgcttgggaagtcactgcagtgatcctcgctggttctcccgagcggacctcgctgacagtcaccgcgggtggagactctttccccgccgcttgccagaacgccgctctcctcgccatcggcactcttcaccagcgctacccggacgagttgcagcactcgccctaccgctaccaccctcgtcgcggaggagcccgcgaccacgccaccttccgggatgctagttcggaggatgacgctaccatcgtgcacttggcgcgcatggtggaggcatacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctagcgtggacctgcttcgtcgagaccccccgtgccgagcccgcgcccgtggttccccaggagggggaagcctccggcattggtagcacggaggatgcgctgttgctcaccttccgtcctggcccgtcgcagcggtagacgagcagttagtaggcttgcgcgtgtgttctttcttgtttgtcttcttgttgggttgtgtggggcatggttatgtcggtgtgtggcataactgtgtcagagcctgccttattttatttgcctaagcaacttgaactttaatgaaccaatttaatagcagtaataaattcaagaattatggtagtcgtgggtggttagttttaattgtccgctctctctgtttgctggtcctgtgtggggttttcagatggtgacgaccaggagaaatgctgttaccggtgatggcaaccaacccgaaggcagcaaccacaaccaccaaggcaacccacctccacctcctcctcctcctccgccaccaccaccagacaccaacgccattctcacccaaatcctcgcccagcaagctaatatgatgactgctttcctccaccacctccaaaatccgccacaacttaatgctccaccaccacccccacaacactctagactcgccgagtttctccgcatctgcccacctaccttctctagctccaacaaccccgtggatgtgttggattggttgcatgccgtggggaaaaagctagacactgtgcagtgcagcgatgaggagaaagtcatcttcgccgcccaccagctgcagggacccgcatctctatggtgggaccatttccaggctacacagccagagggacagcctattacttgggcccgcttcaccgccgctttccggagaacccatgtgcccgccggagtcgtggcccttaagaaaagggaattccgagagttgaagcaaggcaaccgctccgtgatggagtatttgcacgagttcaacaatctagcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcagcaacctcgctccgcgcctcgaccttaattcgtggtgcgcgtcccacagccgcagcaacagcagagtcagcaagggactcgtgcgccccgtcctcctacgccagctgtgcagcctagtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctaacgactccagacgtcatcgttggtacgttcctcatttattccatccctgctaccattttgttcgactctggggcttcccactcgtttatatctgtgccattcgtggggagaattcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagataggactgtcagaaattcccatcgtcagagagttcggagacgtgtttccggaagaactacctggtatgccgcctaagcgggagattgagttccggatagatcttgctccaggaaccgctcctctgtacaaacgaccctaccgtatggcagcaaatgaactggccgaagtcaagaaacagttggaagagttgaaagaaaaggggtatatacgtccgagcacttccccctggggtgctcctgtgatttttgtggagaagaaagacaagacgaagaggatgtgcgttgactacagagctctcaatgaagtcaccatcaaaaacaagtaccctcttccccgaatcgatgatctgttcgatcagcttaaaggtgccactatattctccaagatcgatcttcgttccggatatcatcagctacgtattcgtgaagaagatattccgaagaccgcattcaccacgcgatacggactgtatgaattcaccgtgatgtcgtttggtttaaccaatgcacctgcctttttcatgaacttaatgaacaaagtgttcatggaatacttggataagtttgttgtggttttcattgatgacattctggtatactcacaatcagaggaagaccatcagcaccatctctgcctggtattgggaaagttgcgggaacatcaattgtatgccaaacttagcaagtgtgagttctggttgtccgaagtcaaattcttaggtcacgtgatatctgctaaaggagttgctgtggaccctgaaacagtgaccgccgtcaccgattggaagcaacccaagacagtcactcaagttcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccagtgttaatcttgccggatactcgtaaggacttcatggtgtattgtgacgcttcgcgccaaggattggggtgcgtgctcatgcaggacggtcatgtggtggcctacgcctcacgtcagctacggcctcatgaaggcaactaccctacccatgatttggagttagccgcggtggttcatgctctaaaaatctggcggcactatctcatctggaatcgctgtgaaatatatactgatcataagagtttgaaatacatcttcacccagtcggatctgaatcttcggcaaaggagatggttagaactcatcaaggattatgatgtggggattcactatcatcctggtaaggccaacgtggttgccgacgctctaagtcggaaaagccactgcaacactcttaacgtccgtggcattccactcgaacttaatcaacagatggaagccctgaacctaagcatagttggtcgcggattcttggctacgttggaagccaagcccaccttgctcgatcaaatccgcgaggctcagaagaatgatccagacctgcatggactcctcaagaatatgaaacagggtaaagccgctggtttcacagaggatgaacacggaaccctctggaatggaaatcgggtatgcgttccagacgtcagggaacttaaacagttgatacttcaggaagctcacgaaagtccttattccatccaccctggcagtacgaagatgtacttagacttgaaggagaaatactggtgggttagtatgaagcgggaaattgcagagttcgtggccctttgtgatgtatgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgagctctacttcgctaggatcgtaagtctccatggcgttcctaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgggataagagtctcccctatgccgagttctcctacaataacagctaccaagccagcatacaaatggcaccttatgaagcgttgtatgggcgcaaatgccggacaccgctaatgtgggatcaagttggggaaagccaagtgttcgggactgatatcctgagagaagctgaagcgaaagtcagaaccattagggataatctaaaggtggcacagtcccggcagaaaagttacgcagataaccgtcgccgtgacctggaattcgcagtggatgattttgtgtaccttcgagtcacgccattgcggggtgtacacaggtttcagacgaaggggaagctcgcacctcggtatgtgggtcctttccgtatcgctgctcgacgcggagaagtcgcttaccagttggagctgcccgcctccttgggcaacgtgcatgatgtgttccatgtgtcgcaactcaagaaatgtcttcgagtgccatccgagtaggccgactcagagcaaattgaagttcgcgaagacttgacctacgtggagaggccagtgaagatcctggacaccatggagcgcaggaccaggaaccgggtaatccgtttttgcaaggtccaatggagcaaccacgccgaagaagaagctacttgggagcgtgaagacgagctgaaggcagcccatcccgacctcttcgccagttctttcgaatctcggggtcgagattccgtttaaggggggtaggtttgtcgcgtcccaaatcgcctctaaaatacatcctcaaaatcatgcgaagaataagtaaaatctttgtgaaagcctccaacaattaaaatgtgcaaatttaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatcctaaaagtccttttcccccccttcctcccttgggccggctcggcccaactccctctctctctcctcttccccgcggcccatcggccttccccgcgcgcgcgccgctgacgggcgggcccgcccgccaccctcgctgacgggtggggcccacccgtcatcccctacctcacgccgctccctccgcccgcccgtgccctagcgccgccgccgccgccgaatccgccgcatcccgccgtccccacgcgccataaagagggggaaatcactccccgtgattccctccctctttcccccctcttttccctctctctctccctcggattcgcgcggaatcttctcccgaaatcttcgccggcgcatcaatggagcccgagatcgccgcgccgatttccttcccctccggccgccctctctccctcccaacgctataaaatcactccccgtgcctccctcctccgtttccgccgttcgccgctctctctcctcgtcggattcgagcccgcgccgtcgtcctctctctccgccgtcgccgccgagctccggtttgccaccatcgtcgccccggacctcctcccgcttcggcatcgcctccttcggcttcgccgcctcctcgtcgacctcgtccactcctccgtttcgcccgtcgaccgccggagcaccgccgtcctcgtcgacccgagccgcgccgccgcctctctccgcttcggtcgccgttcccgtcgtcgccgtcgacccggggtgagccgaggaccgccattttgtttcccccttccctcccctctctcgggcgccgctccgtcgcgccggaggtcgccgccggcgaccatcggggcgtgggcgcgccacctcccgtcggccgtgccggcgaggccgccttcgggcgcgccccgcggctgccaggtggggcccggccgtcagccgcccgcgccctcgggtgcggctgacgcgtgggacccacggcgccggccagcgcaagctgcgtgcgcccggtccaccgtggaccgtgaggctgccgcgtgggccccactcccgtggacccggtccgcgcgccctctctcccggctgacgcaataaatccggtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagcccttttcttttctgttggtcgtgtagacgctgcagcttcggaagatctgctcttcgtggaagttgaagccggcgtttgggaaagcgagcaaggcaagtcacatcatctttgaacatattgaatcccagtttgtaaaattatgttgatttaaattattgcattatcgctttatttaaattgccgcgttatcactgttttatttagccatgcctatttacctttgttatgaccttattattgttattgttattattaccttgttcaccctagaataaacaaaaccccaactaggggacactctacttatggtaccactagtgtgattataggtagatgcttcgcttttaattaggcaacattaggcggttttacaactctagactttgggaatattcatatcacctggacactgtggaattgttggagtattgtggaattggattcacaccgccccctctattcaaaacccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaaaagtacacggattggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctatttgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttggattaaggcaggttcgtgtgggttcacggccttgataaataatattgtatagtactagaatcgtgtttacaaaatagccctgagcaactaatgtctttaaatgctgtttactgcaaccctaaccctttacagtataattcctttgtactcccttgcatttgttctgcacttgtgggtgtgtcttgttgagtacggtggttgtactcagtcttgctcaatttttcccaaccccagaagaggagttcctggaagatgaaggcttcggtgtctagctcgtgcctgccgtcaagtgtctgtggtcgtcgccctagtcttccgctgtttctcgtttgtctttgtgtgtgctggaccttcgctgcccatgtaataaattaactatttacgcttccgcttgttaaactctgatttgtatcaacttttggtgtaccttgcctcctgggacaaggattaatgcacgcacgtaaggaacgcccgttgggttatttccggtcgtgacataaactccatataacaagtaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcaaccgaggggagggggcgcgcggaccgggtccacgggagtggggcccatgcggcagcctcacggtccacggtggaccgggtgcactcgggctcgcaccggccggcgccgtgggtcccacgcgtcagccgcacccaagggcgcgggcggctgacggccgggccccacgcggcagccgctcagtgcgcccgaaggcgggccacgtcggcgcggccggcgggaggcggcgcgcccgcgctcctatggtcaccggcggcggccatgggcacatcggagcggcggccgagagaggggtgggaaagggggaaacgaggcggcggtccacggctcaccataggtcgacggtgacgacgaaaaggcagccggagcggaggaaggcggcggcgcggctcgggtcgacggggacggcggcgctccggcggtcgacgagcgaaacggaggggtggacgaggtcggcgaggatgcggcgaagccgaagcaggcggcgccgacgttggaagttgttttgggcagctacgccgcggtcgggagcctggccgacaccgccgaaaaaaagcattggccaagttcgatccgggcaagaagaaaggccgttaaaagtcgcaaccgaccgaagcagttccgggaagggtttaaatagggttgaaagggaagaaaacggctgccggggaaggaataggacgcggaaggtccgccccccatcaatggcgccggcgccatttgtgggggcaaatccgtttgtttgaacgcgagagagagagggaaaaatggggggaaagggagaggggatcacggggagtgatttccccctctttattgcgcgcggggacggcgggaggcggcgggattcgcggcggcggcggcgctagggcgcgggcgaggcggcgggagcgacgggagtaaggggatgacgggtgggccccacccgtcagcgagggtggcgggcgggcccgcccgtcagcggcgcgcgcgcggggtgaggccggatgggccgcggggagaggagagggagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggattttaggaaatatacaaaaatcctccaagccttatttgacttttaactttgcacattttaattgttggaggctttcacacggattttaattattctaggcataatttagaggatgtattttagagtcgttttgggacgtgacaccgatacatgctagatctatctgatcggctatgctataagcgtttataatctttatgttaatatatactttgatctaagtgatttatactgtctcggcatggcgaccgatctatcccaatcacttggtttaaatgtacatcgacagaaagattatttagtgttaatatctacagccgatcgagtagatttagtcttatcttgcttatttataactgccgatcgattcacatatgacatcggctcgaaaataaatgatatatcatcggcgactggccaattggctatcgtttatggatttaaccgcggtttcttttgtttttctttcttgtttgcaggatcaaatcaactggcacgctcacgaacctaaaagcaagattttggacctgcactgaagttaagcagattttccaggccagtgtgtgtttttcgcatcaacatgcttttggcacgcctggtgggaccgacaagtgacaacgatgtcaacagaaaagtaatctccatcgtcggcaagcaagccgtcaattcctcttcaaaccaagcttccaaaacctccaggaactaatctaccatcaactagggttgagtccgaggtcaatgaggcaaacattgtcccaggcagtgcagacaagttatcaccagaacaaaagaaagagtttgaattaatgatgaagaatgctcaggagcaattcatgaaatcgttcgtggcaactcgacagggaaaagttgttcaaaaatacaaggtgaaagtggttgttgccgttgaagttggaacaagctcatctcaaggtagtaagagtgctgcagatggctcgggcgacaaaggtgacgggcttcaggacagtgtggtcgaagatctttacgaagatggtgctgaagtgcaagaagaacctgctaggtgcaccaatttccaagaccaagttgattatgctgtacaacatgctttgatcaaccattctggagtgcttgtcaatccattaccaaatatgatcaaatctgtgattgatggcacgatagctgagcatcaaaccacggggccagtctacttgccaggtagtgtctttccaaactataggaacttggtgacaggtaaccagcaaagtacttccaatgtaccaccagtgcagccgacggctgcagcttcgactcatgc

SEQ ID NO: 21116 - DNA, 1198 bp, Oryza sativa
gtatgaatgtctccgagattttcttatgaaaaatggtttaaaaattgggtaggtggacagtactctcttcactaaaaagtttgaaaatgatttattcatttgccaaatttatgtcgatgacataatatttggttctactaatgcctctctttgtgatgaatttagtagtatcatgactaaaaggttcgagatgtctatgatgggtgagctaaccttctttctcgggctacaagtcaagcaatgtcacgcccagatattcccgaatagaattccaagtagaatgtgcattaaaatccccgtccaggaccggccggggtacacaaacgacaatgttgacattcagatccacgtcttacaaacatcataaaagtcttacataaatgcagcgaaaagaaagaaagacaacaggagctaagccttgactagaactgcagtgggaacaccactccacaggcatcctcgacggcacggacgaagcctactcctcggagaaacctccatctgacacatactcgtactctggggttgggaaaaaatagagcaagactgagtactacccactgtactcagcaaatcataccggaataggggcatgatgtagggaattatcaaagaagagctagagtggttcgtttacataatgcgagcatttaaaaacagaagttgaaagatttaaacagttgtaataattaattaatattaactatccaccgtccaacgctattccacgttgcaacaggcccaaccatctacctaaactatccaaaatcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccacaaagaggtcgtgacaggacccttcgcctaaccccctgtaaccaagcgcaccacacataaggttttcccccactcctgcaaggcagcgggcagtcccctatcgtgcctaggtgtatccggaagcgacataggccgtcgcagggcccgccccgttccatcacgcccacccttgcctggatgcgttgactagagaaaagctacactacaagcccagccgttgcccacgctggcttgtggtaagtacgataagggctgcagg

SEQ ID NO: 21117 - DNA, 781 bp, Oryza sativa
cttttttctccaatcatccaatcaataatacactcggcggaatcatcctcggacaggagtagagtattacttcttgaataagaacgcctgaacctgtataaaattccttgtctccaaacccatccactttcctagcttgatagccaccccctttattattgtcgaaatcttgtttcgacaggcggtcccttgtttcttggtcctccaagaagcaaaattccattgcattatccaccgccgaagccgaatatgtcgccgccggttctttttgtgcccaactcctttggatgaaacaaactctaaaagactttggctacaacttcaccaagatcacactcctatgtgacaatgagagtgccatcaaaatagccaataatcccattcaacactctcgaaccaaacacatagatattcgccaccactttttgagagatcatgaccaaaggagacatatgccttacacatgtgagaaccgaaagccaattagccgacattttcaccaagcctttagatgagaaaagattttgtgagcttaggagtgagctcaatatcttagattctcgcaacattaggtgatgggtggttagctaatttatagtcaaacatgtatcactaaaatgtaaattaaaaaaaatgagcttttgtgtcttgagatcactttttggtaaagatgatcttgataccaggaataaagctcaaacatttgccttcatccaaaaaccccttttgtgaaaatttttgcaaaatcctttgtggaccctttattttaaattgggtttta

SEQ ID NO: 21118 - DNA, 659 bp, Oryza sativa
gatgaaaatgggccgattgagctgataccaattgatcatgggttttggctgcctgaaagcctaagtattttgtttgctctaacctgcatattttgtactgaaaattgaaatctatgatcacccatagtcactaatcgccataaagagttgctcactccatgtcaaaaatataagctgtataagtttcttacactgtcttcagtgcaaaactttgacctttaattccttgtatagtattaatatcaataactataaaattgacataacgtgaatgtactttcaaattcaaatcttatgatgccacatgcttgacgctaaacatatgtaccgctagttcaattattagtcaatgtttgcaaatgttggcttcctaaaattgcgggaggcttatatttcaggatagagggagtaattttcacgaccacacactatgtacacattttaatataatatccattgctaaattttttgtcctaatttggttactagcaatgattgttttctcatgttgtaaacaatgtttgaactattttagttttagtaattgatttgacttctaaacaatttatagtttgaagactgcacatttgattggctttactggccccaagcacgccagcctttcaatgttgaaaccctggactacataaagtcacttg

SEQ ID NO: 21119 - DNA, 2855 bp, Oryza sativa
ttcctgcagccatctcaggtatcatggatcgctatctcaatgaactcttcaaatgaaatgctcctcaagatgactgtgaattatggtttcgagtgtgtgtgataagtgaatttgtaagtaatgtaagtctcttttgtgtcaagatatcgcctccatgaataataaggaaggatcattggtccttcttacatttctcgatgtaaattgtaaatgaatataagtgaagaatgttgtaaattaatggattgtgtatatctcaccaacatcttgcatgttcagtgtttttttatttgaaacaagggtttgtctcaaaattttgtgtaaagtaattgaatgatacctttaaagtttcctcttgaggatgaaattatggggactttaaacatgttcagctgatataagtattagtatgaactctcaaaacattaagtaacacaaagatcaaatcaaaattaaaacctttttttccctgataatacataaaatatatatgtacctatgcgcacacaccactgcaaacatcacgctatgcaatttttttcctaaagaaaacatgtatattactataacaaaacttatagttatcgatctcactttatttgactcccccctttgggcgaaaatgagtttcgacagtggcaggaatttcgaattcaaataaatttttgaggaaaaaaaaatggcattcacccaaccaaaatgctaagtgcacaccctcatcagttcatctacctctctccttcactttactctctctctctctctctctctctctctctctctgctccccccggaggcaacggcggcggacgtgctcctctcctcccccgatcgccggcgagcgggttcgccgggggcggcgacgcggccggctcatcccaccggcgcccccacctcgcggcccgattcgaaattttgaaggtagtattcgttctcgcctcgcttagccctccccccttctcctgtggccgcttcacgagccggcgtggcgcgtagattggggatccatccggtgattgaatcttcccccaaggagattggatgggatttgtttggaagggaatagttccacgcgtagtgaggtgtggtcctcctagggattaaccgaacaaagcccttggtttgattccggatttcttcgctgcttggtgcagtactgacattgaggggacttgttttgctagcagtttgtttgcaaaaataattggggattcagttgaaaccccatgcccccacattaagcggatatttgcttcattacctgcaagagtggtcaattatgtagtgttacagggaaattggtctgtagggctataggcacagactgttagctatctactttggctgaatttggtcaggtttctgcacttcctaggttgatcgtaacattgttgttactagtctcactagtgtatgcagggggtatgattagtttataatttctaggtgttcctgtcaagcttaagaatatcgaatatgcgcttatattttataatctaaagttttactggtattggttgtcgtaggcctttagcatgtgtagatagtgattgattgaagaatgcaaaagttcagacgacttccacctgttctgctgcagcttgtttgatcactatcatgcatccctgttggctttcgtatggattgcgtttgccctctgaaactaggaagcttaatgtgtgttacgctgttactgtttgagtagttggataatgaatcccatggtagcactatttgcactccggtttagacatagtgattaaaatggaatttctccaaaactagatctggcccattgcaataagtagaattcacattgaacattaaaactttgcagctaagtttgactatgggacatgtctaatgtatcttctaccctttatctgctttaccatgcaggtggcactttcagattgcctatgctagttcatttcacgctgcatatccaaaatggtgaagctgacaatgatagcacgtgttactgatgaccttccgttagtggagggattagatgatggtcgggatctgaaggatgctgacttctacaagcagcaagctaaactgttgttcaagaacttatcgaaagggcaacatgaagcatcaaggatgtcaattgagactgggccataccttttccagtatccttaattcttatgctatctgcagatttagagttcctgttgaaaaagattattccctcatgattttttttataggtgttccgtgccaattcccaaaagattaactcatggttaccctttttgtggttttaggctcaaatttgaattgcagcagcaaagacaatgattccaactagatatgttggttgatacatacactctgtttagttttcctctttattttaaatttaactgctcattccattgacaacatattcttgctgcttatgggggagtgagtgaattggtgagtaataagtattgtattagacattttacttggtctaccactctcccaatttttgcatcagcaagaacttgtatattctatgccctatatgcatcatctgcctttcgtcatatacttggatgttaatggcaccaagatgccaggaaagttgtgttactaatgccgtatgttaagaaactaaatcatttcttgaattttcatcctgtttgccttgtgaaaatcatttgtggtacacttgttgcaccttgatttaaccaaacagttacatcatcgagggccgtgtgtgctatttgacaatgtgtgactgctcttatccgaagaaacttgctttccagtacttagaagatctcaaaaatgaatttgagagggtcaatggcaaccaaattgaaactgctgcaagaccatatgcttttattaagtttggt

SEQ ID NO: 21120 - DNA, 4239 bp, Oryza sativa
aagacgaagaagttgtatttggataccagaacccaaaggaacctggccaagttgaatgatgagctttatgaggtgcaccagattatgactcgcaattttcaagaagttctcggtgttggtgaaaaactagatcatgagtttgcctttgcaccttatctgtgttatgctgcatcgttcatcatagtttttagcacgatggacttgtcaatgatttctgtgcatatgagattaacttgagtttacgtatttccttgaaagattatcagtgaataggtgagcagtcaaattcgcaaaatcaatttggtttcagcagactatcttgccctaaaattacttgagttgtgttttcattccgcactatattgttgttatattttgtgttttccttcaataggccattttgttgtttcacatcttattaatatttcttagactcatgcttccttttgaattgtttgctccagtacacaccaaagctgtttctttctttgtgttgcctgtaatcccacgctttgacagttttgcatgagtgcttcacttttggcaagacttgttgcagtctcatctcacatttcgtttcatgcttagaggtttacatttcccagctgttgctcagtgaaagttttctgtttgcagaggtgagtgaaatgtccaataggttgatctctgatactagaatttatgcggagaaggcgaaggatctcaatcgtcaggtgtgatcccttattccctttactgcatttgccatctggcaatctcaatctccaagcaactaatatgaaattaatatttcaataaattgtgaattaatattggacatgtgataaatcgtgactgctgtttattcatggaagtcttaagggagtctactcatttgctttctagaattgtgacactttacttttctcaaaattatacatcaacagtccgttgtttcctagaatgatcgatgggcaattgcaatttattttcaaaaaccgtaaaattgtattgcttagttccagcaactccacttcaaatttccttaccttcattgctctttgaggagaaaagggggggaatttgtgctcaagtagtcaacaactaagttggtccttttgcgatcaatttgacacagtaatgcttagaacatgtctacatcctttatttgttaaacatatgaattcctgccatacccccaaattatgttcaccaatgcacgtgagggatatgggaatctctcatgcgttactatgtcctatctatgtcatatcactggtggactgttaagcataacaaacacctgatctgcattaccagtttaccacttcacctgttttcacgtctgtgacaaggctttccttcaatggttttcaggcccttattcgcaagtatgcccttgttgccattgtgattggaatagtactgatgctcttttgggtcaagaacaagatatggtgactgagagtaacagtcaggcctcctgttacggtgctggaacttgagttctccgtgcaccccgaatcgattctggctcaacagatgctttgatggcttatcccgcatctgcccattcaagcgagtagtagtgtagctcttcttccgtgctttttgttttttgtttttttgttttttgcctattcctcccaacaaagatcatccaaactaaacccattgtagtataaaccctcgtcatcgacccagcctatcctgatggatgaagaagtccttgagttcttgcagcaccgatttctggctaattgttgtgtagagtcggcttttcgacctccgaaatggtatatgttctttgcaaactcaccatgtaagaattgatgtttcaggctgatggatggacaaggcacataccatccaaagctgcatggaatgtcttgtgactcagacgttttagctgcaatcgaatacgtccggttatgctgctggagaaaggtcattctcattgccagattatcagcttctgtagtcagagattttggcatgcagtgcaacaacttgagatagaacaacgttaagtatgaagggcctatttgtcttgagctcaaatgctatgctaaatatgatattttttacatgcaacaacttgagattatcttgatgtagaacatgaacaaccttgatgatacctttgagctaaaatgctactgatactctggtatttcaccgtgtcttaagaatggaacatattacatagtatatcatcatctaccattacaccaccagtttggagctcagaaacttaacgggaatgcttggtttctgcagaatttaaattaaattacattctttcccgcaaaatttcggcttaatttggatttcatccaaatccaaatccatagtggtgttcagcaccggaagccgagcaccttgccgtccaccggcgagacgccgacgcggcacaccttggccgcctcgacgtggtgcgtcagcacacgcagcacggtcaccctccccttgaccaccagcagcgagtcgacctccatcaccgccgccgccgccgccggctgctgctgctgcgccgaggcggcggcggcggcggccatctgctcctgaggcagcgacggcggggtggccgcggcgaacgccgggacggcgaagctggcggacatgtccttggtgcggccaccgtcgatgaggccggcggggatgtagacggagccgagctcgccgccggcgtaggcgacgcggagcgagctgtcaaagtgcgcgagcggcgcgcggttggggttgcgcacggcggccgtctgctcgaacgtgaacgccaccgtgccgttcgggccggacgcgaacgccggcagccgcaccgccgccaccgcgatgtcgggcgggcgcggccggaacagcacgaacagcgccgcccccgccccgcccaccgccagcgccaggaacgccgccgccacgaggcacgacgccagcgccgacgacgacgacctcgccgtcctcacgtgcaggtgcagcggcctctgctcctcctcgtagtagtagccgtgctgctgccgcaccggcggcggaccatgccttaccggcggcggcccgggcggctgcatcggcgggggacctcgccgcgccgcgccgtcgccggcgatggcgatggccggatcgcgggttcttggcggcggctgcatgcgtggtgagtgggaagtggttgctgctggcgggcgtgcgcgtggcgagcgcatttgttggcttgcgccggaggtggcgcgccgctttaggagtgaatgatggcatggagtggttgggggcggcatgtgctgcaaaagtggagagcgcggcgaagtggaggcttctcgcggcagcctccgcagctgctgctgtcggctgtcggggagaggagagagaggagttctagtttggagtgagatcggtaattttggtagtggttgtatcgtactccctcctttccctaaatatttaaagccattaacttttttaaagccattgattttttttaatatgtttgaccgttcgttttattttaaaacttttgtgaaatgtgcaaaactatatgtatatataaaagtatatttaacaataaatcatatgataggaaaaaaaattaataattaattaaattttttttgaataagacgaatggtcaaacatttttaaaaaagtcaatggtgtcaaacattttaggatggagggagtatctacgacctatgtgttggagcggatatgaaagggataatttcggacgttgaaaatggtgggggtcgatatcgaatttgttcggaaaataattaaaattctcagatgctgtgtgtaaataaaacaatgtcaagttgttcgtgcacaccatcaaccattgtgtggggttcacatcatctgccattgaggctaacggcaaacattttgccgttgtattcatccgtgccacacattcttctatcaacagctgcatgaagtgatcccactattgtgattaattatgaactactaataagcagaattacttatttctcttttgaaaaaaaaatcagcaaatagaatacgcactcggcggcaaagcgtgcgagcaatcaagcatagaagcagagcagagcaaaatactgcagcaaagcaagcttctattatactgagagctatccaaatcctcgaacaatagtacatatcttataaaatactatttaagtattcatttgacaaaaatagcattgccgcactactactatgtccatacaggtattttttatccaaaaactagcagcgaaatgaagctactaacaaaatccttgagaatac

SEQ ID NO: 21121 - DNA, 12305 bp, Oryza sativa
  unsure (1)..(12305): unsure at all n locations
tttgttctcacacgctttgccgccaagtgcatattgtgttttctgattttttttaaaaaagagaaattagtaattatgctgattagtaggccctaattaatcatggtgggatcactgcatacagccgttgatagaaggatgtgtggcacggatgaatgcaatggcaatgtttgccgtaagcctcaacagcagacgatgtgaaccccattgtgtggtgggagaagtgcttagggtcttttggctagctccacatggtggtgggttagccgaccaaagttcgaagcctcattcattctatttatttgatattagatcattctctaatattcacttttttttaaccatgtgtgtggtgggctggtgtcgttgctacgtaccttgaagatcacgagaccagagcctacatcagagattaattaggaggtggaaggggaagtgctgaaaagggtttccctcgcggctcattgcatcctgcgttatgtcggtgcgtgacggtagtatgcggtcgtgagaagagatcgtgagagctcatgctgataatagggtaactgataaattgggctattgaatgtgtcaactcataatatatagagtagatagtgtgattatgcatatattatttcataggatagtccgcatctattgaattttagggataccatattcgtattcatatcatattatttgaatccgtatccatattcgctaaaatttttataaacccatactataccgtcattttggacagactcaacgcagaactaacatacgatccgttattaccctaggaggagatgtgacgacgtgtgttctaagggcaaacgaatcctggccgttggttcgatggttgtattgatagatgcttcagcttcacgttcgttttctttcgtgtcagtgaagctgttactgtcgtgttagctagactttgttctacgctgaactgctgatcagctgatcagcacagcttcactgattagctgggctttgtcgagcaatgtgggataaacttgcaccgcatttagttctaaacttttttttcaaacttctaattttttcatcacatcaaacctttactacacacataaactttcaatttttccatcacatcgtttcaatttcaaccaaatttttaattttagcatagactaacccagctttggtattacgagtgtgacttgactaagcaaagcaaagcatagcaaagcgacgagcgaaagggaaaagaagttaggacgcggactccaccaaacaggaaattaacaggaacggagttggggattatggctgatgaggttcggtattctttttgtagtaatggtatttctttggcttttttttttgtgtgtttcttttgggacgcaaagctctcgctcgcggggagcttagtgtgtaagcaacatgccgcgttgattgcgccttcttttcccttgggaaaaagaggccgaatcgtcgtcttctttcgcttgctttttggcaaggatgctggattgctggccacctcacttcgaaataataaaaacaaagtaggagtagtaaggtagacggtaaaaaaaaaaaaagaaaagaaacttcgacgcacatctggccatgtgaaacaaagaagaaataaaagcaaaaaattccgttgccgggactcgaacccgggtctctcgggtgagagccgagtatcctaaccagctagactacaacggatgctggtatctattcctgcattatacaaattaaccatggcctgatctgatccaaaccataaacacgggtcgggccgtacatccagctgatgcattatgggctgcacgcacactcgtcacagtaggaaaaggttaaattgaggtccctcatcttgtcatcttgtcgttgagtttcaaaatcgtctctcaactataataccatatataacttatccctaatctttcaaaggtatcagcgtcgtgttacgacccgacgcgccgaacacctgcaggatggacaccccgtcgtgcccgatggcacgtacccgtatgcctcgaattgccacaccccagaagtgtacgtcttctgctcgaaacaacaaataaaatataataatcacaaaattttcaagaaatcaaagacgatgaaattcacagcatggaaatttagcccccattgttcctcgaaaaaaaaatagcccccattcgttttaaactgtggaggacggatggtagattattctggttttgttacaattatttaagggcacaaatgagtgaattaacattgaacatataaagtattccaagaaatctgtatatatagttttttctttagaaaaaaaatgccctacccaccgaataaggtgctgtcaaatttagaaatggctccaaaactaatctttaaccataaatctctcacatatataaaataaatttctcatatattataatgtttataagaaaaatcgtaatcataggaaattaaattaaaatgtcaacccaataatattaattgcatcaaataaaatttaatttataataaaataattattggccaaatgtttaaagcgttgaatattaaaatgcgcgcgccttgttcagtggaacgaatggaagcgcggaggaacgaaacggtctccatggcgcagttgtcggaagagttccatgcctagctggctgctagtcaatcggtgaaggggaaggctagggacacgttatatatgatactagctgaaaccccgcacattgctgcgaaaatttagtatgataacaataaaaaaataatgtgtaagatagctagataatatcagattaagtaaatcaatatggtttatgataatttaaatttaaatagtatgtagaatggtgattcaaacgtaaaaagtaaggtggtatgactttatagaagaagaaaagtagggagatagtttgtaccgtagattattcatctcaaggctaaaaacaattaatgtgatatgacttaattagaaaaaaaaggagaaagataatttggaccatagattaatcatttaagtactaactaagtaaggatgaactgtataagtatataggatataaaaaaaacataatacataaagatatagcatgtatcaaaaaaaaacataatacattgaaacattatgtgaattatgttagatgataatttaacaggtttgtatttgaaaagctcttaaattataaaaactataaaaatatagcatgtttgcatgatgtttaaatgtgatcattgttagtggatgatgatgtggcatcttgttaattagtggatgatgatgtggcatcttgttagtgaataatgatgtggcatctttgcatgttaagtttaaacagttagtgggggataactttataaaaagataggattctgaaccttcagggacgattttgaaactcgacgacaagatgagggacctcaaatgaacttttttcccgtcatcacagtaccttcacggcccatccattacgggcttgttggccggccgttctctcttctcctcgtcctcctcgtgcggcggccggggcgcgcatgccaagctgcaacggcaaatgtagcgacagcacgccggcgaccacgcacgtacacctacaaatggcggccgcgcgccaggaagacgtacggcaacggcaagacgtacagagagcggggggcgtttatattcgaattcaaggagcagcagcagcagcttgagctatcgccatggccgaccaagccaaccagctcagctacaaggccggcgaggcggcgggccacgcgcaggcgaggagggaggaggcggtggagaaggcgcacggcgcggcgagcgccgcgcaggagggcgccgccgacgccgtcaagaacgccactggcctcggcggcaactaggtcggccgcgcgacatggattcatccaactggcgtcctccatcgcaaagctggacttaactgatgtacatcttcttaattgtcatgtagcattccccttaattgtgtccgtacttctttaaaatgctctgatatcacttgttacagaaaagtagaatatggagctctctatttgggcttctttaatttgcttttcaattgagccaattttaacatggacattttatttatgtaaattttaacatggacattgtccaccagattagagttaccttaattttgctttaaatttgtgcctgtgttctaacagttgcattatgcttgtaaatcatgagaatctgtcactcttcaggctcacatcattgtgctcaagatcaactcttccaagggctccacattgcctcaccgcccaagttcaatcttggatctggtacgtgtgatagctaccttctagttctactttgtcagcaaaagaagctgcacctttggaattttttttttttttggggggggggggggggtagttgggaatacttgggataaaaaggctctgcttgctttcaaaaggcatgcactgatcgatggccttttagctaagtaggaaatgacagacgaaaacaccatggatatatcaacatgaatgctcgccttccatgcccaagcaagcagaattgaatcgcatgagaaagcatgggactatgtacagatgattgcacatgattatgtatttatgtgaaggtttggatccaattgtttatgtttagattttatcagttgtcattgttgataacgatacaatgctactgctttgccgggaaaaaatagctgaagattgtcgaacacaaatacacaattattcccctacatacaagataaggagcacaaatacacgatattttagctaagaatttgtgccaggaatttagtggcaatagcccatcaattataagccactctctgatattctctctttatgctagcttttggttctttcgatcttctagtggtaagccccacacccatctagcaggtactatttcctggaaatccaatgcaaagaaaagcatatattctcactgtgatattgtgagcagcctaagtgacaaccaaaaggagctttttggttggcatattttatttccagggtactagctagtacactattttcatctgcactctcattgcttgcagggaccaagtagttggacaaacaatttattttctcattacaccaacattgcaaaaaatatcgttattgtataatatttcacaggtttattcattcacattcatggtgtttttgtgcccaattcagaattctcatttctcaatccaaattcaagcctacaaactaatcattaatcataattttcctgaatcagttagcatgtgtagatgattacatcatacttgaaaaattacacctacttttactaccacctatctcccaattagcaaatgcaacttattggcttaagctaccatgagtcagtgagagtcgcctcacacggtcaggccggctacgaaggcgacgccggtgggcggcagccaggagtagccgccgatgaacctcccgacggtgaactccatggcctcctccggcagcttgatgacgcggtggcccggccatggcacgcgcccgccgaccgccgcgccggggccggagttgcggtactcgccgtagtagagcgtgtccggcgcgcgccccgacgcgtcccaggcgagccagccggcggcgtggacgtggcccgctatgtacgacatcatgtacaccgccctcgagtacggcttccatggccgcccgaggtacgtcgccgcgcggccgcgccgcgccgccggcgcgagctcgagctccggcgaagggaggaggcggcagccgtgcacggagatgccggtgctctggttcgggtcgcgccgcccctgcgccgtgaccgtgttctcctgccccggcagcggccgccgcgcccacagcgtgcagttctgcagcaccacggcggcgttcccgaacacgaagtccaccgtgccggcgacgtcgcagtcgcggtagaactgccgctgcgcgtgcgcgtacagcgtgtcctggtaccccagcacggcgctccggtacaccaccgcgtggtcgccgctcagcagcagcgccaccgcctggtgcctcgccgcgccggcgcggttctccaccgtcatgtcccgcatgatgaaccccgccccggccaccgctgcggcgacgacgaagaccgacacgacacgatcagcaacgtgctccgccgccattggtaacagtgctacgtagtacgttacgtacctagcgtggcggtgtggaaggtggtgtagttgtcgtggacgctgcggtagccgacgacgacggtcttgccggcgccgtcgccgacgagcatgaggttggtcttcttgctgccgatcttgacgttctcggtgtacacgccggccttgacgtatatcacgacgcggcgacggctgtgctccggcgccgccttgatcgcgtcgcggatcttccggtgagtccccgtgccgtccttggcgacgaccatgtcggcctcgatctcggcggcggccgcctggaggagccgccggtcgttgtgtctcacccaccttgggaagctcccgtcgtcgtcgtcgtcgtcgtcgatggtcagtagccgtctgtggagttggttgtggacggggacatcagagagctcgccgccgggccttcccctcgcggcgaagatggcgaggctgttgctgaggtgttccccgaggttgccgaggtagccgagcatctgcggcttgatgcggccgccgtcgtcgtcgccggcgtcgccgccggcgccgacttcttggaggctgtccatgcacgtgtcgtggctggtgagcgccgcgctgagccacgtcatgatgtcgtcgtcgtcccgtcccgccgtgtcggcgtcgaccgagtccggcggcggcggcggcgccgcgatggcgccgaccgaccgcgcgaggagctcctccgcggcgtcgagcatctccacgcagtcgccgtacgcggcgcccgaccgcgccccggcgagcagcgcggcggcgccgccgagcgccgtcgcgttgtacagcgcgtccaccacgcggcggtgcgtcgcgttcagcgacatcggcacgagctcggcgtcgccggcgccggcggcgccggggaacgccatgagctcgccgacgcacagctccgggtacagcgtcaccccgcacgtgcgcgcgatcgcctcggtcggcgcgcgcccccgtggcgcccggccaccgccggacgacgacgtcatcctcgacctccccaagacggcgatcgccaccgccacggcgacgccgacggcgagcgccacgccgacgatgcacaggacgacgataaggcggcggcggtggcggccgtcggcgcaccggagccgaggctttgccgccggctcaggcgagccgagcgtggcatgggccatgcaaaatctactcgcaaatctctgttggtgtaagtggagcaaaagcgagacaagtgaagcatagaatttatagctgtgaggagagtgttcgctgagttagtttcacactggccactctttgcttcggaattcaccttttttttttgtaatttcggtgattttcatattgccaagttttgggtgtgtcgactggatttggtgtgcatttagtcatttacacaccgattttaaactacgaagggaactcatacaattcgcaatggaaaactcaaaattgtgatcagacacgatagggttttatgtacgcatgttcataagaatgagtatgtgtgcgctttaatgtgtaattaaaaaaaatgtgcaaccgaagcaaatagaaaaggataagggccccattgaattacaggaatgaaaaaacggagaaataggaaaaacataggattctgacaggaatgcaagtgtaaaacagaggaaatcaaaacacaggaaaaacatatgaatgattgtttgattgggccgcaggaaaaacacaggaatttaaggagagataaagactcaaagtattctttccatgaggttctacctcatgttaaatttcctgcaaaacttgcataggaaaagacaatccataggaatttcataggattccataggatccattcctttgattcaaagggctatataggaaaaaatcctataggaataaaattctctgaaattcaggctgtgtttagttcagcgtaaagtttggattttggttgaaattggagatgatgtgactgaaaagttgtgtatgacagattgatgtgatggaaaaggactaaagtttggatccaaactttggatctaaacacagcctcatatgaatttcttttgaatcaaaggggcctgaacctatggatgtgatgccaatagggcaataggagtaaatggtgatgtggtatcgcattactcccatccgctcgtgccggcgactcggcgagtgcttagcttgttcgttgccagatcggtgtgtgcgtgcgtgcatgtgcaatcatgcaccggccgccgccgcttcaccgacaccggccggccactggtaatccgccattccggcagccgctccggtggtccgtaacatggccgcggccacctccaatccggatcgggctccaatgcttcaatttgtttggtttgtgaaggattggaggccgctccaggttttatcaaggttttgggggaaaaaagaacggcaatgtgtaagttccaaaattatatagtaattacattacatgtgtaagtggggtgtaaatttgtataaagtatagtatgcatgcgtgtaaaaccttgaactaatgaagacgttaagttttaattaatcatgttgacagccgtaacgttagcctgccatagcaatatgcacggacatgattgcattggcacgggacaaaggaaatcgaacgcttcaaaacaccgactgtgatggaggagaaaatgtgtcgacataattatagcgattccgtaaatttgttactccctccgtctcttaatataagggattttgacattttgcttgcactatttgaccactcatcttatccaaaacgatatatacgaaggctccaaattcatgaaatttactccgaataaaacgaggcaaccgcatcttctctcccccggatctctcaattaattccacgagtgtgaacacacaacactgacacacaccacccaaaaccctagcgccgccggccacgccgccatgaatcgccaggcgccgccgcggcggaggtccgcccgcatcgccgccgcgcacggcggcggcggcggcgacacgacgctgcgggagcgcatcctccggcggccagacggctacatcggctcgccggagaagcgcagtacgcagacgttctggatcaacgacggctactacatggtgccacgcgaggtgacctaccgcccgggcctccacaggatcttcgacgaggtcctcgtccacgccgcgagcaacaagcggcgcgacccctccatggacaccctctccgtcgaggtcgacgtcgtcgagcgcagcgtctccgtcttctataacggccgcggcgtcgtccccgtcgagctcgtcgacgaggagcgcggcgtctacgcgccggagatgttcttcggccacctccatgacgacgacgaagaggatgatcagaacaaggcgacgaacgacggcggcggtggctacggtgtcaagctcgccaacctgttctccacggagttcatcatcgagaccgccgatgggtgccgcatgaagaagtacaagcaggtgagtgagccaattctgagcacacactctctactctctctcggcagcgtcacaccctcacaaatcaactccactgtgccaaatttgatactaccttcgttttttaatatattgatgtcgttgattttttttatgaacgtttaatcatttgtctcattcaaaatttttgtacaaatatatataaaaagaagtcatgcttaaagatcatttcatgatagatcaagtcaccataaaataaacgataattacgtaatattttgtagtaaaataaatcatcaaatctacctaactgaaaaagtaaatctctcaaagcaacttggatgaaccatgtaatgaacaaaacagcaacttggatgagccatgtaatgaacaaaacggtgaccatccgatacagaaaacgacaaaacagaaatgacaaatcgtagccatccgttcaaatgaagagccttcctgaaggtaaaaagagagagatagtagtagaagaaagaggattaaaaaaaaaggaaaagaaaaagaaacaacgctccgcctcagctatcgcttagcaagcatgatcatgggatgggatcggttgagttcagtgggccgaatgatcgtggggttaagcaacatgttcaattaaatctaaaagagacacaaaagaaaaaaaactacttcctccgtttcacaatgtaagtcattctagcattttccacattcatattaatgttaatgaatctatatagatatatatgtctagattcattaacatcaatatgaatgtgagaaatgctagaatgacctacattgtgaaacggagggagtattattaatttgcaactcaaaaaaactaatcaacgattggacaaatcaaattccaataaattaaattttggaaaaccgcctattgtttcctgtcaattatattctcttaacacctattcaaatatgtaaaataaaattacatttgctaaaacatatgtatcacaagtaggaggatagacggaacatacaaggagaataaggtggtcacgcataagtagagatggcgaaaattcggtggctcgcacagtacagcaactaataatatgcatggttgtttatactcaaattttaacatcaaagaacttataaattttgattccaccgtgaaanaattaaaaggacccatgcagtgacaagacgatgttaataacagagtccataaagtagtatatcttattaaaaagtcaacggcgtcataaattggaaagccggaaagagcatgtggcatagtttggtacacctgatactgtttttgactcttctaactgttagatcctgcacactatgaccagtatctcctaggatcatgatatgttatatttgcctataccatgaccagtatttcctgggatcatgatatgttttctttgcctattccatgaccttgttacttggcaggggttatcggctttgttgttgatatatactcgctgtcatttatttgatgtccagatctgatccagctgcttggttggcttttggaggaatgtagttgccaggtagtagtcaatgagtcaaaaaactctgtgtaagtctatctccatttctactaatggaaatgggaggcctggcctcttgctaaaaaaaactcatcgtttataggcatgcaaattctgtattatcaacaaattttctgagttttagatgtagttactactttcatggagcattggataggtcagtttactatcaaaacaatatagatcatgatgttacttactccttgaatactttaatttccaggttttctctgagaatatggggaagaaatcagtgccccatattacagactgcaatcaaggggagaactggaccataatcaccttcaagccagatcttgctgggttcaacatgacctacctcgaagaggatcacgtgacgctcatgtggaagagagtggttgatatggcaggaattctaggagactccgtgcaagttgagtgggatggcgtgaggctgcgtataaacagcttcaacgattatgtgcgcctgtatatcgattcccctgtcagtgacagatcaggagcagggttcccaaggttattgtgctgtgttgtttcgaacgagcatattagtttgttgagtgatcgaaatctatccataatggttttgtctttttaattagctgaattcacctttgccttcttgatcgatttcagagtttacgagaagttaaatgattggtgtgaggtctgtttgagcctgagtgatgatggacactttcagcaggtaaatgttttggttatgtttatatcagggtagcttcttagttaaatgccatggttgttgctgcattttactcctgttttttatggttttgcaggtcagctttgtaaatggatttgagacactaaaaggtggaacccatgttgattacgtcacggagctgattaccacccatctgatgaaccttctgaatgagcactatgaggagtgtaacttcaatgtagatgatgtgaagcgctatctatgggtcttcctcaatgtgatcatagacaaccctaccttcgattcacagaccaaggagacgctaactacacctccaggaaggcttgggtcaaagcttgagcttcttaaaagtttctcgaaaataggtgtgtgcacatctgacgatgagtcggctaattttggctgactgcattatctgcagttgattaggctttacagctaatggtaattaacgcttattatctcttgcaatta

SEQ ID NO: 21122 - DNA, 1200 bp, Oryza sativa
agcttttgaagaacaagacatctctttaggggtctcagcctgatagtgacattgacagctaattgagagatgccttctgttttgattgtgagtgtggttttgcacaaacactttacggtcatcacaagtcccactcgtgggtaggaatcatacaataccttggtgtgattttgcacaaacacatggcatgcatgaaccacatttgacttaacccactttcacaaggtttagtctacctcttaatgatgcatatgcatatgacttaatattggcattaaatattccattcataaatggctatacaaagcaaaagagaaaattcaacatatcagtaggtcttatctagccatatggctcgatcaacgccgcttcgagccagtgtgaccaagtcattagcatgactaagactatagggaaaaacccggctattacatgaagtatcgtgatgccactcagtacatctggtggtggttgtggtagcatatgctaattttattgatggatggataagacgaggtgttgcttgctcaagcgataggagaagcggctgctttgaatgtttcatccattactctaaacttgtcagcaggtgcggatgcgtcaatcgcatcagcagcaagcatgaaggcaatggaaactgcggcaacttgtctcttttctcctgaagccatggctgtgtcgagcatagtagcagcaatcccagccatcttggccgtggcctccttagtttccgcctgttttgctggtggggcagcatcaacaacaccatcgagggcttttctgatgtaggagcatgtctcacttatgcacatctcaacattggaggtgcaatcctccgttggcactaacatggccactttgaagatatctatcattgtcgtaaagttgtatggagacattccaataggaaaggcaccaggaatcttggtgcattccacaggtgaggctagcatggttgacactgtaataacgacaaggattagtgtgattaccttggccatcgtggaatatatatcccaatgatttgatgatggatgattcaatgcaacaagaagtagctaacctaagttgatgagctgcttgctattatgaaagtgggatgtgattgctttaaatagtgtaaggcgatggcctaggaccgcaggagctttgtggtcaaaaattagttggttgcatgcatatgtgccaagtctttgggcc

SEQ ID NO: 21123 - DNA, 662 bp, Oryza sativa
cccagaggtcttcttactctaccttgcagttcccggtgttcctctagccaaaatgcaagtacttgagtctgattcggttgccgcagtgaagcttcggatccaaaacagcaaaggatttgtggcgagaaaccaaaggttggttttcgaaggcagagagctctctcgcaatgatagccatatccgtgactatggggtgaggtatggaagtgtgcttcatctcgtgatccgactatcagatccacgacgaaccgctgtgaggactgtttatggaaggaagtttaaattccaagtggaccaacgtcgaaatgctagatatatgaagcaagagatttcaagaaatgttgaaagtcccaatggtattggagagagcatgactttggtcaatggtgaaaagcttgatgaaagcacattaatctccaccatttgtgagaccaacacttctgataccgattttcttgcaaacaagtcagaaaattttaatggaaatgaaatagaagaatcttttgagcaattatccatttcttctgacattggaaacaatttacaatttgatgatgccaaggagaaatatcccctgattgaaccagttcttgtcaacccaagtgttacccttactccaaaaattacgggtatgatcgaagctacacttgctgggctagaaa

SEQ ID NO: 21124 - DNA, 22388 bp, Oryza sativa
  unsure (1)..(22388): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcattttatccttccagcatattcttgtgcaatctcatcaacaattcggtggaccattctgcagggtccacaccatgaggcccaaaactcaataagcacaggtatatcactgcagatcacatattcattccaagaacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaacaatgttcaactaggccttcacataacaattccattggaccatgtgtacctcatcattctcatccttcaaagaccaaaccggatgggcaaaaactcatctcgccctgcaatcccctgcatgactgaagatctgaaagttggtagggcaagaatgtctgaatctcctacattcttcagggaacaaggttctcgcagcaagcaacgcctccatatccaagaatctcacttacgtttgcacggtagaaatgatgaaaaaccaggagcttttcgcaaaaccttgatttgttcgtctcgagctgcccatgctgctgcgtcccggtgtatcgtaccatcagattcagagagagcacacttggtttcttgtctccctgatcaagactcatgaaatggaatggacacatgacgaacaccagagaacaaaaccgcataggcaacagctacaaagtcagagagaaaacactggaggatgccgtcctggaagatcttcatgttctgcacctgcagaaaatggttgtgctcatataaaacttttgcgacaaaatctgtaaaatggaaaaatgcatgtggtcatcggttcacatacacatctatatttgagtgcagaaagattatttttaaaacccattttttataaaactgagctcttcgtacaaaagtcaaccttcactaaaaaaaccaagtggagtaatttttttatgggataaaaaggcttagcgcccagcttttctgggaagctcaacgggattttttaaaaatatccggcatttgacacttgaaacaagacaataagatgacaccagctttgccacctcatcatcaaactacctatcagcacccaaaaaaaaagaaaactccatcatcaatatgtgactatgtgagcagtgttagatgctacaccaccagatgacaaaaaaaatccattcaaatgttttgtttggtagttcagactctctgaaaaagaaaaaaaactactccacaaaactgatgtttttcctattggattaacaactaactggagatcacccaacgttagaaataaagggctcgtatcctttaccataatgacatttttatcataggcattgacatataaagcaatatgaggatggaacctacatgccactgactgtaatgttagtgcaatatgcgatgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcgccgccgcgctcccgagcaccacccacccgccacgcccgcgcccacgcgccaccagctacgaggcggaggcgtccccagtgtagcaccaccactatggcggcgcggcggaggcacgtggcggcgggggcgggggcggcggcgccggctgcgggggagtgggcggcggtgacagccggtggcggggctgcgtgggcgttgtcgccggtggaggaggtcgggacgaagcaggagctgatgcggcggacggggctgccgccgcgggacctccgcgcgctcgacccggcgctgtcgtcggcggcgtcggcgtcgtcgtgccgcccgtccgccatcacggggcgggaccgcgccgtcgtcgtcaacctggaccgcgcccgtgccgtcatcaccgcgtccgaggtgctcgtcccgtccccgcgcgaccccgccgtcgcgccgctcgtccgggagctccgcgcccgcctcgccctcgccgcctccccaacccccgcgccgtcgccgtcgccgccgcaggtgacacatgcatgccccccaccctaccttccttcttgcattgcatcgtacgtcttcttcttaagcaaaagctctgatctctcactccttttcttttcttttttgaaagcatggcatggcggtggggatggacgggagcatctcgccatcgcaggcgagccgcggcggcgaggaggccgccggcaacggcaaggatggagaagctctgggaggaggtgacaaggctctgccgttcgagttcagggcgctcgaggtgtgcctcgagttcgcctgcaagtctctcgaacatgaggtgtgtgttcttctaccttgtctccatgctttttacctgcagtgctatctccatctccaattctccattcagaattggatggaaatgcaaccaatacctgatctttaagtgcagtgtagctatgcataacatgcattaaaaaaaaagagatttgaagagagatacatccctccaaacatttttcaagaagaaattataagcgtattgaaaattaaacacggaaccttggagttataaccacttactcattgctactgcactatcaattgcatctcaacatgcaatttgcttgggttgaatttaccatgaatagtgagtggctcaccaaactatgcaaaaagttatgcattgttgtatatttgtattaggtttgacattgtaattgtagacatatgttcaattcctatccacattgatttttctaggtatgtcatatgatcttttaacactcaactagacgtccactatcagtatcttgcacatgtatatgtctttccttgctttggtttatatcaccttcagaaggggaaaaaaagaagtggatttgtaccttgctacatttcgacaattctttagcggcatcccttctaatccaaccttttttattatatgaaaatgacttttgttcttctgccctgcaaacatgcttctccgattttcatggttgttgagatgatgctaagtatccatgccgtgccggtaacattcagtcatgtgtctcacccttttttacttcctgatagcactataacaatgtgaagacaaaattcatttctcgagcacattaaaacggtagtgtgtttagcaacttagcattcaggcaattctgcactgaaattgcagttcctaagaaaaatttgcttgatacatgattgcatcagacttgcacattggagaaagaggcatacccagctttagatgaactcacctccaaagtcagcaccctcaatcttgagcgtgtgaggcaaatcaagagccgactcgtcgcaatatctggcaaagttcaaaaggtcagcttcagtatatataccacaagcatatgtgaaactgaaattacttcctccgtttcacaatgtaagactttctagcattgctaatattcattaagatgttaataaatatagacatattaaattcattaacatctatatatatgtgggtaatgctagaaagtcttacattgtgaaacggagggagtaacatttatgtataccatggatcagatagtccattaggagtaattctgaagtgtttaagtaacattgccatgtgtatctcgtctgacaggtcagggatgaactggaacacttgctggatgacgacatggacatggcagcattgcacctaacggagaagctcgcttaccagtcatcaagattcgacatcgataaagaagcaagcgagctcgaagatcacaggtaagaaatttttttcttccataggttgatgacacaagtcgatatgcttcatccaaccgttgtcaacatgctacagatgtgtcgtctgaatgtctgaagctctgaatgcagcagcagggatgaagaaggagtcgagggaggcggcggcggcgacggcgacgacgagacgatcgccggcggcggcagcttcagccccaacaccgacgagctggagatcctgctggagtcctacttcgtgcagatcgatggcaccctcaacagcctctccaccgtgagtagttcctctcgccgatgaacgtcaatcatatctggacgtccacccatttattgtatgtcaactaaattattataatttttttttaaaaaaattaataagataaatcaatatataatatatcattccacgaatatataagctatcaattgtaacaaaagtgacaaataaaactcaaattagcagttaaatttgtttttttttacaacttatagaagtagaatttacttctataatttaaacttatatgtttgtgaagtgatatattatttattaaactatatgttaatttttttataaacatttagtggacatgtaataaacgggtggacgtcccctagagtgattagaatccatctcgatttttttataaccactaaatgacctgcattaaacgggtagacatccgctcgagtcattaaaacagattcccctctctcgccattgctaacgaaggtgaaattaaccatctgaatttatctctctctctctcacggatgaaactgaagctgagggagtacgtggaggacacggaggactacatcaacatgatgctggacgagaagcagaaccagctgctgcagatggggatcctgctgtcgacggggacgctggtgtccagctgcgccatcgccgtcacgggggtcttcggcatcaacgtccacatctccctctacgactcccccgcctcctccgccgccttcccgtgcgccgccgccggcatcgtcgccggcagcctcgcgctctacctcgccgccctcctctgctacaagcgcgccggcatcctccagtgacgttattactagtactacatgtaaaagaaacattgtttttagtattaactgtgaccatgagtgattaagaacgagtaattatgcgtgtgatagtgtgattacggtgttctaggcctctttgtttatatttattattactacctctatcccataatataacccataaaaaatgcatggtcaaacttaacacggtcactaatactaatttttgtcttataatttctcatatattataataaggattatagtaataaaattataaccatatgaaagtaaatttaaatatcaattcaatgatataatttttagcaagtaaaattcaattcatactatacacaaaatattttgaagataaaatctcaaaatgtgaacacctaggatggagggagtagttttttttttaagtttactacttcctccgtcccaaaatataagaactttcggttagatgagacacatcctagtatgacgaatctggacgaacgcatgtccagattcatcgtgctgtactatgatgtgtctcatccaaccaaaacttcttatattttgggataaagggaatatgatttataagccgacgaatttaaaaccatgtggaatgacatctctatatttgactatcttacgctattttttttcaaactactactccctccgtaccaaaagaaaacttaacttatggagtttgaattttgtcccacaaaaaaccaacttctaccatactacctacccttagcaatgctttattacttcgataccatttacctattttaatgatgtggggtattttgatcatcttcactctttactactgttgcattgggatgttagggttggattttacatgggatagagaaagtaacttttagaaagtaatataaaaatgatttatggctttaaataagaaaatgctgtttatctgtttagatgacttttcggttcataataaaccgatttataagtctaagtctatacaaagagtattcagggttggtttggtttatggcttaaataggcattaccaaattttgtcagtgccaaattttgacaagttttggcatgattaattttggtaaggcaaagttgtgtttggattgaagccaaaatatgctaagtttactattgaaatggcctattttcttaggcatgtcaaatttcgggttcaaaccaaatagacactaacactattgaaattgtcaaatattgataagtctaatttagacctcaaaccaaaccaacccttggtgtacaggagcttaatgatgaacactctcactgacaaccctggcccagacgtgtgtgccccaactgtcagtgtgtcaccaacaacccagcatctacggccccacgtgtacattccatttttctcctgagcgcagcgatgacgacgaccaggagctgaggagcagcaaaaaagaaaaaaaaatcgattagttcacgcaaaacccaaaaacgaaaaaaaaaaaatcttcattgagtgttaactacggaaaatatctgacgaattcgtcgcgaaatttcgtcctctttttttcgtcagaaacgaactaagcagcggggatctcgggatagcgaatccccagattcggactcgatctcgctcccctccgatggtccgtctcccggctgccggcggcgacggcgacggcggcggcgacggcggcggcgtcctcaacctgacctaggtacgaacaagtctcgagctctctctctctcttttttcccccttacgcatccagtatagtttgcgtgatctgatcgtggcgcatctgttcttggcgatggatggatggattgggagcagaaggaagaaggtgtgaatctctgctttctcgcgcgatccggcggcggcgggatgcagtaccaccagggcggcagccgcatgccgccgttcgcgcgcggcggcgcgtacagccgcggctacaagcagctttacgcgccgccgcagcagcagccgccgccgcaggacaagcacgaggtgctcatggaggcgggccgcctggcggcggagtacctggtggcgaagggcgtgctgccgccggcctccctgcagcgccgcggcgtcggcggcgggggatgggtccagctcccgcctccgcccccgccacctccgccgccgcagggaaccctggcgttctatggtgcccagaatggccggcggcggttggatgatgatgatgatggtaatcctaacccccgctcgcggcggaaccgcggtggtgagaacaataatgatgacagtagtagtagctacaatggtagagggaagaggaaattcggtgcttacagtaggcattcggattgggggagggacaaggggaggagtagggggaattcggatagccggagttacgatgatgaggatgatgacgggcctcctggttataggagagagcggcgaggtggtgggagatttgatgatgctgggagtagcatgtcgggggtggcagcgtctaagacggaggccatgggggagtcggagctggaggatactgggtcgaaggtgggctctagcagtaatttcaggaaggatgtcgatccgccacaagaagtggagggcgttgataagttgaataagattaatgaggagagtaatccatcaaattcagaggtggtggagcaaatgactaatggtgagagcactagtaataatgcttcttgtattgttattgatgaggaacagacgaaggcaaaatatttgcctgtgccctcagatgacaaggtttcagatgagaagcctgacgatagtagtgttttgaatgagaagattgaagatgacgagactttagctgagaaagctgaagatgataagacttctgatgagagggtaccaggtgtgaagaataacttgcgtgatgattgtaataatttgctgagctattgcagttatccaaatgtaccgacaaggcggcgatcaatagttgcacacaggaatgcagcaccagcccatagggaagttgctgttgccgaacagattgatctggtttcctctgaagatgaaacccatatggccactgatgttacagggcatggcagctccttgactaatacccaggaaggcaacaaagatggccttgcctgcttggaacataccgatacaagcactacttgcaatcagatggtggagccagtaagattccagacagaggaaacacagattggaactgatgatttgagaggacagaaaaacattgagcaacattatgcagttcacgaatctagggaggagaatatgttacctcctaaagtgggtgttcagcagcaagttgaggaaggaatgcagatttacaatgttgatacaccgccacaagatgaagacttgattgcttcagctgataaagagaaagtagctggtgtggcattattacctagtatcaaagctgaagctgttgttgcgaaggaagaggacaagtttggtcagtcaagttcatttaaaatatgtgatctaaacctagttggtagtccagaggttgctgaattacgaaatgatcctggtttgggtcaattctcaactgctggatgttcaatggagccacaaaatcagcaacaagagtttagaaatacgggtaacagtgcagatgataccaacatgcatgcccaaattccattgcacaataaggtggttcaagttattgatcttgaagatgactcgccaattgaagctggtgcatgtgatacttcaaaagcaaagtgagttccttccacctccctcttatttgctatgtcattctgcttttatatgagtataattttttcttttggtattacggtttgatgatacagtacctagccttaaaggcttgtcccagactagttactattaggcaaccagttttgtgtagccagcgatgaatggtagctggcccagacgctcagcaatacaaaaatacaggggtgactgccttcttccagtcgctgcacaaggagaatgagtctaggcctttgctgtcttcttattgttgttgcttttcatgttctgtaggagtggcagctgatcttgctgcctaatcagcagacttgctgtcaatctttgtactcttcgctctgatcttaataaaatttctctgtcatctttatggctagcctgactaaaacagtatttgtacataatgcaccgacaaccatctaatttccacatccaacctatgcattagtttatttctgtttattttctcttcatttatttatccattgtggctgctaactacatacctttaattgtgtatgctagagaggaaaacatggcaaaccctgctgtgaccacagatgttcttcctggtatccaagatggatataattttgcgatttcagattatcttggtgctgatataccatgctaccaaccaatgcaaacagatcttcccaatgggatgagcctaaatgattcagaggtgaggttttctgatattgttatacatcatgtggaggcttaataataggaaaatagattcaccactatccagtaccagtagtgacatttgaggatttgtgaccatatgtttgcttgacatgcgtagacacatatagtcaccataagttcataatactgttttttttccatgagtaagagattccttacactttttttcctcctgttgcagggcattactgtcatggatgattcaatatatggttctcttagcgatatcggtaattgatattacttaaccactttttcagtttttctacaacaatgtgcgttatgtctttgtcgtgttgattttcgatgttgtatttcttcacttgctcgttgcgaaaggatgttgatttcaaaggctatgaaagacatgcctaagctttaattcgtaaacctataaactgacaaatccttgtagcattattcactttagacaattttggtgtgacaaaccgatttgcaaaattcctgatatttatggtgcctatggtaattttcattgggaaaagcatcagtaccagaagtggttcataatcttaatacctattgagcatatgaaaattgcagccaatccatgacagctcatttctctcaacactgacttgcagttcttttaattcttatggttacaggttttatggaggtttgggaccagcaacctcaggactacgagaagttcttctgaccaggcgccaaattgctgttgtcagtgctgtgacagttctgtaaccctgtaactgcaataatcagaaaaacacacacacacaacacacatacaggcacccatggtggccatatgatccaggccaatgtcctgtctaactacacatcatatatagctggagcctttgatccttccaggtcaatatcaacagagcattcatcctaaaaaggattgttcttgtgtaaacagttcgacaagttcatgtaccgtgaatacaatttactctacaactctagatataaatacattgtttcacctcggaaaggaaaataagaatacattgtttgattatctgctccctgttgtgatattgtctgactgctctacgctgaatttatccataaggccataagagatgtgcaatgcaacatgatgttagggcccacggtgcggccgagcaacacaagcaaatgccgctagctgttcatgtccaaatctccactcattttcgtgggagaaataaaatcacattgattgcacaggggaaaagaaattcatttaaaaatagtagcttgaaatcgctatgaaaatgtacacataaagacacccatttggaacacaaaaccttcgcatggtatggacagtaaaaaaaatgagctcccaaagaatggtgctctagctataacttgctactgatttcctgattttgtcggttggatttccaggattccagtttccagcagattcagacagcggcatcttctttgctatcctccacaggcttctctgtagatggggagctcgtctcctgggtgccagagccggttgagaccttcacagtggcaggccttagcagcctctcccttagaaggaacccgcgtttgacttcatgcgagacaatcccagccttgaactgatgagattcctcgcgtgcgatagcctcatgaatcttaacataagaaattagaaggtatgagctcctgctatggcgcatgtaacacagaaataacagcacaatgcctttgtatttacatgtgcaaatattgtaactatgtaagtgcgcgaatcaaactttttatatgagcaaaagatgtactggcatatacccaaacttgtgaatcagccgtttagaccacctgtacataaaaaaggtgatataaaggataaattatactacttaccgaaggatcaaatggcttgccaactgtttccacaactcctacacctaagcttctcaatgtctctactaactgcttgtatatgccttgatagcttgtgctaatcgtctgctctttatcagtctccggggtgatctcttgattcaccttctcaaaactatcaaccagagtcaatagactctgaacaacatccacctgtatatttgaggtaaacctagcacgctccttttcagtctgcttccggaaattctccagatcagcatttatacggaggaacttgtccttccctgaagtaatttcggttgcaatactttcatactgagcagctgagttactcctttctttctcaatggcaatgatagcactctcaattccaccaagagcctcatcatttccatctagaaaagctttcttgtatagacgaagtaggtccttcataggggggaaatcttccccattaacaacctgcataaagctattcagtttagtgaaacttgatgaaccacactctttttttctttgagaatattatgagtcacgctcgatgaaatacatagctataagttcaaacaaaacacccaaacaatcatcaattaccctgttcctcctctcaattcactttgctcatagtagtatgagcattcctttagttatttcattgttcaagttgcaacagtatggatttatagtcatgcttaacaactaaaatccgtgctctacccatagttcaaaaactcaatttagccaagaaatagcaacattagccatgtcgtccaattactcatgtgatgatttagaaagcaacgcagattccaaaattagctcttgttttcccgagtttagccaaccaacaaaaactaacaccgcatggtttttaggttcagaccatgctgcattggcttacaaaaaaaaagaagtatttagcactcaccaaaactcaaaaatgtttacctttccccactaaaatccagcattactcactcgaatgctctaattcaagcttcttactaacaaacaaaatgagctatatcactgcgaacatacagtagaaaaccaggaattaagagagcacaatctacatatccttttttttttaaaatccaccacgaaaacggggctccctatcccctcatcgacgaagagaggcgaaaagaaaaaaaaaattctccacgaactaaatcatcactcctcgaagccgataacagcgagaggatgagaagcggtcaaaagggacggcggagcggagatctcaccttggggtcagcggcggcggcacggagcggcggcggcgcggcatgggtgcgccggagggagagcagcgagggggtcgccggcctcctgctgctgctgctggggctcaggcgagcaggggttgaggcgggtggggctagggttcgggggcggtggaggtaggtggggcttgcggcggcggcggcggcggcggagaaggtcgccgccatattctatcgttttgctactacttctcaactgttcggaaaatactgtactacagggaaaaagggaaaaactgaaaggcaaatgaggaaattacacggtacacaccaggggttggcacttgggcccttggcactgcttgtgtgtaattctacagtggtttaaaattttatatttcatttaaaatagaaataaaatgattaatttaaaatattattcatatgattacagatccagctcgatggatttgtggagttaggaatacacagcttcaagaaatattggatctggaggctggagctatgtcaaacatccacgaagttaaaatttaaatctgaaaaaattaatttggacttgattttaggatttttcatcctagtcaaaattaggcttacccataaattatctttgacccttttcacttatttttttatcgtttattagttgtagcttaacctactagaggcttagaacgtagaagtttgtgaaaattttagaggattctttaaagtttttttttagaatttctttacttcaaagaaaacttgaagtgatattaattatgttaagaaaaatctaacaacctagcggtgtattcttcaaagagaaactttatttggatgcacacaatctacgcgtaacatatatgtgcacatatgtatacccacacatttgaaataagataggtttatgctcataaccatcaagatatgtttacgctcataaccacctaatatatatgctctaaatgacccaacaagctatagagatctacatcaatacaatattatgtgtgtgcaactggtagcagctttgtagccaaacaaaacacaataattcgtgagttcttgtcggctatgaagcatatatagttctggggctagagaaaattataacacgactatttgtacaaactagctactacaatgattattaattatatgaatttggactagagctaactgttcaatttattattatacttttgatatggtcctattgatgtaacatcaccaattcaatattactgaggaagttccctcatacggatagaaaatatatagtttcttgattgtttctatgctaataaaaacaatgtgatctagctcaagcctaaattgggcctaaatatttgcaatttgagcaaaaaatttatttggttccttgctaaaaataaacggtaccaaattttagtataaccaaatttcggtaagccaaaaatatagagataattggagtaagccttgtcaaatctcttcttgttttaagagaagtttttagagttaccaaaattcgataggatactagtggtagacggatagctgaccgttgccattctccaaaattgcaaagccaaaatttgagccataaaccaaagagagcttttcttagacccattttttgcactctttaaagatccagggatataatatggtgtgcatctagcaaaatataccccataattcataggatgtggttgcgaattagccgatgaaaaagaagacaaaaagaaaaaaaaataaaacgaagtatccagaggccacgagtccaggcgcttctcccccccgaagctcgcgcgcacgcacgcacgctgggcgcttcttcttcccccgcgcatcgtccgaaatcctccggattttctgaggaatccccccgaatttccttgcgtcccatcatggcctcctcaggtaattcctccgtgccaattcgtggtattcatcaaaggggggggggggatttctttctcttttttttttcaagcaatggatggtgaatcgagggctaggcgaaattactaattaccctcgccattttcgtgcgtatcctgcccttagcccaccgccaccgcctccggcgatccccatccatcccgcgatccgatacccgcgcactttttttttctcgaatttgcgttaaccctagcttcagttctagaaatttgtttgccttttaaccttgatactaataacaatttgatggttcccaaaaagttcccatgttagaaccgccactgtctattgcaccgtaaaagtatgcagcaaccgaggcgcttgatataatctattgagcatctaatgaagcagggctagatagaaaaaaaaagagaagttcagattgtcacagctgcaactgcaattgcttctagagttttgcatgagaaaatattatcgcagtcttaggacttcttatttctgttgtgaaatcctgggtatgttatcagttctcactttaacactcgcttgtatggtatgattatgcatttttatgcagatgtctccgttgatgttcggccagagtttaactcttttgatcatttgagaagcatacgatatattgcaacagatagaccatggctgagtaagtacagcctgaagctagccttttcttattttgattgatatggccttggtcattagcacaattgaggattaatgaactatcttccttttggtgtctggtttcgctaacagcgttatatggaataagagttcaacctgtaacaccattcagcagtttgagcagtagacctgatctggcactcattcatcaatgcctacctgatgagctgctttttgaggtaatatgtggaccgatgggcatttgtcttcatatttgtatcatataaaatgtattatggtaaaatggaattcctcatctctgtagtataatttgcttccttctaattgataaaatatcactatgtaatatcctcaattgacatataatctttttctgctcaagtatataagtagctttgtggctctattctgtagtacctccttgtatcaaattatcattacatcagcatgaaagaagtgggaatacttagctcagtaacaaattacatgtctctttgctgaactacacagatctttgcaaggatgagtccatattctttagggagggctgcttgtgtgtgtcgcaagtggaaatatactgtacgcaatccgactttgtggcggaatgcttgcctcaaaacttggcaggttagtttacacatatctattttggttggtttcgtatgcgatgttttgctcaaatatttgaattttacatgtgaagaggactggaatggaggctaactaccagatggtgcagtcgctatatgattcttcttggaggaaaatgtggatgctgagaccaagaatccaatttgacggtataagttcaagaagaattttatcataacatatgttcaaacattaatttgatgaatgttaaattcatatgcgccaactaggctaatatcatagcacacatcacattctttagatttgtgtggaaagaaattgtctagattttaatcaaactgataaaatgtctcatcatgagctgtttttctctcacttggctgtttaaaattttaatcaggtatgtactgtacaatactggtaccttggtcaaatattgtacaaaagtatgtaagcaaagtaatgtgtcattcattctcaaattttcatgtgtcactagcctagagctcgtgcattgcaacagaaaacaaattgagtttctagcttattaagtcaattaataagcacttatttagtctaagtaatactatgaattttcttttaaacaaataggtgattttgaaatttgggggagccaatagtgaaataggggatgacttgttgaaaggtggtgtaataatatagattgtgcggcccagatgttagtggtaggggtggtgtgggaatggacaccaccactactaacattttaagtagtatagataccggcatacatgtaaaacaacaaaatactactactgtacacatgcatcatactcttgtgaattggctgtgcaaagacggtggtgggaggaggtgcatagcagcgtggaggcggacaaatcacagcatgtgctcaggcttgagcattgtgcactgagcccaggaagaatcacaggttcagagcagaagagctgcattgacatgttgatacactgtgcaccagtaaaaaaaatctaggccagaggaattttttaaaatcattgctgtctcgcatagcttcatgaggtgtagctttttcataacaccaagatctggttccgatctgtctcatctaactgtttgtgccaccatgtttacttgtggccagaggctgctcaactcacttgtcaattccaaaaatgcatgaacaacaagaaaacattttgttgcacagatcttggagcacaaccaatggctgatcggagttcgtatgtacctattttgctgcctaaaaaattccaattattactggtccaaatgaaatggacatcaattattatggtgacaagtgaatgatcagttgattgtttttgggaatgtgtatgccagtttatctgttcaatacactgaatttcacgcataattctatgtttattatcactatggtacacattgatttcgtgcattcactttgggttgcatgctgagacaccatgacatttttaaagtacagtaagaatagtatgacccgcagtgaatgcgcttttgactcattaatgaatgtatgtcgaggcatatcaggctgttacattttgactgaatttcagctgcagactaatcctgttgcatactgcgataatagtgtatttggatcagtagtttgctactgaagactagctgaaaggcattgcattagttttggaacttttctgttgttattgctgtaattgctagagtaccctgtattgtggctatactttctttggttctttgagcgaaatttgatacttgttgcttcttcaggtctttatgttagtaggaacacatatatccatacggggactgcggagtggcagttcacaaaaactgtcaatgtggtatgatattatggtggtattattgttcatttgattatacttacctgtacaaataccggtctttaggatttggttactgcatatttctattgttggtgtctgaatagctttagtgtttagtattaatttatgcgcttattgtttccaagttaatctgttaatggcatggtaatgatttttgtttgccccccaggtttgctactatcgttacttgagattttttccaagtggaaaattcctctacaaggttcatatttgaattccttttgttttctacagtatatttctcgttagtgtaacatcggttgatattttaatttcctgtgaagagcagatttccccacagaagattaaggatgttgtcaagtgcatgcatttccgggcatccaaaggtgattgtgtatttaaaggcgactacgtattgtcagaggatggccaggtgaaacttatcgtacttgtttattcgtccttgggcaggatacatcaaattactgccaacattaatcattaattagttttttttctggcacacagatagaactggcactcctgtatccagggcgtcgctacacactagttaggatgcgcctcaggtattttggcttgaacttctgtctatgttttgaactcttgatgatttctcagtgcttctaatttgaaatttgtgcggacattttgtaggcttagaggcacaactctgggcgcaaacaacaggttggatgtattgaagatcttaaccaccggggtgaatgcaaccgaactgagaaactggaaaggcagcgtgcttgaacttgtggagacctgggatgaggatgagacgcatgatccagaagttcctgctgttacccacagcaggggtttgaccccatttgtgtttgttccatttgaggaggtatgacctatgatctatactactgttaggtgtaatgctatgttttcatttgcgccccgcgcttttcttttgttttctatattggaaaattatttcatacctagatagcctagtagaaagaactgactaattaatggctttgactaaaatgttcaggctgatacttcagtgatgaatctgccagtggagaagatggactactttgtccctgggtgatcttgcgcacaaataatagtttttccaagatatatgatgaagacgcaatttcgctgatgttagggcaataatgtgcatacaccatcagacgtcagtctttgttcaatttcatgctcatgttgcttgtatactgttgtatgaataatgctatgttttgttggtgcttgaaagcaaacattttgttggaccatcctcccgcagcaataatggtccaatacttactagtacatggtgttgccttgtaaatagatcatggtgcaactgatgaaacaatacatttgtggttcagtacatttctcaccaaacactggccttgtgatatgtagtacagatgagaaccacatgtaatataatgtaatgtaatgactgctctttctacattgccaggactgcagattaggagaatttggtcctcggatacattctgaaatatacttgtactgaagatgaacattcccagcggtatcatccgcgttgtatatggcttgaaaggggcattatgacattatgagaagatacacttccatgagctgtatatatagctgattatttagggtggctaatttgtagcagagttgcatgaatatttcttctacatgctgctgggtttgggttctttctccgtgatcacgagctcgttccactccgggttgcgagggaggtaagtctcctgcaggttttgaaacgaagacgtcagagcaatgacagtttttgcctcaggccttgagttgccaacttatattgagaatagcatttgcttttcagcagatgtagtttgttactgtcttggtcctcttggacatgaactaaaatttgatgtcagaaatattactcccttcttccctaaatgtttgacgcc

SEQ ID NO: 21125 - DNA, 34183 bp, Oryza sativa
taggaaaagaattaataattgcttaaattttttgaataagacgaacggtcaaacatatttaaaaaagtcaacggcgtcaaacatttaagaatagagcgagtagtaaattttcttgaatacccaaggaaaacctgatccagctttagggagattgatgcatgtttaccaagtctctaaacggtatgatttttgttaaaaataacttctactttgtgttatatactacaagtttctatcttgtgctcgttttctgaacggctaaacaatgtgatttttttccaaaaacaagttctattgaaaagttgtttttttaaattatttcaatttactagtacttaattgatgtcgttccgtttagcatgcgggaagaagatcccaattcatttttccttcaaaattccttgaaacgacctcgaggttggtgacggttcaaccatccataattctctcattttcctccacgagctccaaaattcctgtgtgttccaacatatttcaaccatccacaattctctcattttgcaatgatcaaaactctagtacttgactataagcggcacttcgtccagacggccactacaaccgtactacttgattaaactctaaaacaacatttgcaattgcaattagtattccactacttgactcacctacactatcgtagtcagataagagtagttctactcatcaattcaatagctgaaatttatttttccccgaacacgaagcgaacgagagctaattgaagagagaacaagatgaatcgatttggggattgctgaacatatttttttttccctttccgattgcacgaagcgaacgagagctatttgaattgaagagagagcaaaacggaatcgatttggggagagggaggggctatagacgtacggagatgtaggagcaggtggggaggacgcgcatgccgcgctcccgcgcgtgggcgaaggcggcgtcgcagagccgcgccgcgagcccacgcccgcgcttgctccccggcacgtacgtgtgcgccatctccatcaccgctgccggcgtcgtcgcgccgccgccgccgccgccgtcgccggaggaggaggagcgcggctgggcggcggcgaggaggcggtactggaggtaggcctcgccgtcgggcgtctcgaacctcctcgcgtcctccctccacaacacgacctcctcctccgccgccgcctcccgaccgccggccttcgccagcgtcgcagaccctggtgtgttcggccccaaattagattgcaaagccactggaatgttgcgctgcctccgttttttcctttccttttgtttttaattttactgatcaaactgcccgtgtgttgccatggtaaaactaaaattatgctaaaaatatttagtgaatatagttaaaactagttgggtggctagcatcaatttaaaattatctattttttaatacatgattttatttaaaattatcattcacataattctaataattttatagtttttaaaaggtacgccagtcgctaccccttcctcgggagcgcctacggatcgggcgatcgattcggggctgagaaatcgggcgcgtccgatttacgtgcaaaactattttaaaccgatttttctcttaaattaattatccaaatcataatccgattacaccattaaattcgttgcaattaaatcttcaaaaaaagaccacacatggatatattccgacgaaaaaaattagcttattattgattttttttaaatgttgcacgatgttccaccaggtatatcggaattgtctcactaagtagatcaaaaatgtttcactcgtttaaatcaggtgttgtttcaccttatataaaaacaatgtttcagcaaatagtgaaagaatgtttcagttcactacaacattagatttatacatagtgaaacattatgattgcactaggtgaaactgtttgatggtattttggtgattatacatgtacacaagacttactcatgatggacaaagcaaacaagcaatttgtaagttggctagcttatcatttctatgcaatgcttggccatgtatatacacgcaaatacatgcatgcacaggcagctggggatatatatacttagattagtataggtgcatgtataattaaccaataactagccgtgtgaagattggctggtgaggcaatcacgcgcatgcatgcatgtactacagtagacggtcgtatgtgtgtgcatgcctgggtgattaagcaacctatgcatatccgagtgattaatcatgggctcggcccatatggccgaagacgatagctgcctacgcgcgggtggctggacctctatctcgctaagatttcagaagttaatatgcggaagagataaaaccagatgaattaagagataaccaacaaaccaattgattttatctctataacaaacttgatcgagttagttacttcgcgcgagcgctagcgagacgcttatcactggactgtggcccagcagcagagaaacaaagcgaattacaaatcaagtttatctctattgattatttcttatctatagaaataatgatgaaggaatcaccacccagctgcgcatgcgcgggcggctgggcctccatctccccgatgctcagatatttgacgccgggagaagctaagagataaaatcaaagaagaatatgaacagataacaaactggtcgatcaagccttatctacagcgaacttgatgcggaggaaacggcgtgcagatgcggtgagcaccgacctcagatgcctatataagacgtcaacccctcggcagccaggggcattgacgaacttctccacacattcatagaccaacgcatctagcatccacaagcgatcgacacacaacgcagccatccatcctcgacgcggccatccatcctcaacacaatcttccctcgtcatcaacacatccatcatccagcaccggagcaacagcgcgtgcgcggccggagcacaccgacggtggcgagcggcttcggacgaaccggcgtccggcaggggagcacgaggagggagatggaatcgatggtcttccaaggtaaaattaattaagatctgtttccttcttatttcatatgtagcacgtacatacgcatgcatggagaggcatcaactagagtatggagtagtacactcgtgcggccaagtcgatgtgcgctggcgtcatggcgccggatgacggcagcggctatggagaacacctcttttggttggttctcgtcgtcagggcgcacggatcgctgccggcgctctcacacacacatctacatcatcatcacaaccatgcatggagaacgtgaagcgaagacgacgagacgaccacaagcagcttaatggaggttctcttacaggcctaaacctgcggaggtaattaactgggagcttatcgaggccccaggaaccaggagaccacatcgcacaagttagatctgtccaatgacaaattatggagcgcacatacatatatattacattgggaatttatatttatgatcttttaagattaataaagagaatgttccctatgttttgtttacattgtgtatcttggtacactggcacgctcgcacttattttctctctaaacatagagggatatattttcgtatttttccatcctaaacagaaacatttttcggtggaacaaaaaaataaaccaaattcccttaataggtttccaaaatatgtgggttttttttgttacaatggaatatttcgttaactgcaacattagatctatacatagcgacacattgtgagtacactaggtgaaacattttttatagaacaaacaataaaccaattttccttaatagagagtttccaaaatatgtgggttttttattgcaaaagagtattttaattcactgcaacattagatctataaatagtgaaacattatatggatactaggtgaaacatcttttgtgaaaaaggggaggaagaagtgggtgggccaacaggtagcacatgggggaggggcgcgcaccgggggagcgcccgatccggctccccccacgccggtcgcccggcgacaagcattatcgcccttcctcctatgttatttgcttactcaatttaacactacttctattcatacttttttgaactttaaaaattaggccttatagtttttagaattcattgtcttgttggctttcattttcaaaatttttagaagtatcgtcaaacatcgccaatttactattctacgactcgtccactgccacctctctttattgttattgggattttagaaatcaaacataattattgtttgtgttctcttttactttctgtaagtctcgtcaaatcgttagtggctttgccactatactcctctgaagtccgcccactgcctcccctccttattgtcattgagattttaaaaatcgaacatgattatcattggggtttattttttactctccataagtcccgccaaccatcgtgaccatgctgcttaacgacatgcctatcgtcactcctcttaatcgtcattgggattctatttggggttttgtttatagtgtttagatatcccatcaacggccagcaatctactcctttacaggtctattacttctcctctctttattgtcatttgtcatcgttgtgttctagatgtatttttttaaaaaaatgtatatttttaattccgataatttttattcataaattatattcctacttgaactcttctaattatttttaatcttttgaaatttattttatttataatttcgaattttaattagtctcgtcgtttgttttagattgtctcttatttcaataatatttatattttattacaaattttatttattttataatttgtatttaagttgagatcttatttttctttttctattttttgaatttattttattttttatttcgaattttaattaatctcgtattgtgttctatatagactatcttttaatatttcttattttttatttccaatttcaattgttccaaaattgtattcctacttgaactctctctctctctttttttttctaattttggattttatttgattttttatttcaaattttaattaggaaaaaatacgaattacccctcaaactatcgcggtcgtccgaattacccccctgaaccacaaaaccggacatttttcacccccaactatgcaaaccagacgatttacccaccttgacccaatccatagtgattttgtccaacgtggcgcacacgtggcaatccagtcaatgtttttttaataaaaaattgtgggacccgcatgtcatctcttcttcctctctctactctctctcgctcttttctctctcacgcagtgcacacggcgaggacgggcagtgggcgtggtcagttggcgaggacggcgcagggacgggcagtcggcatggacggtaagcaaggacagcgcagatggcggcgcggacggtgcggacattagtgcggagacggaggcggcggtggagctagctaggtggaggactccgactccggcaactcgttgatgcgattggcgaggtaaggacggcggcgcgcggggggcggtgggggcccgaggacgacggcggccggcgatggaggcggaggccgaccgggtgcgaggggacacgcggtgggcggcgggctcctcatcctcgtcgtgggcacacgggaacgcgcggtgggcggcgggctcctcctcggcagtggcgcgcggggatgcgtggagggacaccgccgccatcgcgggctcctcctcctcatcgtgggcgcgcggggactgcggtgggcggcgggctcctcctcgtcgttgtgggcgcgcggggacgcacggtgggcggcgggctccttctcgacggtggcgcgtggggacgcgcggtgggacaccgccaccagcgcgactcctcctccgagccggcacgccgcaccccgtcccagctccccgcgcctcgctccctgtccgtcgcatgctctcctcgtccgctggtgatgcgccgccgctggcatagcgaaccgggcccaagggtgggaggaagagcccgccgccgccgtctcgcttgcctcaccttgccgctgcagcctcgcttggcatcacctcgttccgccgccacgctcctcccctgccgccgccatcgccgctccgtgtctcccgtcgccgccgacccgtgagagagagagagaggaagagtgagacagagtgagagagagagaagagagagaggaagagggagagagaggggaagtggaagagtatgacaggcgggtcccataattttttattaacaaatgctgactagattgccatgtgtgcgccacgttggacaaaaccgctctggattgggtcgaggggggtaattcgtccggtttgcatagttggggatgaagaatgttcggttttgtggttcagggggtaatttggacaaccgcgatagttcggccggggaggggtaattcatactttttccttttaattaatatcgcgtttcttatatagactcttctttcaatattgcttttaatttcgaattttagttattttcaaattgtattcctacttgaactcttctttttttctaatttcggattttattttattttattccaaattttaattaatctcgtattgggttcttatatggactcttctttcaatattccttatttttaattccgaatttaagttatttttaaattatattactaattggactcttctttttttttctaattttggattttattttatttttattctgaattttgattaatctcgtattgggttcttatatggactcttcttttaatatgacttattcttttaatatgacttattttcaattccgaattcagctctttttaaattgtatttatatttggactcttcttttctttttctccgattaatgtggaaatttttagccccacagcgaacgtagtgacttctttcaaagctgttataatataatagatttgtgataagagccgacacatggtgcctagatcaattttgtcagcaatgagaccatccatatatttttgtacatcaaatttctgcataagcccgattgatcaaatgtatcccgattaattgttgaatagtacattctccgttcaacaaccgtattccgtctttcatgaaccaaaggcgaaaaatcggagctagaagaatgaactaaaggtgaaaacagttattgatgtccatggatcatttttggtgatggccagtgatgtatgcagtggcaggtgaggtccaatcttggtgtattatgtggtaaagcttgaaaaacagtgaacttgaggtgaaccagtcgaaagccaaatgacctgggttgaaccaacagggccatggcaatcctctccctttcctccagcatggcggcaccctctctccattccctctagcacacagcgctgctctcccttcccttcagcaggacattgttgagaagggccatgtgtgaggggcatggtaggcggcatcctaggacatggcacattcccggtcgctcatcgtggtgtccgggctggatagaagcgatgccgttactggcttattgcctgcatggcgtcgagaggccctatggatctgaggatgctagcgtggttagcgctggatttttcatattttggtccttttgaaaaacttatttcgcaaataggcccctggaaaaacttatcccagaaatggtcctttttgaagcgccggagtggctggcgccgtcgtccaacgggaggcgccgtcaccctgccaccgtggcacacgcgaaccgatgtggctggaggagggcacctgccatgttggcgtcgccccccctacccacccctcgtctccattcctgtttctctgtatgtagttgtaacggtgtcatttttgttttattttttcagatgttttttcacatttagaatcacgatacagccaaccacaaaaaaatttaaactcgaacgaaatataccacttagctaagtctgaaaataactagaataccacttagaccataactcttttagtaaaaccctttgatcagcatgttaaacataatgcactctagcaccatatgaaattacttaatctaattcaaaatataaccacatgaaatgatagccataagttaaacagtacagagagatgcaattttttattttattttatttttttgatattttttttcacacttagaagaacatatgaactaaaccatagaaaaaataaactcaaacggacaaaatatatgactcgtagaattttccaaagctctaccaaaacggacaaaatatgtcatttattaaaatatgcgtaactttctcatacggactcggaatcaagcaaataatatatccatgaatatctacagaaaaagttacatccgaattccgtttgcaagattgtgttttcgaggagagaagtttttcggtagagctttggaaaattccacaggccacatatttcgtccgtttgagtttatttttttatggttggttcttttgagttcctaagtgtgaaaaaatatcaaaaaaattaaaataaaaaaaaagttgcacatctctctcctctgcactagttcggagagagaggagaggagaggaaaaattctacatgtcacatattacgtccatttgagtttatttttttatggttggttcttgtgtgtccctaaacgtgaaaaaatatcaaacaaataaaagaaaaaaagaaaaaattttgggggggcgggggcgccagccaatatggcgcattccccccagccacctcagcatcgccccgccacgtcggcgtggggacggcgccagccactctggcgcccaaaaaaggaccatttctgggataagtttttctaaggtctatttgcgaaataagtttttcaaaaaggactaaaatgtgaaaaatccaggtggttagcgaggctagatctaggctaatgaaagagtagggatgggagtggaatccgttggaagtctccagataaacttttgtggtgcctttttgtcttttcatgttttcggtaaagaaaatattttctcaaattgctggctagccaaattgacacgtgactaaaccgccacacgtacactatataggactactgtcgctataaaatgggggttatgagggtaatttgtctggtttgaagagttcttttttttctttgggggagggggggggggggttaaatcgaactactacaaaagtagtttaggagtgtaactcgaactttttccttcttgtcaaacatgacaggttgcagatgcagtgcccccacgagtaccacctctaccgtggactttactttgtaaaaacatattcattcacctaaacaaatgtgaaagaagtaaataataaagaatctctcccccaagtagctagcaacacatttttgtatgcacctgtagcacagtactagtagttattactattgtttatcgtctttaattagcgcaaaaaaacaaagaaagatgtgcagttgtattgctgaagaaaacatgcatgcatcgatcttgagagaaagcaaagcacatagataggctaatttctcctttaccttattatctttcatgttttcggtaaagaaattattttctcaaattgctgactagccaaattggcacgtgaccaaactgccacgcgtacaccaagtagaactattgtcgctgtagaagaggttaggagggtaatttgtctagtttgaagagttctatttttgtttttggaggggggcggggtgggggtgaaatgtttagtatttgaattgaggggggtaaatcgaactaccataaaagtctaggagtgtaactcaaactttttcattcttgtaaaacatggcaggttacagatgcagtgccccatgagtaccacctctactgtgggctttactttgcaaaaacatcatcatcacctaaacaaattggaaagaagtaaagaataaagaatctctccccaggtagctagcagcacatttttgcatgcacctgtagcatattactactccatccgtccaaaaatataatcatttttggatttcaacacagtcttcgagatactactttgactaacaacatctataaaactaagatgttttaaataaaaagagttgcatattataatagtttatttaatgataaatccagtaacatcaattttacataattgatcttttttattttttttattaatagtcaaaattaaaaatgtttgacttaacactgtgctaaaaatgcttatattttgaggagtagctatgctatggtttatcgtctttaattagcataaaatcaaataaagatgtgcagttgtattgctgaagaaaacatacatcgatctttagagaaagcaaagcacatacataggctaattctcctttacctttttcttttcatgttttcagtaaaggaaaagagggaataaatcaatggaggcgagaagcaaaccaaggtgcaaagcacaaagcaaggaacccctgcgtatgctagcattagtggaagggaagcgatcgagaagataccaaaccaaacgaccaattaagctatctattcatctagctgatcgagccttctcctaacatccgtctcgtgctcgcgctcgcgcagaagcccatctatccaagcattccaattgctgctgcttccatcggtcggccagaattgctgcatgctgttgtcttaagttatttggagcattcttcagttcgtccatctagcctgacttcatacttgcttcacctggctcagggcctctggcgctctgctctatatatatactcaggtacgtattagtaataactaattatatttcttgtaacaatgcatcaacttaattaatttgcggctcgctcgatcagtgttacttagtttatttgttcatcgatctttgaaaaaaagaagaagcagttctactgattatatatcaaaacatcaattgattatatatggttgatgtaattgttgtgtatatgtgtgtaggtggcgagtggaattgatcggttgatacaatctgatacgatgggttagattaattgattttctgacgattctcctcttcctgatcaccatgattaaagctgtacaccttctaattgcactttcacattctcgaattatatagcatgtctatttctgtgtttatttccttttatttgatcaattgatttgagacgttgatggcttaacgtgcgcacataacatcaatattagtcgtccatatatatatatattcgcgattataattaagtatataagtgccggaatatatcttggcttggggagggggcttattaattagcgccaaggtgtgaaatggtttagctagcatattaaaacaaaataatatgcatgcatgatgttgtttcaatggcctaaaggaactggcatgcatcgatgtttgccaatttttatctctagtaaagaaaagcaaagtagatccccacatgctcagaacttgtttattatttttatttgaacagaacaaaattcactagcagctggtgataaaaaccagttgattacatatgcactatacctatagcatatgtatgtatgtgcaagttaaccatgtatcatcgacctatcgagcacgctgacgttaaccaagcaagatggtccgtgaatagaaaagcacagacactttattctctttttccttcaaaaataaaattcttcaaaaatgacacatagtttgttaaattcggactccactaagaccccgaatgccagaaatatttttcctacatccgaaggcatcatgattctccggtaaatgatttacaaaaaaactagatgagtgcatatctctcattagctttgttttgtaccgtgttagctagtacgcctgcttcagcaactcctgttgagtgcaggggacattgtagagcaagatagttgttggtgtcctctgtaatataaagtcaatcttacacagtctaatttctattattatggcagaatgtaaattgggatacttttgattgggctgtgcaagggatacttgaacattttgttaaaaatcagagggacacaagagttatatattttgatggctggcgtggttttggagcatcagcagtccttagagctgtagcagatgagcttacatctcgaggagcttggccagaactacacattgataaagtaatccagattgactgctctacatggaaaagtagaagggcaatgcagagggcaattgcagtggaactcaagcttgatgattcggtaattgaaattattgataagacagatgaggaggatgattttaagggagtggatgaaggctctagaagcgagataatgagtgttgcagaagtgattgatcaagtcctcagggatcacaaatttatggttgcttttcataatggaagtggtgattacattgatttaggtagctttgggttcccgcaaattacactatttcgttccaatctaatattatggacctttcggaagaggttccaaggaagggagcgttactctgagataaaagacaaagtgaagaacacccatttattcgcatttgaaacagagtattatataacaagaaacaacattctcttcccagtactgcaaaaagaggctgctgccatagctgcccattatccttgcatgcgggagatcgacccggaaaggatcgtgcattgctgtctatatggactatttctctatctttgtttgcccaaacatttggagaatgagtgggcagcccgagcatcagtgtactggatgtgtgatggcatcatacaaggtgatcaggcatgggagataagcgctgcactttcaaaagaaataaagtgggatctacaaccttctttacaagatgaggtgcgtcaagaattcatagaatcatcctcaaaaaactctgtaagtatccagagattcaaaaacagatactttgatgggcaaaagttttacccttggatcacaatcactgcatcaaataatattaatccagaaacactacaggacatccgatccaaaaatgcagaggcatcgtcttatttcttggctcctgaaagatccagtgatatcacactagtgttatctgatgggttgtttgaccaatggaacaacctccaagttctgcagttgtcatattgtgacttcagctttgcatcaccaccttttattggttgccagaatctaagatttattgggcttgaccactgtaaagataaaaaagaaggatgcaaacaaagtgacctaaggaagtggcagtttctccatagcttattagttttggatctcattgacactatctggtaccaagtattttccgaagacatggcagatctttttgttaaccttagggagctaaatatagtaggagtttattgctctcacatatggggccagctacaaaataagattgaatatgttgatttgtctaggaaaaggaatataaaacttccttccactctaagattcttcaggcttgatgaccgtcaacctacaccgcagtccacaccgggcattgaattatcgctaaaaggttgcatgggattggaaagtttattcctgagtcgaatatccaacctcacggagctggacctctccggaactgcaatcaggatacttgacttcacagctatggtggtggaagtctcaggtttgaaacgactatttctgctaggatgcaagcaactccaagcaataaaatgggacaatagtggttcaacgataaagccggacctagagttgttgtgcgttgacacaaggtctagaagtaaatatcctcagttatttgttgacaagaataaatcccccggtttcttgtcagtccatgctgttattgtggacgcgagaattgctcggtccttatgcgctctaatagagaactcatatcatgttgatatgcatatccatgtcacctcttcgaccatatatggtgaagttcaatccgaaggaacctacaaagatagcattagccaattaagtgatcatgtgaacatgcagcaacaagaccttatttcagcaggccagtaccatgatgtccaacttagcatggttggcgatgtcccaatgcagtcattcccccttcctccgacaacaatgttgagccgccatatcgagattgcacaggggagccacaacctggagagcgagctggatgatgattcaccgattcttactttagctcatctagtgcaggggaaggctgagtcactgcatgtgcatgatctctcaaccatcactcctttgcccggaggacaatggtgctgtctcaagtggtgtcgtatagagaggtgcccgaagatagaaattgtcttccctaaacacgcatggaatttctacggtctggaaaccgcctgggtgtcggatctcttgatggcccgttgcatctggagtaaaggttctctccagtacagtggttccttccaaaatctgcagcacctgcacctgcgcagctgcccaaggctccagttcgtgctcccggtgtgggcctcctccttcccggacctgaaaaccctccacgtcatccactgcagcaacctccacaacatcttcgtgctggacggagattacccagagcaaataaccgtcgaaggtgtagcattcccgaagctaaccaccatccacctgcacgacctcccgatgctgcggcagatttgcgacgtcgagttcaagatggtggctcccgcgctcgagaccatcaagatcaggggatgctggggcctgcgccggctgccggccgtcgctgcggatggaccgaagccggccgtggagatcgagaaggacgtgtgggacgcgctggagtgggacggggtggaagccgaccaccacccttccctcttccaggcgccggtgcactcgcgctactacaggaagaagctgcccaggggctccgtcctcaggtatatatacggtgcatgcatcggaccatgtacctagctagctgctccatcttgatttatttgcataatacttgttctcagttatttcatttgtttgatctgtgcttaatcaatttgctttctctgtctactgttatatttgttgcctaggtgaattgaatccctgggcttgggcggccatgatttggggattgattggcgacgaatgatggtgaatcagtgagatgcttcttgcttgcttctgttgggtgatttgtctccggtgatgttgcagcaagctttgtggtgtgagctgtgtgacgggcacggactgaccgtggctcgatcttgtcctcgtatatggccgagttggccagagagcgagattgccatggctctgaaataataagcggctttgtttgtgcgtggatgcacagaccagctgattgagtgagtgtgtgtttcttgaatttaattagcattctgggtgtggatgctcagatgcatgtgtgtgtgtggcttgatatgatgatctgctttgcgtttgaaacaataataagcagtagccatttgtgcctgcgagcatatgtatgtggctgctgcagtgtgactgtgtgagagtgcattgcttgtgtgtaactgaattctgaagattctgaacagatgagcagctggttgtgtgtgcttgcttgcatgcatgcatccaccttgctccaatgcgtgtatgtgtggtattgtaattatcagaagctatagtttgatctactttctcttctgtttcccagggaaaagagttaaccatctcttactccttgtgttaacattttctttctttttttttgacagtggagatttcattacgcaaatgaaagcatcctgcttctgcactaaagtgcactaagccaaaaacagaaccccttaccttttcccaattgcatggtatgtttgttcttttttaaaaaccttcttttttaacgaacatggcatgttttttcaaacattcagaaagctctcagagggaccagatttaagtcattagcagtgaaccgaaggtcgctctgatgattatagaggtttagaacgcaaaaggtcccgccaggattggaaacgcaaggtctgattctctttttcatcacaattttttttcctaagatgtatcttcttgttccataacaaaacacacgattacgtcgaagtagcaacatacaaactacacaagtaccaaaaccgatatatccaggattccaggtcaaatctcatacgcgtcaaatccatgttcttcacataaatcccctgtaaatccaaaattaagctaatacaacacccccgaagaatatacaaacagtaacttctttttttttaatcccaaaaatcacatagaacaaatgttccatgatttcacaatcttgaatagtaaaccacactagtcagctctgccagagaaaatgatagcctcttgttagtgacaaaaaatggcaactgtcttcccatgcatccatccatacttattattgcctagcccagcaaagcctatgtaaagaatccactggcatataatacttgtttacaaaaaaaaaagactaacaatgaccagtacttatttcatggtttcttcttttggagggccttcagcaatcttgtcacttgtttgcgtttgggcgtctttagactctatggcggtggcctgagctctcttacttgcgatttctctttgcattgctatttgatcttgcattactttcgtcatctcctttatttgcttctcttctttctccagttgcatgtccattatgatcttagcattcttatcgattggtttgaaatattcatctatggcggtttcctgtgaaataggatggaggataagttagcatgtaaggtccagaaacattaaaaaaaaaagcatatcatagaagtaaataacatgtctgattctgttacacctaaatttccatcctataaaatcatggcaaatacgtaaaccaaacaatcaattaaaccatagaagatacggtgtccttcataatacaacagcatgatggctaatccacctcttactgtcaggtacacaggggtaacttgaagcattattcatgattcaagttgtgagatggttcataaactaacatgttctttctcaaaacaacagtacacatttcctatgcaggcattgagacatcgatttggtaattttattttgtggcaggatgtcttacagcttcttcaagctgctgattgagggcttgcatctgctgaaccatttgacgaacttctgatagaataatttgttctggctgcttccgaagctcttccttcttagcttgggcctggaaaatgttcccaatatttaagtattcgtataaatgaacacagtatggcattgatcaactaatgaatgcatgaagaaaaatgatagatgttatcaccatggtccatggataaccaaccatgctaccttgaaagaattgctttcgcaacatttaaagacattggaaggctgagtacttagaacttaataatttctatgctggaattaggttaagtgagcttagcccttaccaacgccaaaactataaaaaaaacagaaaagcgtaatattttgtttctttaaaaaaaattgtttgctcccttttatttacatatcccacaaggacccacattgtcttgtactccctctgtcccaagataactcatttctagtctctaacatttgtcccaaaataagttcatatctatccctcttcataccctcggtctgcaaatcgagttttatctcctccataccctcttacttgcccacccactaatgctactttcctattaatgaggggcactttgttcttttttcctccatactaactttttttttctcgaacacacagaaaagcctccatactaatttgaatcccacttgctagaagtgaagttattttgggcggaggtacttcaaggcagtgcatcatggatcagcaggggtgtgcataataaaagctaacacaacaaccacaccgactgaacagccattacttagcatatttgctaattttatctattggctattcttcttacgaaataactattcaaaagcaggcaattattcaaagtaattgagcatgtaaaaatgctacaacaatccgtggtattttacataattgtatgcagaagtaacaatgccaagtaagcacagttaccctgtacaaaagatatggaagtaaataatcattcccaatacaacgtaaaaaaaacagttctttgtggcagtagaaattgaataaggctacaattagtgggatggcttatctgaataaaaagcagttggtaaccactactctgtaccacttgcaggacatagctgatattttcacaatcaatgaaaccagcaactgatatgcattgtgaggcacccgaaaagagcacagttgtcaattaggcacagaaccaatttaccataacaataatcccttatctgtgccatgccaaattgccaatcagctaaaggagaagattccagcctcaattaaacaaaactctactgaaaacaagataaccggtagtacattcttagcgggcaaacccatttctatttcaagcagctcatcccaaagaagacaattactagaagattaagtctcacactcaaacatggtaaagatgctttacttttgctatcacataacacaattcatagattagatatatcttcgaagaaaatggccgtggcatggttaaaaaaaaacaaaagcaaaaagcacagccttaccctcgcgatccgctgctgcatctgcagcctgtgagcacggatcctcctctcctcgtacccggacagcacccgcaccacgaaccacgccttcctcccgaactgcaccagcttatccatccccggccgcctcgcccccccacttcaccaaccccacctgctccaatccatccaagaaccaaccgatagcgtcatcaacaacatcccctttttttcccctggaaaaagcgaggtgcgttgctattcgattcgaaccgagatggatgcaggtggaaccgagctccacggccgccgcgtcgttccgtccccgcctcgaaaccttctcgccggccgcgcgcgcggcgcgaggaaggatgctgccgcgcggggaggtacggtgggtggcgactccggattgcgcggcagatcggcggcggcggcggcggcggcgagagggagtggagaggtccagagccgcagaggtgtggggaggaaggagagagagatagaaatacaagaaaagggaagggggcatttggttattcgccattttctcttctctccttttcatttcctggcaccgccaaacagccacggttccatgcaaattggtgatagaaaaatctgaaaagaaaatatatattttaaaaaaatataattgttgataatataattacattgtagcttgtatataaatataatcttgtggacccatggtcgtagcgtcaaatccccttgcgtacacatatatgttgtattcttttacttatccacctgcataaatcttggagtacatctaaccgtgtaaaattcgatatattatttccacaatttctattgataaaaatctagccattttaataaataatgggacgatcagtcattcccgcttgttgatcgagaattttctcaatagcacattctgcaagaatagggaaatataagggatgttgagaagaaacttagtatgaatatattgactaaaaaataacatatataaaaaggtacaggagaataaattagagtaaaagttaaagagccgaaaagttgctctaatcggttgagttacgggctttcgacaaataagttgttaaaaaatgaacggggcaactatttcatggtaaaactttttatatttatattattactggccacaatagccaagggggtgtcggtggtggcataaagccgatggagactgagatgggatcgccttgcttccccgcacgtggttgtgatgttgtcaagacaaaaggggaggcgtagcatgggtcgacatgtctatgcgcaagggcacgatcaaattaggagcacggagggcatgggaaatggtgcatcggctctccgaggtcgtctgttcatggctccatagcacggtggggaaaagggcagggtgcgagctgtgaggtcgtggcatagttgagctcgattcgccagcacgagttcattgtcactgaagcataattgactggcatgatgatcctcagagattcactaaggtgaggcgtaggtttcccctaaattgcctcattcggagcatggcggaagcggcacactcgttgtggtcatcatggaggagcggcggcgtaatcattgatctagagaaccgagatactatcgttggtgcagcatggaataatgcttgagaatgtgagagctggggaagagaaggaagaaggagatggagaggagggagatgagttgcccactaacatgtgagacccacgtggatcccacttatcatgtcagtcaagaccagccactatattggcatactgccgagggaataaagttgatacggtgttgttagttggtgaataggctatacttggttcaggggtaaatttcagactcagcgacgatgagggacctaaagtgaacctattcctaggtcttaagattgtttgtgcagtcttaaatgggcctttccttattggggaaaatttttcagtttgctgtagtagcttactcagctgagcgcatgagacaaaggccgagtttagttctaaattttgaaccaaaaaaacgtcacatcgaacttttctacacataaacttctaacttttctatcacatcatctcaatttcaattaaacttctaattttagcatggaataaacacatccaaagttattgttttttttttaaaaaaaattgtactatgaataggcagggagtgattgaagtatgttcagttcactggcatcctccgctgactaattatccaacggattatataaagtggattatctatttgacttgactataatataaatttaagtgatataataaatacagtagaaaaaagttcccatagaaaatgtattttaaaatatgttgagcatataattcaccgtaataatctaattaagcagggtataaaagggacagggcaatcgacccatgccgaccgacggttcatgttgttccgctcctgtaagtagtaaccaaggttgacagtatcccgatctgtattctagtatcttacgtatcttacgatactataaacttatcaagccaaaacgataccaatcccacctaccgaaatgataccaatctcacataatatccttattttcatagtatctcgattctactattcattaacacacgatcctataaaattttagttagtatcccgattctacgacccttacgttccaacaaaatattatttataataagatgatttgaaaataatgtaaataaatatgcttaggtttatattataatcagttaaatatatcaaaaccaatgtgatttgatctcttgataaatgtctctatttgcatgacatatattattactatatttttttatatagaatagctatgtgcaattaatacaaatattaattgaacttaaaaagaaaatatcataatatccgatactacaatacaatcctatgatacgatattactttgagcaaaacgatactacctagaatcccaatactgataaccttagtagtaacacggccatgcatcgtgccatcccaagggggttttagtactaagagcaggtacaatagaagactataatctagctataaacatattttaaagagataaaaaaaagagagagaagagcagcgggctacaaatctgtagccagctgtagcacggactccaagacgtaatgtgtgtatgacaggtgggaccaggtattaatagtatagtaagcaactattgtatgaattgactattacattggctatagatgatttggagctagtagttggctatactattaaacttgctctaaggttgtattcttttcccctctttcccaactcacttcccttgttttccacgcgcacgcttttcaaattgctaaacggtgtattttttgtaaaagttttctatataaaagttgctttaaaaatcatattaatccattctttaagttttttaggctaatacttaattaatctcactataatcgcgtgctttgttttccgtgtggggagctcccgaacgcagcctaagaaactaagcaaaccctcggggtccgtgaatcatctccaccaacctccaaactaaattttgggaattctagaaaaagtcgaggtacaacagactggccaaccaaccatctgactggccaaactctttcgctcactgggcagaatttgctagcaaaaatgccttgccaaattgttggccaagtgcatcctcgtggttgtgcgccatcgttatctgcggccttctcgagtcgccaccttcgcatcctcctaccatggtcagctaaagaagctgaggtgaccggcaaggagcggcacggtgagcaggagcatggccgtcgacacccccgagttgtccgttaatgagcaggggctgtcgagaacgttggtccgtgtggcagcttcggcgaggagcagagatagagatggatgaggtcggggagtaagctgaggcagtccacgctacccctgccaccgtccatctctagagctcaggcagcagcatctagatcctaagctccatgccgttgactccccttatccctggcgtcatcgattcctccttcggcacttgcccttccgtcgtcttgactgctgtcccgcctccaacttattcctgtgctgccatccctgcctccgtccctcccgatgttgtctccgcgtcgtctttccccagatgttagtttgttggacagtagaaaagaagggagaagaaggaaagtagaggctgatatatgggtcccgttgtaatattggatatgaaaatagataatatgttagagtgggtaacaagttttgcttgtcaaattagttaaggagttggctatacgagagttttgatttgggtagaccgttgaagatgctcggaaagaagaaacgcggccgcccaagccccagattggtgggtgcctgggtagcatctgcctgcctcacttccaggcgtaaacaaggcggcaccccgtaaccaccagctgcatgcaaaggccccacatcacattcacatggtcgcttgcgcgcagccgccgcaaacgcacgcacgcacgcatgcgatgcgatcaatccattcctccaccgcgcgcggagttggatccaggtcaaagccgcgtacctataggccgtcatgagttggatatgatggatataactctcgggagatcggctcgatcgatcgtcgtacgctttggacggctcgcacgagcgcctgtctccatcggtttcggtatcggcagcaggtcaggtgcagcgtacggtgtgtggacgcggcggcaccggcccgggagggatgccggcctcgacgaggagggcgaggccccatgcagcgcgcgggccgcccatccgcaccgacgcgcgtacgtacgttagctaccggcgaaatcgcggagtggcacgcggtcaccgtacgtctctctctcaccgatcgatcgatggccggcgcgcgaggaaaccgggagaaacggagctgcacgcacgcacgctcgtcgtgccaagccagcgcgcatcgtacgtatacgctccactgacaccgacaccacggcgcggcggcgttggcgcgggcgcgatccaaaccacgtgctcgctcacgtggcgagccttcgacctacggcttttctgtaaccggtgggggggattgtgcatgcggtttcactttcacgcctcgtctcgtctcgtctccctttcctcgcgcgctccacgccatgagatgcgcgcatcaccgacccaaaaatggtcaactatatatctggtggaatgggaaccgaaggaatctatctcagcatagtcctgttacatttataaacgggactaaaatttctttttttaagtctcggtttttttaatgaatcaagattattatggatttttgccgatcaagtaaagatagtttctccggtagtacttatactcccttccatcctaatttaatcatcatctaagagaacgcagagatcgaaaataataaaaccttcattattaataaattaatcatcatcggttaattaagatgttctgtcgctttgtgttttatgcattacatcacattttaagtattgttccctccgttttataatgtaagactttttagtattacccatattcatataaatgttaatgaatctagacacacatatatgtctagattcactaaaatctatatgaatttgagcaatgttagaaagtcttacattatgaaacaaaagaagtacatggcatcgcaacaatagaaattaattatagttggttgcatgcagcgcattcaaagatattcacttactctttacacaattaaatgaaaagatactttgttagatgatgattattttgagaatgtctcaaaaaatttaggggataattaaaattggatgaatggagtatattcctacgtgtgttttgcatcgtcggtgaaaccatctctttctttaagtagaatcaccgtggatccaatattttattctcaattatctttttctagtccatccctaattatataggtgtagcttattataaactacatgcatgttaaagtagagtaaatgtaacggtgatttgtctaaaagcagttatgtgtgtttcttttataaaaaaaaaattgctgacacgttttggtaacagacggaaggtgtcactggcggaactttgaaatgcctctttccaggaagagtttgacttcttgcatgtcttttatttgagcatattatattaaatagaaatgattatggccatgctattataataaagagacatataagtacttaagtactgatgagggcatgactaagatataatcatacttatcttacatataataagctttgctttagcttgttgacatgtaagataaagtataattatatttgagccaacgatggctttgctttagcttgttgacatgtaagataaagtataattatatttgagccaacgatggcctcatcagtacttatatgcctatttattttatgttttctatattatttttttattgtatgttcaaacaaacgttaaatactgcatcataagttttgtatcttctcgtttgcagaaatatttgtgcgggtgaaggaaagaatatcggcctatacagaaggattcttgaggttcataagtacgtgttggaaagcttatgaaatttactttcatatggtttcgatcccacgtcaaaatttctcctaagcagttgggaatctgcaaaacaagtcacataccttattcatttcgagtctaatttaggtcttgggcttttataattatgtcgtgggctaagcgccagagatgggctaaccttaggatgttcttaatcatatttatttagtagctgtcatagtttagagtcagggtttcgcttatattattctatcgttgtagtttcgccgcttagttcggtctgaggaaccttaacttgtgagcttcattgtatatttgcaatatattcagattgattcttctattctcttgcttgtcttctcgattcgcttgcaggagatagccttatcggcgaggtcaaccatgtttcgattcaggtgataaccaacggaggggtggtgtaatgattgtgaggggttagaacgtcctgttcggagcttttgtgttagcaacatcaagtctccacagtcggcttatccggtacctagtcctcattaagagctaaaaacatatacagcaaatattaaaacatcgtaagagatgcaagcacaactacaatattaatcaacttctgacacacaaaagcatatgaacgagcatcgaccattgtctctattcttccggtagatctttaaaccaatattatcaaataaaccattggcatgtactctaaagatgttacagccatctggaacatcaacaatccaataggtaagactctttaggtcttttattagggatggtgttgccatttggaacatcaacaatccaataggtaaactccttaggtcttttattggggatggtgttgtcgattgaaccattgataacccgataggcaagactctctagtgctttatcgtgggcatcgtggagaaagaaaagataaaatattttagacaaattaagtttttaataagcaccatgaaagacaaaacctaaacttttataataaaaaaaataaaaaccctaaaactgacttaagttaaagcaaagacgggatctcatttcccctcattgtcagtgttgatcccaggatggaggagaaggggatcacagttgaaaatttcatagagttcgacttgtcacatgtctcaaaattttgcatggcttattttgattttggtgagaactagccaaatttattgttgacgaataggctagatatatcttattaatatacaaccatgtatcatataaaccttttccatgtttaaattttataaaattttgtttcttatactttcatagttgttctttaatacatgttatattaacttaaacctctatatcgtgcatctaacatggtcaacattgatacgacatgctccattgaaattatgccagcatattacagtaaatgactaaaataaaaataagaattaacacatggattaattacttgcattttgcggactggtagactggtaatagtaccatgcctaccgtggttatgataaaatgagcaacttagggtttgctaatccggaccgggctcactttttgtgaagcctgcctccattgtgctcgagacccgactggcctacgagcgacagtgagaatttttccgtttcctagttattatacttcaatttgtgtgataaacgggttagaatgatttattatgttacaccatcaaacaaaattaatagccaaatatataatttaaatatcaattgatcctctatacggtcttagttacaaaattaatagccaaatatataatttaaaaatcaattgcatcctctatacggtcttagtatcatgaaaatacaatctattaacttattaaaataataaaaagaagctccacgttcgctgtctggcctataaattctcatataaatcagagaaaaagaataacagagtccatataaaaatacaattaaaaaaagcttaatttcgaaattaaaaaataaggaatatttggaggaggagattatggcccatacatatatacaatttagagctaagtgaaattcgaaatcaaaaaataagaaaaaaaataaatataaatgttagagtccatataaaatacaatttagaaataaaaaataaaattaaaagaataaggaatattagaaaaagtgcctatagtacatatatgaatataatttaaaaataactgaaattcagaattaaaaaaaatattgaaagatgagtttagagtccatatacaaatacaattacaaataataaaaattcaatattagaaataaggtatattagatgaagagcgagtccatatagaaatctagaactaatcaaagttcagaattaaaaaaagagtagattttagagttcatatagaaatacaatttagaaaaaaaaataaaattcgaaaataaaaaaaaatagaagattgggagaagaatctatagtacatataggaatataataatataatagtaacgaaaattaaaattttttaaaaaataaatattagaagaatattatagagccatataggaatacaacttaaagataaccgaaattcagaattaaaaataaaggaatattaaaagaatggtgtaaagtatatatagaaatacaatttagaaataattaaaattagaacttaaaagataactactatctatcgcgtatatacaatacaataagaatattacacattgctaagtttgaagtttgctcagctaacacagaatttaaaattatattattattttaatatatcttttaatagaataagtaaatatgtatgctatcatacgaggaaaatgaaaattcaacctctgtaaagaagaacgtatctggacatgaaattgggtttttacaattttggacggaagatgcacacgcacaaggaccttaccacgtgaatcgaacggttaaaataacaaaaccgcccaaaacaaacaaacaaacagataaataatcagaagcacgcaaaatcataccacgtcataatctaatcaagcaaaaaaaaaagaaaaagaaaaaagaattccaccccgatcctcactactgtgtcactgactcactgtagcagcaacagcagcagagtgtgagtgctcatcaatccagcccatccccctgctgctgctgctgctgcttcgctgagacgacgagaggaagaagacgagcccccaagccaagcagacgcctcctccttcttaagcttcccaattctttctctttccctcctcctccgcctccgcctacgccttccccgctagtcccacacatccggcgaagattccggaagtttcgtcgatcctccgatcgatcaagcggcgagcggcgggaggcatggagaggtacgagctgctcaaggacatcggcgccgggaacttcggggtggcgcggctgatgcggaacaaggagaccaaggagctggtcgccatgaagtacatccctcggggcctcaaggcgagccttcttcgcttcttcttcttcttcttcttgtcccttttcgtccgctctgttttcctgatcgatcgatgggtgtggggcgttttttttgctcattcgggtggtgatctgatctctgcagattgacgagaatgtggcgagggagatcatcaaccaccggtcgctgcggcaccccaacatcatccgcttcaaggaggtgaggccgtggcggggggcaaattgggtgttcgcccctgttcgtcgcgtcggtggcgaagaatctgtttgtttttttttcttcttgtgtgtgtgtgtgatggaagaatcgtgccttgcgatgcaggtggtggtcacgccgacgcacctggcgatcgtgatggagtacgctgccggcggcgagttgttcgaccggatctgcaacgccgggaggttcagcgaggacgaggttcagcgatgctcgaatcgactctaatcaactccatttcttggtgagttcttgtgctaatccgcgtgagaatggtgggcttttgcaggccaggtatttcttccagcagctcatctgcggcgtgagctactgccacttcatggtaagaacagaaaaacgatcccagtaaacattgcattctttttttaaaaaaaaaaggatgggaaagtgttcaaatgtgaaattattattcgtgatggattcgcagcaaatttgccaccgggatttgaagctggagaacacgctgctggacggcagcccggcgccccgcctcaagatctgcgacttcggttactccaaggtagggagaaggccttctttaaccttttcttgaatacccagtaatcttttttcccctcgaaacctgcctaacacctcttttccctgcccggatttcttctagaaatggacaagcttttcttttttcccttgtcaaaaagcactctatttttaaatgatctatagtcgatttaattacctataaatatatattacactagtaatatttgatcttacctgttatacatacattttaatacatacattttaatatatgctacagctaactataaataaaatttatagccggttacttttctcttttatcatttatcttcggtttatagttacctagtctcaaaagatcaaaactttttcttcactgtttcaattcactcccccaagaaacgccattgcttgcaaacgttttcttctacaaatgctaaaaaaaaaaaaaactcctatgtgctttcttgcctaattttctcccccttttcttacgcgcaactgcctaaaagaagcaacattttcgctttgatcgcaacatgacgccttttttgtttcttctcctcgtcgcagtcgtcgctgctgcactcgaagcccaagtcgacggtcgggacgccggcgtacatcgcgccggaggtgctatcccgccgggagtacgacggcaaggtcagtcacgcccattcgcccatcacttccccttgtcatctgtggcatggtggtggggcccactggcagtggcggtagcgtggggcccacctgctcctggtcctcagcgctgagcacgtgccgtcccctgggagtccacgtatcgcggttctcaaggcaaacactaccttggaccgtagacccggcctatgggcgagctgggcagcatcggaaagtgggtcccatgtgtctgtgagtgttgggtctatgggctactatgggctagggtccatgggggggggggacaggtgcctctgggtggtggatttgggatttgtcctctaggagagcggtggagatttgcttgcctgcggccggacagacgcccactgggctgtgggcccgggattgttcttagcccgggcccacacactgcctcgtgattcgtgacagtagtagtactagtacatgctagacagtgtgtagtagtacgcgctaaacaggctgtgtgaaggggccctgagaccatatgctgctgactgtcactctcagttcagctgagtgtgttttgctcaaaaaaaatagaagaagaagaagaagaagaagaagcttgagtgtgtgtttcttgctgcagctgagctgagctgctactgtagtgcattagattcccagctaatgatgctccctccagtagtggtagtagaactccagtgttttttgttgaaaaatctcttctgtaaaagcaagggagggattattcaaaaggacaggttccttccttttgtgtgtgtgtgatgtcgatctagacattcacattctctctcggtttttttttcggtaatcaactaatcacacatcacgcttgatggggatgctcgcttcgacgaggcgtggcggctgctttaacagcacgccagacacaaaagaggagggggggagaaaagacgggttgatcgaattcgagacggttttagtggtcaagagtttgcaccctgtagcttgttacgtgcccccacttgttgctttattaaaatgtggtggcctgaggtaaagtgagattagccggtgatggcatgagattctccagggtacagatgcgagatattttgcttctcgcccgatttgggcagggttaaaagttcggattctttgtatgtttggttgtccagtgtgttttggcgagtgaagtaacggagtgtgattttgtctttagttacatgcaacgctaagaaaggaatgatttttcatcgtttgggattgaaatggaacagacgtgtagggattaggtgaattgtgacaggatccatgaggtagacgcacccctcagtctgtatttgcagttatgcatgtcattcggttggacagcttgcaatttttgttgacatctttttgggttcacctcatactttatgtccttttctgagcttttttttccatcatggttctagtgctacatattagctaattgacgttatcacaatgggccctcggacccaatccttttcaggtagacatgttagactgaacttctctttggccttttctgtggttattaattttctctctctccttggtgtcagttactgccgtcatatcttatgaacgattttcttcaggacagtgattgcattttgttccttccctatataatacatctactcaggctgcttagatttttcacgctgcaaaattggttgcttttgattgacaaagtggacactgccatagataatttgtagatggaatatcaagaaacattttatcatttgcatctagatgttctttttttacaaccataatgtgcccttgatttcaacaacctataatgcttatttccgagttatagagttatgtatttttcagctgatttgttcccgtcatctttagactgccctcaaccacctgttttttatttgaattaatgctggaataatctattgcataaagaaaaaaaaccactgttgtaccgctttccaaaagattactggatgcgtatgtcctataacagtcatggttgttagcctacttagccattaggtgagaaagcacaaagtgccccacagcaggtaaatgtctgtggggggaatatgtaattaccgaaggacatggatcctctgagatcatcttttctatgttctcatgataacgccaccaccctaataacgaatgtcaatacttatgcttaccataggtgtgttctgtcattacctgtttttatctttgctttagtacataagcgtagcactgatgcttgtctgccttttgaatttaggttcatggaagtgcacgtcatctttcctatcattcagtttattttgtacagaagttagcatccattgtgaacatagctgaaatttgcgtacttcggagagttttgatatttccacgcttctatttggaactttgagcgtactaaacataagtgacagcatgctgtgcagaaaataaaaggagccaatcaaatagatgtgctaaatggtgtaatagagcctttgatttttgtttcttggaccattttaaattacagagattattctgaaatgttttgatgatcgaaacaagcacgattaatgttctacaggctgttctgccttaatattctactagaaagaagtgtactttcatacatcctgttcttgcttgtatttatcctttcatttgtttctatcttatctcctgaattcatttacttgtctcctaacatttttggattggatggttgatgcttcagacagccgatgtgtggtcttgtggagtgactctttatgtgatgcttgttggtgcttacccctttgaggaccctgatgaccccaagaatttcagaaagaccattggggtaacaatttaagaacttttcagctaagcattatcagatcacaacttctagtctcttatgctttgtgcattttttgttctcagagaataatgtcaattcagtacaaaatacccgagtacgtccatgtatcccaggactgcaggcaactcctttctagaatttttgttgcaaaccctgcaaaggtactactctatttaaactcagatcaacttactagacctattcatgatttttttaaaaaaaaaatcattcccaaacttcatacagagaataacaataagggagatcaggaaccacccatggttcctgaagaacctgccaagagagctcacagaagctgcacaggcaatgtactacaagaaggataacagtgccccgacctactccgtccagtcggtcgaggagatcatgaagattgtcgaggaagcgcggacgccgcctcggtcctccacccccgtggccggctttggctggcaagaggaggatgagcaggaggacaacagcaagaagccagaggaagaacaggaggaagaggaagatgctgaggatgagtacgacaagcaggtgaaacaagtccatgccagtggtgagtttcagctcagctgagtatttctgtccagcagcacaggaagattgcaaactggagatattgtcataatgtggcagctgatggtcacactcccattctgtagtttgcagtcttgtttttcttttttcagtttcattttttcttttcttctctttgatgctgcaacagtgtaaattaccaaagtggttctgtcactgtctttgtaatgactgatttaagttagcatgcagaaacataatgtattgaataaaaccatctcattgagcatcttctttctcagagttgcagtccctctatccttgccatcctgttactgctattgtccatgtattcggttcatcgcttgggttgggacagagaggtgagattgcagctcttcagaaaggaaaattttgtcagtaaccggaatggtgaaattacaccctccttaagacaaacgaacaataatggattgtggaactaacaaaatggaccaatgtacatgatcaggggcataatgttgagtccaaggtgtacataggaaacataagtgacaataatagaaaatggaacaatgctttgctgaagaccaaatttagggggttggagtgtgcattgtagttaactgaacacagtttgccactcccactgatgtggttacattcaaaatgtgacagcaagagaaaatcctaaacagaccaaagcaagaaccaacctcatcagggtattccgccatcaaaatctgcaacgcaatcggcaattccaccatcaaaatctctgtttgcacaaccaaatcttacacctgaatgatgattcgttcttctatacatatgctgccaatca

SEQ ID NO: 21126 - DNA, 3928 bp, Oryza sativa
tgagctcagttcaccacctgcgaaggaaaattgattaaaagtggataagaaaatatgtgattttgtttgggaaaaagaagaagaagaaaagaccagtgatttgcagcgacagcctagacctgtaatcatttaccgaatacaaaagcctcacagctagcagcattgttcttcgatcgatcagtgcgatgaattagtatctccgcatataattaactaacaggtatacacacattcacacaggaattgacagatcaagatgctcgaacaaaaaatgtacaaatctgacccacagatacctcattgttcaatctaatttttttttccatcgattcgatctcctttccaaatcaataaacctccacaggagtagtactcctatacccaatccaagagggcaatgtgtccatcgaaagcaacacgcgtttgtttgatgctgccctagaaattatcaggagctccatttcctgtcactgattctcgtcagagcaaaacgcagagagctgattaaccaagtcgctgtcgcgtgcttgattccacactgggatatcccagatcgagctgccgatcgatcgatcgtttctgcaagcgagaagccaatcaagaaaaagcttcacgcgaacgcatgcatcgatcgacagcgacaagaaccgtgggactttggagagaaatcacgggcgaaagcgatggatcgaaaattcgaaatatcgaatcgaatcaaaagccggcgatgccggataattctatttgcatcgtctcgttgatagctgctcatcaattgctaagaagctagcttggcatgtggtgcattttcatgtccacctgccaaaatggaatctcccatttggggggtgtttggactcatgcagtgtctgaaactctgaatgcgacctgcgttttctgaaactctgaatgtgacctgaactttttgtccactccttggagaaagaggatggaaatatacgttccttacattgacctgaaaaactctgaattctgagagattgcagaacaagtaattaagcagagtttggtgagattcgatggaaaacatggagcaaaagaacatctttaattgctcggtcatcggaggtaaaaaaacaattcgcatctggttagcgtcgtctggatctggccggggtgagggaattcagcgttcctgcctgtggaatttggaagagtctttgctcctgaatttaagaattccggccaagatttggagcatcttgaataagtcaaaaaagatagttcttgtgaatcgagtgctagtttcacacgtactggttgatcacaaagagaaatcgtacgtgtcgctattcttcaaaagacatagaacggtggatgaatgggcacgcttctcgagcttctaacaatgctgtttcttataagaaccttgcatttatgaatttattagaaatattgttgaaatccattttcaactttataatattcaatttcattcttatgtacttgctctgttccaaaataactcaaactatagggatgaattatatattttggaaaagagggagtacactcggataattatcccaaaccattggactattcaaccatttagtacaaaaaatatattttagtgtcagttacttatgttgttttttcaccttaattatcagctgagctggcgcctagtccaccatggcttttcttttacatgtttgcatgcaaatatggacttttatcgtagtacttcttttaaagtttcaacatgattttgcgtttcgaaatggctgtatggtttacacctttctacacgcaaaagaacacgattttaatgctagggtgaatcatggtgtcgatctgggggaccgaattcctattgtttttcagtacggatcatcctgtttccttttctttttcagatgctatgaagaagaagcaaattagtatgtctcatccatagaattatatcgattctcattcacacgcatgaacgatcgatgctaattgagaaagtcagatcgaagtgggggccattgtgcagatgattaattctaagtagatcactgtctatgatgatctctatcctctatcctcacactgttcataaaaggagattaaaagtgattaattaactttgctcggaagagatcggcacaaatggcagcatttcaacaatgctatctgcccagcaaatctttattaggtgcagaccaacagtttggtgaaccactcctgcatggtgcctacttgtcctactatatgtgtattatctcctttctaaatgcatgtgttgacgcctttttgtaaattcttgatgattttacctttgcagttaaggtaacttccttgcattgtcagtgttgaaatgtgattggagtactacaaagtaactgctagatcagcttgtttactgtatgtctgaatctaagaatctaaggctgtgtttagttggatccaaagtttagattttggttgaaattggagatgatgtgactgaaaagttgtgtgtgtatgacaggttgatgtgatggaaaaggactgaagtttggatccaaactttggatctaaacacggcctaagatatgaaactcagtttgattttgacttagcatgaggtcaattggacagtaggaactttactgttctgtaggagaaaaaaaagataaaagaaaattttcaggatacaattaagctagctttaactctgaggattacttagttagctgatcatgcatatatctaactatgtattaactgaaaattatcatgccttgcttattattatgtactcatgtgtatataattcttttcaatctagtaaatctagtatacatgtatgaactatcaaagtataagagaataagaacaaaattgaatttgaatcaagcatcgcaaatcaagaataaatgaacaaaaactaattagaggcgatcctaagaaataggagaatgaactcatagacgatctctttttttttgtatgtatgtatgaactattaaatttcctgtactgtatatgtttgagattttctctgctgctgtcaccgacatcgccgccgccgccgtcgccgccgccacaaggtcgccgtagccagagccatgtcacgccacgccagcgacatggccatgccgccgtcgccctccacgacgcggaacccgccgccgccgcagccgctcttcatcttgagcagcagcttcgcctggctcaccgtcctcgagctcagcttcacgccgtcgagcccggcgccctccatggccgccttccagttccagctagctgctgcgtgatcgccgccgccgccgccgccgccatggcggcggcggtgttggtggtctagcgaggccacggcgtcggcgatctccctcccgaggtggtccctctcgatggcgagcctctcggcgctgtccgccgggaggcactcgtggagcgagtcgaacacggcggcgaagtatcggaggttggcggcgaaccgcgggagcaagctcgcgcttcttcctgtagtggtgttgtcgccgccggtgagcccgccgccgccgtcgtgtttctcgatcaagaacaccatggacgggttcagggagttgatgtaagccattcttgtggcggcgcacgcttctcttgagctcgccgggaacaccaggttgacgaccaccgtcgcgtcgtcgtcgatcctggtgcaatcatggcgggtgttcgatccgttgttcaggatgccctcgaactcgaaccgtaggttggggcagccggcggcgaaccgccggagccgcgcctcggtttcccgtagctcgtcggcgctcgcgccgaagccggtgatccgcagggacaccggaccgtcgccgcagccgcctccgttgtcgtcgtcgtcgtgggatgaactgctggtggcggcggcggcggcgtccgacagggactggatcagcgaaggccactggaacccgtacgagacgtcgaagtgacgacgtggaggcgg

SEQ ID NO: 21127 - DNA, 1178 bp, Oryza sativa
gccgccaccatccgacgacgtcgccgccattccattttcatggtcaaactcctccgccttcttgaccatccgatctctcaccctgctaccccgatcgccgccacaaatggcgctgctgccgacgccatcgacgacgacggcgccgccccccaccaccttactcttcttggccaccgccgccgccgcatcaccaccaccaccaccatcgatggcaagactcaacttcaagttcatctactcctcgtcaccttgaaatcccaatcgatctccaacctccaagagaaacggattgatgcaatatatcttcttcgtctgttctccaagctctctcgcatgcggcaatggagatcaatggcggaggaggaggaggaggaggaagaggaatgggtggaggcgaaggcgagggatatatatataagcgcgggaattggaggggaatctggcgcgaaatctctcgatcggcgtagctttggatgcaagaaatgcctatgcttcgcggacgttttggctggactcgccattggattccaagaaatggatatgcggttgggtcgtttggctttcctctttgtcctctgcaaaaggatctatctgtctctctctctatgtgtacctgtcatctgtcgatattgtaccggttccactgctaggctaggctaggctagctatctccctctctgaccctctctttctctggtctacatgtagcttggaaagaaattgttcattattagtgtttgtgttaacaatgtgtgtgatagatgttgacaattagttattactcatatatagtagtataattccagtgtcttagtatattgtaccaatgtttatgctttgggttcaattgctatatgtcatgttcataccgcaggggtgtgcttctacactgttatgcctggtcccgtctgaccatatgggcatatatatatatatatatatatatataaattgctcatgacaagcctcgaccgatgcaattttatattctgggggaggtaatgttcagacttcacacttcagaagtactccaatatagtttaaggtttgtaagctagctttgagattccactatggttgttactagtatattacataacaagcttaacattgactcatgcaagctatagcatcatcagcgtgtacgtcaagaacatggagcatacgttctgtggact

SEQ ID NO: 21128 - DNA, 3389 bp, Oryza sativa
ggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgatgatgtggctgctcgctgttgcggaaacagtggaatggatgggggtttgggatggttggggtttgacgagctgggcgggttgaggcgggaggagggtttgcttagggtggaatctgattggccgcgatcggcacgggtgttttggctgtatcctatagcgtgaaaaagataggaaaattactggttgtatcactttttgctgggtcaggtttggatagaattcaatcgtgttttccctccatgtcttttatccgttgaaatggtgccatatgaaatgtcaggattagttataaattctggttgcacactttgtggacgatttctgttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaagatggaggctgatgaggatggtgccaatggcggaactggtgggacatggactgacgaggaccgagcgctcaccgccagtgtgcttggaacggatgcttttgcttacttgacaaaaggaggtggtgccatatccgagggccttgttgctgcatctttgccagtggacttgcaaaatagactccaggagcttgtcgaatcagatcgtcctggtgctggttggaactatgccatattctggcagctgtcgcgcacaaagtccggtgaccttgtccttggatggggggatggctcttgccgtgagcctcatgatggtgagatgggacctgctgcttctgcaggtagtgacgaggccaaacagaggatgcgcaagcgtgtgctgcaccgattgcactcagcattcggaggtgttgacgaggaggattatgccccaggcattgatcaggtgacagacacagagatgttttttctagcatctatgtactttgcatttccacgccgtgctggtggccctggtcaagtatttgcagcaggcgtgcccctgtggattcccaacactgaacgtaacgtatttcctgccaattactgttaccggggataccttgcaaatgctgcaggatttagaactattgtgctagttccatttgagaccggtgtacttgaactgggttcgatgcaacaggtagcggagagttctgacactctccagaccataagatctgtgtttgctggggcaattggcaataaagctggagttcagagacacgaggggagtggccctacagataagtcaccaggtttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggtgattgccgccatgtctcgcgtgatgaactcagggtagaatcagttggggagtgggcgccaccggtagaggcagctttacttcgttcgctggttgcagacaagcagcaagcagtcggttggacggacacccatccacccacctttcagcgctgttgatagaagaagtttgtaggcagagaaagaaagctcagattctgacttagcgatccaaggggaagacaaagctctcaagttaaaactgccattgttgtatggtaggcttttgtggtcggttagtttttctctttttgttgtttattggggagaataccatgttcttagtttattgcttgtggcagaaccataaacagtacatctcgtcaaatgcatgagttgggaaagaagtcacctgcttttctgctaattctgtgtttttgtttgtatctcaagtgagttggtgtttatacttcggcatgttactcggggaagctgggctacatgggccagtaggcacatctgtgatctgtgttctttcaatctagtgaccttttggggaggtgactctcatccatttccatatcaggtttttgtcggttcttattttcttagtgtgtgtgagaggaatgaaaacgagaaaattgaaaagacacgtaagaggtgagatattagtcattattaattaagtattaattattttaaattctaaacatatattaacatgatttttaagtagttttatagttttttttaaagagataatccataaaatgccattgacaag

SEQ ID NO: 21129 - DNA, 3854 bp, Oryza sativa
gccccgcgcatgcttttaaattactccctccgtcccagtatgtaacaagttttaagctcgtggacaagtattaaattttaaactggtaggcggcaaaagcacatacggcaatacaaactagtactctattcttttcttctctttcactgataactatgctgaggggtagaattggtagatttctggtaaaagttgtactaggttgtaacatttgggacaaattttgaatgccaaaacttgttacatattgggacggagggagtactaaacagtgtgttttctgcaaaaaatttctataagaaagttgttttaaaatatcatattgatccatttttaaaatttaaaatagttaatacttaattaatcatatgctaatggctcacctcgttttacgtattttctcaatcttctcttttcctctccttccttgagggcgtaagcttatctccccatcaacaacatggggtaagtacctgaaagaaccaattacaaaatttccttgcgcatctcgtatgctctggctcctctgtactcgaaagaatgtcaaaaacaaagcatctacatttaccttgagagtttcttcctgtaggaggtggtttatgccatccttcatgtggttttgtatctgttttttgcttgccattttataatttagtgcaagagtaataatagatatagctgatctagtagccatttgaatcatttcaacattcaccatttgcctcctttcccaccaaatataccgtattcccctatcgaaacaatttcagcaaatttcaaatcattgaggtgtggttacctcctctcatgattgtcttctagtaaaacgattgtcttctagtaaaacaaaacccgattgatcaatattggcaatattctcaattttgtttcaaattcacatatttatccacacttctatatagctctatcacattgaaaataatatgtttaatatcctcacatatacggtccaatcgtttggtttattcatcatcatgaaataaaccaaacaacatatttgcaaagaaaaaataatttgtaaattttatgatcgttaatagaatattataaaataagttagcgagaatgtgtattatgagagacggagtaacaaattaagttaatatgcaaggacgagccgggggagtatgtaatactagtattatcaccatcagtcatcaaccattcttactctttcgttagatatgataaggttggaaggttcattttgcctctaatatagtctgtattaatgaaactaatcactagattaagtctactaagtgattattagactaaacaacatcttctggtggcttggtgcttacgccacacggaagcttattagtagctactccctccgtcccaatatgtaacaagttttggcattcaaaatttgtcccaaatgttacaacctagtacaacttttaccagaaatctatcgattctacccctcagcatagttatcagtgaaaaagaagaaaagaatagagtactagtttgtattgccgtatgtgcttttgccgcctaccagtttaaaatttaatttgcgtgtgagtgggtttttactgtgtttaaccagctttctggcgccaatgtgtttgaaatgcacgtgtgagtttgatggcagcaaacagaccgccaccactgagttttagtacaggaataatcattgagggtagtatggtctttttgcaccttttcttaatacttgtgaacaagcttaaacccccgcctcgtttctggaagattctctcctcccccgctctctcagaaacaactcaaatcacgattcgctcctgcaacgctgcacgcgcgcggcacgaggagtaggatgccggcggcggcggcggcggaggggaaggcggcgcgcgcccgatcgacggcggcgacagcggacgccgcggccgacgacgtcctgtacgtcttcgctctccttcgtcgacgtcgtcgtcttctctgtctatgagaatctagttctcgcggtttgatcggcatatccacaggatgccgcggggcgcggaggcgaacaagggagcagcgggcgggcgcgcacccccgcccccgccgcggcggcggcgaccgcggggcgggacgacagccagtacgattccccctctccttcaccttctcttcctgagaatattgcgttctcgcgagtaatgacatctagcattgcaggactcgtcgcgtcgatggaagcgcggctggagtttgcgcgcgtcagccggcgaccgcagcgcgggaggtgggcacagcagcagcaggaggcgtggctctctggttagttcgtcgtcgtcttctctgcggccggtttttcggttgagagtttgtgaagcaaggtggtttgtgtgtgggggtggggggtggtatccggatcggtgtgtccttttttttttttgaatcgcaaattcaatttaattgtcgggattgggggtggtaatggcaatctatttctgtggctggttcttagcgtttcgatgtgtgctgtgtgatgagttcttgatgcggtaggctattgcgtcacttcggtctctagaagcgaggaagattctgtagtgtttgctttcaaatgctttggcaagttcgattcggctgtagatttcctgcaccaaacttatgttgggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaagagctcggaagcgagctgcatgctagcggtccatcatattcaggtgtagtttggccatcaccaatgtgcagtaaaagtttcacaatcacccaattaagcatgttgatgaagccactttgacaagcagcgaccaaacattgcgtacctgtgcaccgttcctaatttctgctgtctcttgtgtaaggaactaagccagcttagttggtcgatagctagtgtgggtgtacacctagaccaaaagttttatcaagttgaatttgggtgcctattttcttgttaaactagatgaatatcccgccgcgttgctgcgaaaaattacgttgcataatatgtacaaatgtaatttgattatcaaaatgaaaataatttgatacaattttgagtctaaaaataattaagattgcatgttttaagatagaagaaagaagagacaatttggaccatagctctatcatccaaaggctagaaataattaggggaatatagcttaatgagagaagagataaataatgtattaactacacttaataagaataaactatagtatataagattacaaagtcgatcctaatattttctttatcttcttaaaataaacacaatgaactcgcatgtttttgtcttttctgtttgaatgatgtatcacagaatgccctgcaaatttgctgacctttttaacctgatacgtcactgatcggactttgaatcatcttttattattgttggaaggaaaaagtatatatgaggtcctcatcttgtcatcgaattacaaaatcatcctccacccgcaaaatagatatatatcatccctaacttacaaaaccggatcactctaggtccttaggtggttt

SEQ ID NO: 21130 - DNA, 1541 bp, Oryza sativa
cagtggcgcttcgggtcccagtcccctctcctccacgaatcccgccgccgccaccatgaatcgcaccgctgatggcatggagatacccaagttccatcaagccatagtcaccgatcagcgctgctccaccctcgacttgctccacgtgatcctccgcccctcccctatccaaccctcctcgcgaatcgtgactcctcctcccaccacagggactcctcggaagttgactgcgatcaggagtgccgccgcgacgaagactctgcacgaggcgcctgctcccgcgctgccgccgctacgtgactgcgtcgcccgtcgccaaccgccagacctcctcctctcccgcctcgcgccctcgccctgccggccgacttgcctataagacgagaagtgagagagagagaaaggaagaagggagagaagaggggaaagagagagggtgctataatatttataatactaaattagtttcatcaaatcaataattgaatacgtcgacttttgaggtctcgactagacgaatacggtatttgcatggtatggggatcgtcagtaccagggtatatgcgagattgagtcaaaagcgacagagacaaggattttatacatgttcggaccccttcacaggaaggttacaaccctactcctgttggccgaagccggtgttactctatattcatcagaatcatacaagtacaatatttgggataacccatctagatgtcgttgacttggcggcatagataaccaacacatagtcgacgacaggatagttttcctcctcgaatataaactcgccgagatcagagatggcgctagatccctcttgtcgacctccgcaggcaccagatagggtttatttaggcttatctctgatatcgatgtttggcttgtcttggcttgtgcgttgatatgttgtcccttctctcctcctatggggtcttgtacttatacccatagatatctccttgtccaagtagaactagggagaccaatatagataaaatccaaatattccttgtagtttccatatggaactctactcatcctcccttatccggaactccttctatatatgaggtatgatttcgtataggacttggtatatggttggccccgcctagcttagtcaattactattgggtatatggtatccataaccctgacagaatatattttcataataaatttgtcttgggtctaaaatgttactacttttttctacaaatttggtcaaacttaaagtagtttgactttgactaaagtcaaaacgtattacaacctgaaacggagggagtaataatctaaagctagctcttttgctagcttttgattggtccacgtggcacctcttactttgaagaaaaatcataaatttatagtagagaaaaaaaaaacctaacaatcatatgtgagaaaaatctagagaaaagtatcacatatggatttcagaggctttcagaggcctccgaaactatctttcctttcccatcacacgaacctgtactcctttgccctgtataaatataccacgcctactcgat

SEQ ID NO: 21131 - DNA, 712 bp, Oryza sativa
tttttttttcggatgacggagtgatctgatatttcagctatgttatatggttatctgtgatcttcttggagattttgcttcctctttgatcaatttggttgtactgctcgttcttggatacgatttttgttttctgtttaatgactgaaatattggtgtttacttccatgggtaatctgaatctaattcgcttgtcctttggttggttgttcttgagcagaagagagggagaccaccaggttccaagaacacgaagaacaagatggagcagaagatggaactagtccatcaaaggctcgccttacttgacagcagcagtggcagcgacagggatgacgatattgggccgagggtgagattcttgcattatcatttcccattgatgcgatacatacattgttgttgttgcaaggcattcaaatcaggacaggttctaactggaaaaaatgggagaggcatatactacaatacctgggtgtatgcccaatctggattcttaatttgataatattatctacttctacttaaatgctaccctgaataattcatgtatcgcagcacatctgtatgttgatatgtcacttcacaatctggattctatccgctcgttcttgcatgtttatgaagtgacatatcacatattaatctactccctttgtccccaaatataagccatttttagtaatgaatatggacaactgtgtgtctagat

SEQ ID NO: 21132 - DNA, 3216 bp, Oryza sativa
tgaaaaaatgatgcgcccatttcaggttctctagttacaaaaagatactaaattcaaattctgcaccagagattccatattttagtatctgtaacatataaaaaaatgagtttgcttacgaacatgagctatgtttatgttaatagttttgctaaggacaagtacaattgtcctaagcaacatctgtaaccatcatgctttgatatttctgtctattatgcttgaaggtgcctgagatgctgcggatgccattgactgagctgtgtttgcaaataaaatcacttcatctgggtggcataaagtcatttcttttaaaggtatattttatcttatcctcatcacttgtctatttttgttttcttcacatgcatctatgcaatcttgcatgatctctctaagattgtatgaacggttatgcttctctgaatgtgtttgtgcagtatcattagttgatgcagtttttgctaggaatttgtggacaactatctgttctactttttttctttaccagaagttctgctttctgtttgtgtcagctgtgaaattgtgatgccaaataatcatatttcatatcgtattgtttcaggccatagaaccccctaaagaagaagctatctcctctgctattgacttgttatatcaggttctattctgccttttgtcatataaatctttattcatgtgtgcatattagtagcagaaacatttttggcatatccttttgtagttcttaaccaaactttatactgtctggtgtcatgtgtaggttggagcatttgaaggacatgaggaattatcacctcttggctatcatttggccaaattgccagttgatgttttgattggaaaggtgcggctaaaatataattttctggctcattcatcaaaagtgacatagatatttaatgcatacatttcagcatagtaactagctacatgttgttgtttgctagcatttgtctgtgcatggctgtgtggcaatatcaccataaattcttcaatgtatgtaaatatatgagttagttgtaggcattagagttgtataactttttatatttccaaataagaaaagatagcttgctgtatctaacctcacatttgcattggagattttgtttgtcatgttaaatggcgaagtagcagatagttgttaatgttgtttcttttcttcaatctgcgtgcaaacaaagacagcccagcccttttcatgcctaatctatattcttatgtacataaaaaaaattccatatgaaatacctttttttcattccattccttaactacaactttaatcttcagttcttcactacagtgccctattcacaataaacttcagtgagctttattatgttccattttttccgagaacgcccatgggaactgcatgtcattccattaaagaaagaagaacctacagtacatcacaactctattatgttcttcatgtccctttggaatgtctttatttcctaccttttatgtacttaactctagtgcacagtaatttttgtaggcaatactgtattttttcacacctctgtaattgactaacagtaagagttttaccacttattttttatatctgtggccctttgagcattcccaatggtattatagttctatacagataattcagggttcatagaaataaatagtttctgcatgttattaacaaataatgacagtaattgttatgtttgttccatcgatttgtggagcatttgtagtactttacctatttaatgttttgctttgatttgtcttctgtgcgactgcagatgatgctctatggtgctatctttggctgcttatctcccattctttctgttgctgcttttctgagttataaatccccattcatctctccaaaagatgaggtattatgatattatcgtggtcaataatttatataatctggatatgcactatcatgacattgtttcattgataatgcagaagcaaaatgtggagaaggcaaaggcttcattgatgaatgaaaaccttgatggatctgcttctacagcagataataaacaatctgaccacctgttaatggttattgcatacaataagtggtctcgcatactaagagaggtcataaaacttatttcatctactcgaatacaattttgtgacattagatacatttgttacgtgctcatgtgtacttagtatcatgtgttcctttatattagactactatcagagtaattttgcagtatatgtcagcctgtaaaaagaaaaaagaacatcagttccaaggttttctaatatgtgattttcaattgcagaatggagctagatctgcccatcagttttgccgttcattctacttgaacagtacagtgatgtatatggtcaggttggactacctcagttagtcagtttatactttatacaaaagcttgatgcaaaagaataagattttcttaagggcttatccgaatttcagttacagcgtttatattttcaaatgttagactaattttttgggttatcaatcaagggcaccttctttaactacatatatgtcaccaccactaatctagtaagagagaatcagtatacttgtgttatgattttcagaaagtttcattcattaatggattttttctgcaaaaatatttaaccgtggtagtgcactattcagcatggtcttaataacacttcaaatcctatggtctcaaattaaatgtgtgaacttagaaagactaagtttaggtgggtaaattccccctatgtgtgtatgctacaagaagtcacaaactgtttctcgagtgactactgattctataagtgcaaccattgttagagtcaagtttaggtgtgttaagttttcttttttttttcctccagatctgctagagtcggttcagcaactgtctacgtgcaaccattgtttctaaagtttattcatatttagtatgaaatataaagctactctctccgtcgacaaatataaggacttcaagcttttgaaatttgtccttgaatataacaatgtatagagtactatacttctcttaccaaccacctcatttaattttcaactaattttacccccaaccacccttctagattttttacgatttggtccttttctaaaacttattttacaaagagacccttggaaaaacttatccaggaatagttctttttgtggcaccagaggcgctgccgccgtggtccaactggacggcaccaacatctttggcg

SEQ ID NO: 21133 - DNA, 2018 bp, Oryza sativa
ccgcgcggttaagtgccgcccaccccctggggagagtgcaccattatggctggagccatgaggggaggggtggcgccagtatggctagcgttgtcctcctgccacgttagcgcatggcagccacgtggtggcacggggacagcgccaaagatgctggcaccgtccagttggaccacagcactagcgtctctggcgccccaaaaaggaccattcatggaataaatttttctaggggtctatttgtaaataagttttcgaaaaggaccaaattgcaaaaaatccagaaccacccttccctccctaattaatactcatttaatgaggggcatatatccttttctctcatccttagtctctccaatgaagggtaaaagtccttatattaatggacagagggagtaactaaatttcacaataacacttttttaccctttcagagacatgcgactacagtatgggacattattagcagacattggacttttggatattcctaaagatagcctggtatgtcttttcattatggagaattgcactagggatatcatctttactggaatgcagacttatatcatgttgttcattttctttagttgactgagtcataacagtgacaattttgtatctctagtccttttgtcctacaagctaagtatatgatgactagcaatatataatcatcacatgattggacagctaaatgctacagtacatatagagttgtagttggaaacataggctcctgtagctcttagcaccttagtgacaaccttatgactagttcagtcaatcacttcatatattacaattgactaatttataccaatgaaaagttataaatgcaatggtcaaagtcacatgaagactaaaaattagataatgttaaaaaaggactaaatttgagggagcaagttagtttctttttgggaactttaaaagggtaccctaacttaaattggtaatgtactttcccagccaaatgctgccaaagtcctctatttctaatttgaacggggacagacatcataatcgatcttctaatgtcaattaatcctaatatttttcagaggcctgtggatggaacgaggaaaaatactcttgagagttggtttgcgaatatgtctcttccatttaacttatatgctcgttactcctcagttgtcaaggtaatggcatgattgctaaacatttttgactttttttaacatgtgccaaagtacaaaataaatatgatcatgttgatgagattaatatcctagtgtaatgcttgtttacctttagtaatctgtataagctgttgtttcacttagttcaatttgacgctaatatggttcatttctggaaaatgcttatgtggcatttgcagtcagtcatatgcgcaggtctataccctaatgttgcagctactttagagggtgttgatccaggagctctaggtggcaggaagccatctgattttctgtctggaaaggaccgtcctcgatggtatgatggacgacgagaagttcacatacacccatcatctatgaaccacagcttgaaagctggtcaatatccatttttggtgtttcttgagaaggtatccttttgacttgaacatgaatggggtgcaccattatcattatgttgcataagatacacttgtagaaatgtggaatgatataccatataaaaaagtatttacgatggtgatctgaggaaaaaatattgtatttttgaatctctgatacttttgattctctctattccctatattcaggttgagacaagtaaggtatttctacgtgatactagtgttatttctccttactcgctccttctgtttggtggtaccatggttatccaacatcaggtattgtggtctctatccaatcctagactattaggcttaagataccgaacccccatcctcttatttctataagggatgcagtgcctgtgccttttcttgtgctcacatcacatgttagatattggcacttgtcaatcaaaagagaaactactcagtataaattatt

SEQ ID NO: 21134 - DNA, 982 bp, Oryza sativa
atatacatacgcagttacgcacacggcattgtcaagaaggtgcaagaaaaagttgagctggtatttttgaatttctctcttctttgatacaagaatcttactacatgtacataaagtagtttttttttttggcaatcttcagaagtttcttttttacaaaaagacaaaaaagagctttggcttacaaatcatgaatttgttactcaagccaatatatgtagagatgaatggaaaaaaagtgcttgccactccaaccaatatatatatatatatatatatatatatatagagacacacacagccactctagccaatatatatgaataagatgaaaaaaaatagggggattaagagtccaatgtcctaaccgctagaccatggaaccattcgttggtacggagaacaaaacaaatctaatatccattatatcaaattcaggaacccatttccacataaattccaaggatttattctgacattaaaatggaagccaagaaccactgattgatgctaataacatgccaattatagattctgaaacatgaagctccatctcagaaaacaaacgtatacacacaagtatgaagcatatatatttacctgaagttggggtcatccctgtagctgacaaattcagtctcagaaactgctactccttcctcttgagaggaggaagcagcagcaactgcctcttgctccttggtcaccacagaagcagaagagttggatgagctgctgctgctgcacagaatgctccctctggccgcctgtggatgcttcttgcagagcagtgaagagctgaggttgcctgtgaggaagacggggttgtggacggcggcagaagcaggtggagcagggagctgcagccacagggaggccgccattgttgcgcctcctgccctctcctctgcttcctcctcccggtgaggtgagagagagagagaaatggaggtggaaatttgggggtggggggggggggggg

SEQ ID NO: 21135 - DNA, 5799 bp, Oryza sativa
aatgactaatcataataacgttagcctatactttatgtccagcatttttaaagtttgggtgtatacttggatacattctgaaaatgatcttccgtcttaaaataaatttatttttcatctatcctacacatataccaatacaaaattaaaaaaataccctcaatcaaatatcaatgtaattatttctcaatttatctattcctaatgcatttatcctctacttgcttaaaaataaacttattttggaataaatggatgaagccaaaaatgattttattttaggacggagggagtaccagtctaatgttttttgccgttgttcataatacattcagcaacagcattaccaataatgtcgcagtgtcaaggctcaatagtaatcaagccagtaaatcaacaatctgatattgctactcttatcataggatagtagtactttcaaagtttcgatacaatttcgctattacacctggtagcaatatgcaacccatgaatgccatgaggcactgggatattacgtcagctacagagttttgcaggctggggttgaagttttgaacatccttgtccagcctagagaatgttaaaaatctgaaataattctggaagccatccttggtgatgcacactgcctcctacttgatcacctcatagacaaatttgcttacatttccaggcttgaaatttcttggactggatcacctctcagctctcgctgcaagttggaaaatccaagtgagatcaactgatatgctacaatgtacgagcaagatttatacatgtcatttcttatacaaaaggagttttttttcctcaggaattctctgttttctgtaaaattcctactaaaatcataaaaggagtgtgtttttttttcttggaacaattcttagtttcctatgaaattcctataaacaccataaactcataatcatgtgataacggaatgaattgtgctgtgccataagctcataatcaaaatactccctccatcccaaaatgtacgacgataactaacattataaaaaaacaaaaaatccctccatcccaaaatgtacgacgacaaccagcatcataaaaaagaaatccctccattctaaaatgtacgatgataaccaacatcataaaaaaagaaacggagggagtagtaataccttttgtattttttttgttgttggaggggaccttcttccctctgccggaagccacatcgtccatgctctgcccctgcctccggtaccggccgccggaggcgacgaagccggggcacggccggtacgccttgataggccaccacccgaagccggggacggtggctatgccgccctggatccgcccctcgccgttgcaacccctctccacctcctcccgcccgcaccctctgcatcccctgcatatacatacgcagttacgcacacggcattgtcaagaaggtgcaagaaaaagttgagctggtatttttgaatttctctcttctttgatacaagaatcttactacatgtacataaagtagtttttttttttggcaatcttcagaagtttcttttttacaaaaagacaaaaaagagctttggcttacaaatcatgaatttgttactcaagccaatatatgtagagatgaatggaaaaaaagtgcttgccactccaaccaatatatatatatatatatatatatatatatagagacacacacagccactctagccaatatatatgaataagatgaaaaaaaatagggggattaagagtccaatgtcctaaccgctagaccatggaaccgcttatatccaacatcctaacatatttaaattaataaacaaaagaacttgtccctgccgattgctaggtccaggaaacactgcattatgatcaatataatggtcctatagtgttcctgttcagttgattcttgtcttgtgctgaaactctgcatatactatcaccaacctaacgaaccaccaatacttactaaatttgttctcatttcatttggttctcgtggaatcttcatagaatttaaaagtcatcaagataaaaaaaacgctgtctcttctctcctctgaattccatcagttgcacgaacagaaactgtcagtcacactcgcatggcagctgacatttgatttcccaggctcgccgccggccggcggcgccggcacgctcgcctcgtccagccacgcaccgccgccgtggctgtcgtcgccaccgccggctggtgttctgctgcgcgccggcggccggtggacggcgctaggcacggggaacggccgcggtggcggtgtgccgccgttcgattgtctttgagcggtccagattgagtgatcggtgtttggtcagcgattttgtttgggccttcctgggtgttttctgggcttcaggcccaataccacacgtatcatttccaggcccacctctttaggagaggatataagaaaattgagatatttaaatcgaggttagatgttagcacatgattaatggatgagtattgattattttatatctagaaaattgattaatataaatttttaaagtaattttctatataacttttgatagaaaacgtacgtttaacggttcaagaagcgtatgtgcgtggaaacaaatcttccatctttctagttatctcgaacgctgtcttagtttaaattttagattagactgcagctgccggagttcatggcatggatgaagcacatcgtcgccggtcgccctcacccgccgctgcggccacaacgtccatcgctaggcaagtagaaccctaacatttttaatggagcgcactgtgcacataaatttggatatagagattgtacttgtactcttgtaggtgtaattggtatgtgacttctcacagttggtggataagaggtacctgtccttatatgcaaattgcactatatatagtctataaatagatcatataatgttatagataggacaggcctggttcattatcaaaacaattaaacctgaccaaatattaggaatatagtggattttggtatacttttacactagtgactttcgggagagatttgggattacaccatcatataaaatagaacccgtctaaatgttatccccataaatagacttcactaaaatggcattctcaaatagaagctacacgctaaaccttttgcaatttaaaatgatagaaatgtcatttgtccctctacttatcttccacctccaggctcggtgcaacaattggggtgggaggcggagtcatggagctgatagggtcaacgagatgatggtagatcccttaagtcaatatcatgtgtgttcttcagtgataaggcatgcactatcactaccacctaccacattggagctccacaaaggacagttggtacatgagcatgatgagaaaggacagccaacactggagttccgtgagaccaggaacttgaggaggttgtggctacataggagcttgacgaggacaatgatgcatgggcttgaagagatcacaacgcgagagctggatgaggacgacaacgtggaagctaaaggaggttggcgggacttgtgattgagcattgggccttgagctggtggcagtgcgagaaagtgcctaggacggtagtgaaacatcaaggactaaaggacggatccagacaacaagcatggtagaggagggtcttcacatggaggacataaggaggaaccatggcagtgaggggatgaggtggccacaacagcctacaccccccgaggagaagacatggatgatgaggttcagccagaactagaaaagaagtgaaggtccaagggcatttctagtgtgcagctctttttgcaaatggtataagagtaaagcccatttacataatgatatttaggttaaacctatttttacgatgacataatttcaagtttttcgaattttggtagtatggggctctgtttggtttaaaagttcacaaaattttagtatacttttaagaaagaaagcttccaaaactatcatattttagcacgaaaataatggtcggattttgtttattttgtgcccttaaaaaattggtaatgataaatcgataagatcaaaatataaacatatctacatctcttttcttttagagggtctattcgactgtttgatatagtatacacaacacaactagccagtatatccgttgccacagacataaattattgtgcttgctagctgtgttgcagccgaacacaaacccttccatatcccaaccgtatcctctgattgtataatgtcaccgcgtgacattacttcaatccacaccatccaatctaaatcaacggccacagattaattggtactccatctaactaatcaaactaactagcagagtatgtactatgtaggtatgtacttaataggtgggaaggatttttttttaacactaaagcagtctcttcatcttcattaaacattaacccatcggcttgtagattaagaattgccccgttccgacgacagaggatgtggcagcacaaaattgatgcacaggattcacttcctccaggataatgtgctaatcgctgcatctaacaagtactaagtgaaacctaattatcatcatgtgccgattcttccaccagtcaacgatgtttgcctcttgaaaatgcaatatctgatctagggacaattatagctgcacaatttactaattagtttgattaattgcatgtcaaataatctacggccgttgatttagaatggatggtgtggattgaagtaatgccacaccgtgacattactgagtaatgtcagaggatacggttcgttccatatcatgcagattacctatctttggtatcggtacaacagctatcttatgtaaaaatttctttatgaaaaaaaaacccgtatactttttttgttttaaaatatataatattcgattagccactatactataaatgtgaaagaagcacaaagaatactactacctttatctaaacttattttataacttgaaataaatttgatccattccataataataaatctacacatattccctcctcccctcttccaaaaaacccccaaccttagattgaattttttttagacgaaggtagtccttccatcccatgaaaaacaaatatagtactggatgtgacatattatagtacaaataaatcttgacacatatgtctttaaaaaaaacttaacctaggcaagtatgtgacatctattacaatgaatctggatagtcctttgtcccgatttattatactagaaaatgtcacatcccctcctagatttagtttttttagaatagagggagtatgtatgtccagatttatagtattaagatgtgtcatattcggtaatagattgatttttgatgagagggagggagcggttcagatggaacagtagtccatccaggcaggcacctaggaaacccaggaattatggccgcatttatgttgtcggtatcacccgtatcacatcacaatacgtcaatatcacatccggatgactaggtaaaccagtgccggagtcagtccagtcactcacaaaatttactcgccggaaaacccaaaagaacggaaaagaaaaaaaaagtcaggcagtcgtcgccgtgctcgccgcggcggggtccatcggtgtcgccggcgccaccaccacaacccagacgaggggagacggcatccaggatccagcaataatagcgcgtcgcggtggtcgtcgtcctcacctaatcccccccccccctccccatccatctattctcagccaaaagctcccctcttctctctctccctctccctctcgctttcgtttcccttttttacccc

SEQ ID NO: 21136 - DNA, 2423 bp, Oryza sativa
gggaggcgcggcggccgggaacggcgtgcacgagctgctcgagtgccccgtctgcaccaactccatgtacccgccgatccaccaggtgaggttctcgcttgattccgcgctcgcatacgcgtcgtgtgggatgcgatccgtggggggttcggaaaagagggggggggggggggatctgtgtgcgtctgggcttgggagcctcggaatcggggttgaattttagagcgaaacaaagagaggaaaatgtcgttttcgccatgcctgtcatgatttgattcctcttgtgattggagcatcatatccaattcgatcattgatacaatgatactggcacaatggggggtagacttcctgttggtcgttcagaatttcctgggatcttggtgttctctgggctcccgattggtgttgtgtattcctgaataatttcggtgatctgttctgttattctcgtgcacgaattgctgacttagcttatcgatcggccgattattgttcaattcctgcattatttttctagtaattatagagctcctttttgacatatagtcgatgcctaagaagaagcaggaatgttgaatcttgcgaatgatcaactgttagaattagatggctaatatctattataatctggaatgagctgccaaaataatcatgccttcaggtcattcggtttatctttagcagaatttataaaaaatagtagtacctttaacatttagccatggtgagttttcccttttagcacaagttataaaagggaaggaagacgacggtacttgtgaagtatatatgttgggtagaagtatagaacttaattaacctaaaaatggatcattcgaagatccttagagaatacatgggctgaatttcaataagcaattctaaccatacactccctttcccaattcgttgtgtcagattgatctagtggtgtaaacctgaagagtctcattatgtagttctgaacttctgatctttggatatgattctcatctctttgaatttcattgcagtgccaaaatggacacactctgtgttccacctgcaaagctagggtgcacaaccgttgccctacatgcagacaagagcttggtgatatcaggtgtttggccctggagaaagtagctgaatcgcttgagcttccctgtaagtactgctctttggggtgcccagagatcttcccatactacagcaagataaaacatgaagcgcagtgcatgtttagaccatacaattgcccttatgctggttctgagtgtgctgtggtgggtgatatcccttatcttgttgcccatttgagggatgatcacaaagttgatatgcatagtggttgcacattcaaccatagatatgtcaagtccaacccacgagaagtcgaaaatgccacctggatgctgacggtaagtacctatagactgtggcgctcttgttattcttattgaacttataagaccttgttggtagagataagattatgttgtgcagattgtattatagaaatattggcacattgaatcgctgtctggtgaggaggtcttccactgtttcgggcaatacttgtgcgtgcactttgaggccttccagcttgggatggcgccagtctatatggcctttctccgtttcatgggtgatgaaaatgaggcaaggaactatagctacagccttgaggtcggcgcaaacggcaggaaaatggtatgggagggcaccccccgaagtgtccgggacagccaccggaaggtgcgggacagccatgatggcctcatcatccagaggaacatggcgctgttcttctcggggggcgaccgaaaggagctgaagctgaggatcaccggccggatctggaaggagcagcagaccccagacggtgcctgcataccaaatctctgtagctaagcaatcacaacattcagaagaaacaaagaaactcaactccactttgcggccggataacatctatcccgttgccatgtcttactgtttttttgtatgctccgaggcaacgccttcatgttgtacctttgctaaacaaacattaggagggtaggacgctcttgtaaagtaaaatgtgtgtatatggcaccccatatcttacaggttggctgatcgagcgttcaagctctctgttgtcttcagttcggctggatctgaaactgcatttttgcttcctgttattaaattgtgaattccattagtcccacaactgcaagcaaatttcagttatctgcatcagcaaatttcagcattggaagcgaagggtcttgatggagatgtgactatttttcaagtgatggctctggttattctgaagagctacaagttgacagcaaaacatggttgaacacttgattttgatctgggagatctacgatgatatcagcagttttgatcagttatcagttattctggacgattggcatggg

SEQ ID NO: 21137 - DNA, 1060 bp, Oryza sativa
cttgttttgtgcatgttgttcaaaaagtcataaaaaattgaaaacataagatagatcaatatgtaaaatatctcttcacaaacatgcaagttcaaattcgaccctatacaagtagaaaaccaaaaacaataaatttgattacaaatagtgtgttttgttctatcgtgtcacatattgatctataatgtcaaatcttcttaaacttttttatgatgttttgggcgacatgcacaaaacaaggggatgtctcctcaagggacaaatagacttttccctttatatgattatctgtttacaatggtgtaagtttatatgatataaactacatgtgctctatttagagcatccctgtcaatgatgctacatcattgatagcactctatgtagcaacaatattttcaattgcacaaactcacaatatctgtcctccttgttatctcataacttcatttattaattctcatctcaaaaacaacttattgattaagtgttctgatttttcttggatttcttactgtgcaagatgctgatgccaaaggaggtggaaaatgagcaaagaacggttcctggcattcctcaaacatgcaatacccagaacactagcaatggacgcactaacaccactgaagtaagatatgttcaccaactctatctgtattgtatgaatgcagtatgaatgtaattgtaagaggactttcagttttcatctataaagctcataatacccctaaagatttttatatcataagccatagcatttaggatttcgattggctggctgaaatctccggttttccaattcgaaaaaaaaagatcacataatgtaatcctggaacacatctccaatctttattcagtggactttaccatttcctttccaattcctgtataatgtatacgaaaccgttgcacttttgagctccattactcataactgaatgagttgtgacttaacaggtgccagttaagggccaaaataaatgtgcaaggtattccagctctccttgttcttcttatgaaaaaaactacttatgtagctcacaagcttgttcaatcacac

SEQ ID NO: 21138 - DNA, 730 bp, Oryza sativa
cggagaaagtggtatattttatggtggaatgcatgagttccttgctttgccttgtattttattttactggtcaaatacccgtgtattgcaatgatttatatataaggaaaaaaaacgagtctttttgttgagaaaaaaatggttgcttctatttggttgaaatgggattctttatcttaaaaagacaaaaagaaaagggacatagtatagttcttaaagtgagacataaaccctttttcacgtggcaatgaaattctcattactaacaaattgtgcagtgtaattaacttaaatgtacaaatgaaacttaaattttcatggttttttaacttgaatagaggtgagaaagaagcaaagcaatatagcattaaagggttgcaacccgattagaagcacccaatttcctctttccggagaggaagagcaatgactgcaacacacaaagcaagaggactcacatttgtactgctctcatggccccactcgtcagtggtgttggcggcatcatcgccacaagtctttcgaaaggagtatggaaaatgataaaagtacattaagttttcttatgccattcataatacatctgatccccatgcggttgaggagtggaggaagcggggttatgacttccacaggatgatgctctctctctccccacgttacttacccaggattaggctgaagaacgagtgatcaaagttaaatacggggacttcaagtaggtgcgaca

SEQ ID NO: 21139 - DNA, 584 bp, Oryza sativa
tttcattctgctccagtggaagaatgctagtagcacagtgaataatccacggggaaagaagaaccttgttttatcctcatggggggatgagtcagtgcttactgaagattatgttaatcctcattatacaactgattgctatcagtcatacagcgaaaggaccaaccaaaatctggtaagtttcatgccccaaaccaaaaattttgcgctcttttttaaaatataactctggcggactaaagattttctgttgctacctcagaaacgcttaaatgaagatgtgattgattttgatctgttggaagacttgatatgctatattgatgagaactgcccccctggcgctgttcttgtttttcttcctgtaagttcagggtgtcacgccagcttaatgcttcatttcttaataaacaccttgcaatattgatgattgatcaccatttttcgtctgtgatgctgctcagggagtcgcagagattgatatgttgattgatagattatctgcttctgttagatttggaagggaatcatctgattggattcttcctttgcattcactgcttgcacccactgatcaaaggaag

SEQ ID NO: 21140 - DNA, 380 bp, Oryza sativa
actccaaagggaaaatcaaaaggttcaaggcaaggcttgtagcaaagggtttttcacaaagagaggaaatagattacaatgaaattttttctcccgtctctaaaaaagactcatttaaaattgtcatggcgcttgttgctcattatgatttaaaagctccatcaaatggatgtaaagactgcatttcttaatggtgacttgcatgaggatgtatacatggacaacccgagggttttgttattggaaggcaaggaccatttggcttgcaaacttaaaaaatctatctatggacttaaacaaacgtcaaggcaatggtaccttaaattcgatgaaataattaaaagatttggatttaaggaaaatgaggtggataattgaat

SEQ ID NO: 21141 - DNA, 591 bp, Oryza sativa
tcgagtaagtgaagataaaatgttggctgttttcacacgaaatggctgatatagtatgcatgtaccaaacatatttattaattaattttaattgattcttcatttcaggctaggtcatcaatgttaatgtttattagcaccatgctaaccttaatggcaattggagggttcccatccttcgtggaggatatgaaggtatttatgaattgatatgtcataccagaaagagcaaacatgtttactctatataatttgttaaaatcgactgaacacacatatagaccaacgggcataaatagtaaaattaagtcagtgaacttggatacgatgtctggaattgattattcaaattcatactactgtaccaaaagattcaacaaagttatcaacacgaataaaaattttccatcaaggacatgggatagtgctatttaattaaaaaagagtaatggaaataaattcattttcaatttaggatattaagaaatcatgtgaagcatcgcatagaaaaccctaaaataatctctcttatgcatcctaataaaattcacaaatacttgcaatgtcttttgactctggataaaaatattt

SEQ ID NO: 21142 - DNA, 3587 bp, Oryza sativa
tttgctttgcactaagattatagcttcatcaagctgttttggatgggttactgtcaccccaacattatcgtgggaactgcacggttactatgcaaactgtgatctactctcttcgtcttttaccgcacggtgttgcaaatccttatatattttctctatcttaaaataaataaatataatacagagcgtgatatatgctaataatataaatctaaataaatctagatttgtaatattacggtggatcgttgtaatattacggtggatcgtattttcttatagatttatttattttgaacgaaggttacacagtgttgaatggaatcgtgaggttcgtcatttttacgtttctgttacgtattccctctgtcaaaaaaaaaaactcaacctcttcttctagaacaatgaatatggataaaggcatcctcacgtttccgttacgtactcctttaaaaaaaacttagagaacaaaacgtttccgttacggactccctttctaaaaaaaaactcagagaacaattaatatggacaaagatatcccgttgagttttttttactaagcaccaaaatcgtagacggaacctttttcatcttttgtcgtggcgatgccacctgtgctgcttgcgtggccgaccggcctctgcccaacccacgccggccacatcaccacctcgtggctcgtggcgctgctccgcctccgcctccgccacacggccccgctcccgacgaatcagcgagaaacggtaaccaaaaccttcgcctccagcctcgcctcgctctcgcacaaatcaatcccgcaaaatccctcgaccctcgatccccccccttctccctctctctctctctctctctctctcccggtgatcgcgacgccaacccgcgctcgcgccgggtaaggatcctcctcgattccccgctcctcccatctcccgccctacctagctcacgatcggtcgccgccaccgccgccgagtggtcggtctgtgtggctcgcccgagctgcgcgttgtgatgatggcgatgcgcgtggttcgagttctcgatgcactgggggctaacgacgaatttgctcctccgagtttcccttttttttttctttcatttcctacttcccttttgagttctttccatctattccatttcatacgtgtctctcattttttatcatgttttctcccttgtttcttcgcttacacgatgtgcaaacaggcaacattgaagaccaaaaagaaagcaagaatcatatggataccgagagcatccaggatggtgatgacatcctgctgtcaggtggagacgacgacaggaatggagggagtatcgcggagattcagacaacggtggacctcggggtcgcatttggctcggagaagctgctgaatttggagatgctgctgatggagatcgcccatcgcgcaactgagatcgagcccctcgtgctggatgcagagtcgatatcggccgagtcggttcagagggtttctgaattcgacctcttgcattgtatcctagattcagaggtcaaggagttggagaaattagttgattccattgaagtggatatcgggaatggtggaaagatgatggcttctgatgaagatccggtgagtgaggtgaacagcaagctccgagatgcagccgtgtctttgaaccagatgcaggaccttatttctgctattagaagacaatcggcaaactttgtgaatgtcatagacccttctcaggacaactctggtatgctcatgttagtctggtgctactagtgctagctgtttgctgtatgtttttttttcctgacaattgcatttgtacaggaactagtgaagatggtggatacgaaaatggtcatggttcatctcgctcagccatgcctgccgaggaacaaagaaatactctgcagctgttaaatcagtcaatagcaagtgaactggatctcggaaagaagttacatgattcggagtccgttgtggaagagctcaagcttaagctgcatcatgtagaacatgaatcgtatttcttggaggaatctgttgaagcgatctctgaaagaatgtttgcagctgaaaatgcatctgaattgtttcttggagcgtcaaaggaacttatcggtaaagttaatacaatacagttccacctaagtgcatcaattcgtcgggaaggtgaccttaaatcaaagttagagcaaagcttgacagaatcgaatggttctaatagcactctagagaagatgaaacaagacagtgaaaaggaagtgatgccgactcaagcccaaccggactctgagttcttgactttgcaggataaaattcagcaactagaggaatggctgagggaatctaagtctggattgccattgacaattgcatcaacaggagaaaatgaagtcggcgaagatgagatgagcacattcgaaaatattgttaatgatataaagatgctgttttcagagcagaaagtagaacacagaatgctgaagcaaagtgcaaacgactttctcacgctaatatacaactcgatgaggagctaaaatccctcaaaagtcaggggtcagatagggctggcttactggaggagaagcttaaggagtcagaaactcagttactgcatgcaaaagcatcgattgaggctattgtcgaacggcacagtatatttaagtcttcaatgtctgatatggagcaggtgattgatgatctaaaggaaaaatatttgaaagctgaaaccagagctgagaatgctgaatcaaaatgtacattgctgacagacactaacttagagcttagtgaagagttgtcatttctgagaggtcgagtagacactttagagaattcactgtgcaaagccaaccaactgaagatgtccgcagcaaaagatattggcattaaaactaaaactatcactgacttagttgcaaaacttgcattggaaagagagtgccttcatttacaggtataaattttattattcaagaaaaaaatactgtggtcagtattttaactttgtcctgtgtatttatgttctttgtatgttatgtaactgtacttcgtatgatttttaccaaaagtactttgtatgatttttaccaaaaaaaattgatgcttatgattcacattgttcaaataatatctttggggttctggacttccggttcaaacagaagcgccaaaagataaaaagaatgaaggctattcttggagccaggcaatcagttaatcatagatagacatacgcaggatttttttcacggtcatctagtcaatataccaagctcatattttgagattctgaatgctttgagtagaaacactgaacagactgaaaaaatagttcatatttgtatttcattttcataacatctgcattatgtttctttactccttttagttctgaatgttctgctctttctttggcatgttttagcctttttaaggcatcagacttttcaacagactggcgctaaccaaaattagatattttattaataaattcctttggatatcaatcctatgactgcatcctccttttctcagttaacagtgttgcagaaattactagtataaataagaatatatgtactcctggcttcttaa

SEQ ID NO: 21143 - DNA, 2835 bp, Oryza sativa
gtgaccatgtcctatgatctattaacgcagcttgtaggaccagatagaaagcaggtaattttcctgtaatgattcttctaaatcattgtaggaatagtcaattttggtagtggtcgttgttgcaagtgtcagttcttgcatgaactgtctatgtgtcaaataatctctggggtagaagagattgtagatctgaactgagcaagtatgctccatgccttctctgaactagcagatccaagcaaatcaaattggcaacagagaattcatgcagtatctacttgtatatatatttcgagtacttgactaatatcgagtagcatttgttctagacaaagtgatcttcactattttacagaatcacagatacaattagcctgacagatgatggtttagtaggttcagctcatctgtacaaaatccatttgtgtatttgtgagcagttatgttatacaagtacaattttgtttacttactctttagttaaactgtaagctttcttcgttcgtaagttgggaatcagggctgtgacaactgataattgcagtggaaacatcacattagccacacaatgacatgcaagatcagtctgaatcgagcactcgagcttgcaagatgtgagtacatagtggatcattacaattgacatctgctgtgtcatttcatcactgatggattgacacaccacaaacaccccccagctttatcatcagaattcatcaccatgaacacatatatacaaagatgtacatggcttatgtggtactaacacacaataagccttttttttttttggggtgatggtgcacagtaaaaccttcgttttagtatgcctcaacaccagtagacttgcaatcaacatcgaaccatacctcgttgagacggccaatgatgcgaaaggggttgttatactgcgcaattgagtaggcgctcttgctagggtagtttgtggaattagcccatggtgaccggctcaaactcaacgcaagtttctccgcttcctcgacgacattgttgtcccgtgcataacccgagaagctcctcactgcaatgcagtggcttggccacctatccgggtggaggttcagttcggggagaggcacaggagggaagcctggaacttcgctggtaagtagagccgcacaaagtaggcagacgagtgtagcggccctgcacctgggacgatgctagttaggatgggagttgtcatcctgatcctggaggagttaaggttcgcgcccatcaggtactggaacaatctggcaggaataacatcaagagttagtgcttgtaggatctggtaaaataaattctaccgacagggaaactgaatttcagaaaggtgtaaatgagagtgaattatgaatgaagatcaatgtagtagtgaatctgatgaactcacaggctaccatgttgttaattgttgtcttaggaatcaaaataatcacaaaagtgctaatatattcaattagctctccagcaaatcaacagataatgccttttatctctgtattacatgaagagctctttactgatgcaactaaaagatttggcagtgcagcccctaacttatggctaacaagtaacaaaacaatcctgcatattttctgttatagaaatctctcacaaagacccaattctttctagaaaaaatcagtactactccatccgtattttaatatatgacgccgttgactttttgacaaacgtttaacctttcgtcttatttaaaaaatttatataattataatttattttattgtgacttgatttatcatcaaatattctttaagcatgatataagtgtttttatatttgcataaaaattttgaataagacgtttggttaaacgttggttaaaaaatcaacggcatcatacattaaaatacggatggagtattatttaacatcacaatactgtctcaattcaagaccacattcttcccgattctcaactgaaatgaacaagcatcttgctaaagtcaaccgacaatagccatcgatttcactcatcaatctcttctacaattcaccgatcttttccattcctgcagagcaaccaacacccaaaacgagcaaatcgaagagctgtgctcaccaaaaaaaatcatcatctcctacctactccaccacccaccgcacatgattacagacaggctccaaatcaagcgcggctgatcccccatcccccggaccaaatcgtagcgacgagggtctcggatctgatcggggtggggcgggctttgcttaccggtggaagccgagcttggtggcgacgtggaaggagatgtcgtcggagggggcggacatccagacggtgtcgcggtagcggcgcacctcgaagtcggactcggcgtgcaccgtcgtgtactgcggcgtctcctccgtgccgcgcgcggccggcgggagcagcgcgagggggaggaggagggcgaggacgaggtgcgcgagccccgccatggtcgccgccgcctcagtcttcgctccgagcggctgcttgcttgcttggggaggcgatcggcggtggatcggagtaaaatatacgtacaacagtcggtatatgattggagaattgtgtttcgacaagtttcagttctggacatcactgttttgttttttagaaagagagtaaattatttttgttaataatgaaaaagagtaaattctagtagtacgagtttaaccaaactatcactgaccttgtttagagaattagccaagatttattttgagagctattttttaacacaaggaaatagccatccaataaaatagccctaagttgtttgaattcaaaggttattttgagagttatttggcttttaatgtacatttcca

SEQ ID NO: 21144 - DNA, 950 bp, Oryza sativa
cccgatctcgaagcaaatctggtttgacgttctcacacagctacgtcaagggcacaacatcctgaaatgtaataacaatagaaacctattgggttggtagacacaagaaacaagcgacccataagtaacaaaactaaaaggactcgtatctctcttattgctcattacttgggaaatctggaaggaacggaacacaagaatcttcagagaaaaggaggcgacagtacactagatgatcgcatccaagaggagttgggttggtgaggtatggccggcgctaaacatattgggagaatgttgccatgagaagttaggagagctgcttgtttgcatgtaggcatgtacggttttttctcttcttccttgcttagccttttggctgtttgtactttaaccctctcctatcaatataaagcaagtcaaatctaaccgggtgtaaaaaaaaagtaagaggaccaccttcttcagtgcgtgattcctctggattaggttaaacgagtgaatcatcaatagcgagcatgagaagaactgggggcaaagcaattgaaaaggacaaagaaccacgacagcccagattttggatggggattgccattctgatcctggaggagtttagagattatcgcctgacatctcaggcactggaacgaattactgtcaggaggaacagcatcaagggttcgtgcttgtaggatctagtcaagcaaattccatagacttctttttttttaagaactaaattccgtagacatggaactgaattttagtggattggtttaacaaactggatagcaaccaattaactggatatatatagcaatcaaatgtgcacaaatgacgtatgccgtcaataattcttgcaggttgtaaatatcaatatgactaataacatggtagggtgttttgtgaggtctagtacgaaactggctacgaaacaatccaatggatca

SEQ ID NO: 21145 - DNA, 1536 bp, Oryza sativa
aaggatagagggcacatgtatcaaatcaaatcaatacaatcggggcaatatggtccatacgaaaatactaagtaaaaaaactaactcaagggtggctgaggcatatataatgatatattctaatttagagaagtataagtagcacctatctagtttcaactttttataatattccctccgtttcaggttataagacgttttgactttggttaaagtcaaactgttttaaatttgactaaatttgtagaaaaaagttgtaatatttttaacccaagacaaatttattatgaaaatatatccaattattgatttgattaaactaatttagtattataaatattactatattttctataaacttattaaaatcagtttgactttgacctgaaacggagggagtagtatattggggattttcagttgggtctgggggccttttaaagtgcattcaattagccctaaaaaattgatatctttactcgtatatatatactcctatcaatccgaaaattccccatttctattcccctgcgcccccacaccgaaaattctctgtcgcgcgcgctccttcctcccgtctcctctcctctcctccgctcctcgcgcgcgccatctcgcggaggggatcctggtgagcatcgcacttcctctctctgattcatctctctctcccgccctcgattttttcgcttgcgttcgttaaccctagcttctcttgtagatctgcaagaagttcttctcttaatttcagagccttaataacagtttgagtttgtttgttcccccgcaaaaaagagtttgggggggttcaattgaagttggatccgccgcccctgcagatttggtcgcctagcttccttacctatggcggttcaatctgcagagcgcggcgtggaggctccacctctgacgctgtcgatattcgagttcaacagtaaggttgtgtgtgtgtgcgcctccggtgacggtgatgccgcccgccgcctgttgatccggttcaatgctttttgttgatgcgagcgagtatgggaattcttcgtgtctgatattgggtgtgcgcgcgcgccttgctctgcaggtgatgcaggacgagctgcagaagctggcgctcaaggtgaaccaccacgaggagaacatcaggtttctcaagtcggagctcaatgccgtcgaggactcgtgcgctgacctgggcagtgagatcctaatgccctgtgacaccttgcttttgtatatacttttaatttacggattcgtggttatattcgtgtactctagtaatgctatatatcggtaccatgatgcagaataactgcgtagatcattaattaaacactatagtgaataattcgagccttgcgatacctagtttctggtaaataaggcctgttaattattaactatggagcttgtggtcattaatttttagtatgtcagatatattttctgtaaacttgagttttatatgtatgttcaagttggccagatgtggagtcatggatctgtgaagaggatgaatgacccatatgttggcatgaa

SEQ ID NO: 21146 - DNA, 1290 bp, Oryza sativa
atacacattatgagccggcatctatttaagaacagggggagtatatgataagctgtaacatgtgtaggaactgatacaccctaatgcaataattctaatgctgacaagcaaatctgacataccttggtagaggtagaccaaaaaaacttgcgttctaattcatgtcttacttactacccatgcttatcctaaggtccatatggcaagccaactgtggcatttgctgcttctgcgtgtgtgcctttaggtgctagtgtgctactacttcgcatgacatatgcatctatctaaatcaattgaggcctctttgagtagaacattggaagttggttgttgagacaacatctctgcattagtggtaggactagcaagctattgcaaaatctttttattatcacgttggaaattgaatctttttgcatgagcctaacatatccaccattcctattatctaatgttcttagcaccattggattattgcattagatggctgtggtaaatttgaatttatcatgcaagtaacaccatttggataaagatatcaaagctatctataattccatatactctttctttaactcatttccataattccatatactttttctttatcttattgcccctatttatatgctgaaccctggaacttttctcagttaaaataggcaattattattcatcgatggcggcaattgcaaataatgacacatctgttgaagaagctgaacaacgcactattcaaagtatactcaaacaggacgagacagcagctgggattatatgccaactgaagattcgtcattatcagcatgcatcaaagctgccactgatgaaagatgtccttggtgtcgtagctaccttgggaaaaataaataatgacaacctcagcaggtcattattctctctttgttttgacatataataagatttattgcaccaactggtgcaaagttaatgggcagaattatttgtttacttttgaggtaccatgaatttgttatagggtactctcagagtacttgggattggacaatatgcttggtgtcgtctgcaagacttatgatggtgtcgagggtcttgaaacatatgacaaggaaggtatggttgataaaaccagtggcattcatggactaggtcgcacaattggaaaatttttagatggaagattcactgtcttttgtcttgaaaatataaggtgtgttttcattgtgccgttatattttggactctactggatggacaccttaacattataactattacactttgcaggccattttctggtgattt

SEQ ID NO: 21147 - DNA, 30168 bp, Oryza sativa
  unsure (1)..(30168): unsure at all n locations
ataatgtgaatatgagaaagaccaaataccgagcactgtcaagacgaacttgatatccgaccaaagaatccttagatccaggagaagattcacacctctcactagacactctttcagccactgaaatggcctacaagtgagtagctataccacgttatattcaacaatctagatctgtttagtataagctgcgtgatcatcatataaaaaggatatctagcataccagatgatctcacagtaacaacactaagatattgtactttatgatgaatttattatcccagaagtgatttcatgaatatgacatgcaatttttatattgcctgcaatgtattgctaatatgctgcaccggaaagataaagaaaagatcaaggtctgcactgtgatcataccgctatcctccggggttgtgtgcagactatgctgcagtaaccaccaagctcagattcaatcatatcatccaaaataaactgtggcacctgcaaatgaaagataatataatcatgtaaaactccatgcttctggaaagatcagaataaactatacaagctggtattgcataacatctagtattgaatatctttctacatgttcaaggaatatatgcaaacctaactttgtaccaatagcagctagcatacctatcgtcaaataatagaagctgattggctgggagatgaagaatatcatgagatcagttcattaacacattccaataggtgaaaatggaccatggaaagaataagatcctaaaacacataggaaggcacttcctgttgaatatgttaagcatggccccgttatcctagcctgttgcactcaattagtcaagttgttttaaaaacaatgtagaatgatagagtcattaagggaaaagtcaggtctatagtctagaaatcctagatcaagttaggcaagcaagtgggagtttcagagctacttggcttcccaaactataggaaaccacgactgccatcagacttgttatgacaagtttcgtgcagcagataattcactatttctcatgcctcaccatcaccaataatgtaaatattataatttcagggagccaaataaagggataaggcataaaaaaagatgatgttttgcacatgatatggttatcttttaaagctggaataacaactggcagcgcccaagaatgaagcctttgtgggggggtacctgagttgtcttcccacatccggtttctccgcaaacaacaatcacatcattctctttcagtaactgtagaaaatgatctttgaatctagagattggtagagaagctcttgcttccagcattttctgaatacaaagatgaggcaattcgtcacaaagagtcaaaggcaaaagaaaaggtattaaattagaagaacagtatagtagaatgtatatcactcttaccaaatagctcgactgcttcattttattttccaaatgttttttcaacactgtgctttccacctgctctgcggatctcgatcctgatcatagaaaagccacattagatatcccgacaggaattatacttacacttacattattagcagtctagtagaggcaagaaggaataatctataaaggaaaaatacttaatacattcgtttgatcattattcagttaaaacaaaaaaaaagattatttcaattagaagaaaaagaaagatatagcatgaatatctcagagaactaatgaggtcaaaatacacggcatgcatgttgtgagcaagagaaataaagcaagattccaaatggaaatatagctaaaaggtgttataattctgtgaaaatagattctacataggagaaacctcattggtgtcgagaaagttgatagaatggagaagataagtctgtcatcagtgacagattaaaaggttatggaaggtaaaaaatggtcaccatccaaatcatgattgtttcacacattattcataaagacaaaaaactgaaatgatgattttattcaaagcttacctgtacgattcaccagataggtctctttcttctcatgaacagagtagctgtcctcgatgctcctagagtcaacagatgtagcaccatctgacgcatcctcaacttgatgtggagttgtattcgcatccatatccaacaacttatccacaaaaccagctcttcgactatcctcagtatccataacccttgaagatgatgatgataactcccctgcttttttgccaaaaccatgtaatatgtagcccaaaggccccaacaaatcgtgattcatcacagaagaaagcaagatcaatttatctaaccttcttgccatcttaaaacaagtgatgcatatggttcaataagcaattggcgcaatgaaagatcagcgaaaaattgatatagagcaaaagctgccactctgttttgtgcttcctgtcgaccaattcagcaaatgtttattgttcagaaatacaattctagacaaggaatgatgatatgtatattcttttctcagtattatgaaatcagaatagttaatactaacaagcatgaaaggtaaaaatgaagaaataaatctgaataagcagtggaaatgggatagcttcccaaacagattaacatgcactatcatatccatccaatgcgcattggggattggtgtgcctccaaaattaaagcaacgccccatcttctaagaattttgatgttcttgcacagaacattgagcactttggatgcataggatagtgcatggagccattgacatctgtatatatgaagacttgcatttctcattgaaataaaaacgaattgtttttatttttgagatattttagaaagtaacagagtgttcattttgtcaatactaacctcaacagatgcatattctttatcttgttcagttaactcgacttttgtcaagcctccagccttccgacttttaccacgaccagtagagccacgcagtacattaacagcatatatgaatttacgatccttttcagatattttactgtattttggcgcttcccaaccaagtttctgacagaatttttgcagaacagcctttggcattttaccagaatctccctgcagaccacaataaatagttagaaccaaatgcacgccagagattaaacagctttgttggttcattgtttatttagcaatatttcgaattgttacattctgcccattgcccaaataatggatctcctcaaatatcgttacaagtgagatatgttagttgtgttctcttctcactgtctagtacggtaatttactgaaacttgaatggtttatatgcagcttttaggagcaagtagcatggaacattgcagcacataaaggccaccccaactatcctactccgtatacaacaaggtttctctaacaaaattgagagaagcggcattataatcaagaaccaagacagcaaaaacacctccaaaattctaaagataaatatgacaataggaggaggggcgttaatataaagtggtgcagatgcacatgaccttcttccatatatcatctatgtttccaagaagatgcccataaccatcatgtgataatttctctattttttgctgttttagtatttctggagccactgcctcccaagcagaagagtcttcaaaaaacaggttatcaagttctacttcctcttcttctacctcctttgtgctggtttcatcaacatccttggacatttttttctccaaactggatcctccatccatatggacaggactctcacatttctttccagttgcaccagagtcaactagatcaccctcagcatttgcaatatcagaatttggaaagacattatctgaactgctgagatcttcctttgagtttccagatgaggatttcgcttgtttacctgaaaacaatcaaacaagaaggcataatataaacctgcctgaactacatataagcattcaaaacctagtcacaattagaagagaaaattcatatggttcactatagaatcgatatccttcaacaagtattatgtgtacccttcttctttcgcctacttggctttgcctcagcagtttccaaacttggtgggcagtgatcttcccatgtgtaggaatcattagaattcacatcatcttcctaacatcagcagcaagaaaaaggaataattgcaccaatatacattaaacaggaattaaaagaaaaagaagagagatacattgaataagcttaatctcgaagtttagcggagcaccatccaattcgtagtggattgaaatgcataagatgtttgtcactaactttaaacggcattcagtacattagaatatttcaatcacaaatgtaataaggtatgtcactataattacgttcgcaacataacgcttcctatcatgtttacaaacatattactgcaaaataaacagtcgaacacgcatattggagagcattttaattaatgaagagttaaaagatgataaaatatttaaattggtgtgacggagagagagtcccaaagtattactatcttgtgttaccagcttgatattaaaacaatacaagatattttcaaggagtgaaaatagaatacttgtcagataaagcaaaattgcacaagattaaaaatttaaacagtcattaaaagagtatcgatattcaatatttgatgcagcaatccaaggaacaaaatcacttgtttgaacatctgtcacctatacctcctcttgttgttccatgtactgccgaatccatgcagcttgtgatgattgcccgtcatccaatgtcacatcttcttctcgccgcctgctaattataatttccaacctctcattgctcccctgcacctcctctgactcacgactctgtggcacccaattgtctttcgctgttgatactaccttaactgagccttctgtccctaaaggccctagaaaagtaatgaacagctgatttaaacatgatagacttcttttttagataatggatttataaaacgcagactctaaagcatacacagccaaaacatgatagacttaacactcaacacttaaaagtttcgaaccaatccatgcctctatgagaaaacacaagcatgagcacaccaaccctgcagttcatgggtgtgtgcatacgtgcagaacctaaaatgcagaataactgcagcgcaaatacaaatgcagcaaaatatgtaaagcactacttcaaacttggaaccagtaaagcacagaacgcaggcaaatcattgtatgcgcagaagcatatattgcaacttcatgcatatgatctgacaaacatgttgatgctggcaaatgcacacgcagagatggcagagttcacagttcaaacagaaatgagactagacagtagacacgaagcgctaagccctaaacccgcgaaaccgcataccagccccagaagaggaagcggtgccactggagaacttgagggggagctcatcgccgggcagattaaagcacagccaatccaacgccgactcgaacgtagccgaatcctgcacccaaaaattaaaccccaaatcatcatcaacaacagaaacgaccaaattccatcgcacggcgggtgctcaacgagtgcttgggagcacgaaccgatagcgcggagagcgcctgctcgatttgcgcggaggagaagccctcgagggagagcttgtcgtacaccccgcgcagccgccgcgccttctgctccctcgactcggcacgcgccgcgggagcatccgccggcgcgggcgctggcgccgcggtcgctccggagttgaggagcaggcggcggaggcggcgctcgttctccgacgagatctggagccgcggcgcggcggaggcggcgccgccgccggccgaggacgacgaggaggaggtggaggagtgcttgggcttctgcttctgcttcggcgcctgctgctgctgcttcttcttcggcgccattccgcctccgccgagctcggcctccgccgccccgatcgtctccgccggcggcgagcttggctacggcggaggcactctctggtaggtgggcccagcgacgcgccgtgtgcgctgtgctttcgcggatactttgcgggacgcgcacattacgggacacgcgttctgggctcgaaagcgtaatcgtgcattcgcgcttcgcgggtactcgcgggccacgcacagcacgaaacacgccttctgggccggaaagcgtatttccacattactgggcttttactgggccgtccattggatctatacacagcctgaaatgtggaaagattccgtgttgaaattaaaagaaattttgaaatggccgagcaaatagcgatcgaacatgtaggcacttttggaggttgggacatgaacatcgagggcgatttcttatttggaatgaacatcgaagcaaatttgacttttgtaaaagtccaaaacggcgatgttgagccgtcgataaaacaatgagatttcgatagcgtttttttgtggtggcgtggacgctaccttctctgctctgtccaactaactaaccccaattggcaaccccgttatgcagcaaaatctctgtctttgaactgatcattagaccgaagatgccttggaattttgagacaagcatcaaagcatgtgcgtttgggaggcagccagcgaccgtgcatgcgtactagggggagaattgagactatacacgcgtggcctttgaatttgtctctagccgattaagtactactatacataaattcttagcagaattatctgttctatacagtagaaaatgttttaaaccattttatttgctgctgttcctctaaacacaaagtccagagatacacttaataatattgtggtaaagggtaagtggcttcaatcccgagatcccatgttcaattctcaacacgcttataatttattcttgaaaaatgtttggatggatgtctctcttcaaatctttcttttctgtaaacacataatccacatattcttcttcacatggagtaataaactaaaagtaccaaggctttgttcggcacattgagttaggaattaatccctcgcagacaccaaacagagcgactcattagcacataattaattaagtatttagctattttttgaaaaaatggattattataattttttaaagcaacttttttataaaattgttttataaaagatatatcgtttatcagtttgataaatgtgcacgtgaaaaatgaggatagcgaagtttagaaagcgcacatactagcacagcctaatgggaccacctatacatttgtcgacaaattttctactaaaaatttgacagatgtaattatagtacaatcgtagtgtaattacactgtaacttgtattaagtttcacgtaattttgaatcgttagatctattacaagattcgttccggtgaagaagaaaaaaatcacagcacacacatatgtgaaaagatttgttcctaggacctctattttactgaaataacatgttaccgagatattcttgaaagttacatacaaattacattatagttacagtgtaattacatgtaagttacagtgtaattatactacgattgtactgtaattacatccgacaaatattagggggagaaatttgatgacaaatatctagcaaaatcgcatcctaactactcttgagtaatatgatatgttttccttaagtatttgtaaatcttttgtagaaaagataactagtcaaattttaaagatgaatagtgccaatatcaactatggctgtgtttagaccctgtctagatgggactaaaacttttaagtccctatcacatcggatgtttgaaaattaattataaatattaaacgtagactattaataaaacccatccataatcttggactaattcgcgagacgaatctattgagcctaattaatccatgattagcctatgtgatgctacagtaaacattctctaattatggattaattaggcttaaaaaattgtctcgcgaattaacttttatttatgtaattagttttataattagtctatatttaatactttaaattagtgtctaaatacaaggactaaagttaagtccctggatccaaacaccaccttagttggatccaaagtttggattttggttgaaattgaagatgatgtgattgaaaagttatttgtgtatgataggttgatgtgatgaaaaaggactgaagtttgtatccaaacaaactttggatctaaacacagctatttaaaaacggagacagtacatatattgagtgacagataacagataattgtgagtgacatctgtatagtgatgaacagttaaagccacatttattaagtagcagatgatttttctttttggtcgtatatatgcccttgtagctggtagtagccgcgacggcttcagtggccgagagttgtaacgggcgcgattatccggcgagatgtcgtcgccgccgtcctcgggctcggagcgctcgctggcgtcgctcgtctccgcggcggcgcactccgtcaagctcaaccgcgcctacctcctcgccccggccgtcgccgcgggcctcctcgccgccgtgctcctctcctccctcctcgacttctccgctttctccgcctccccgcggccggcgttccctccgccgaccgcgggcgcgccggcgaacgcgtcggccctgtcagcgccgcctcgcgcgcccgtgcgcacggccctggacacgctcgggacgcggccgcgggagccgttcacggcgctgcgcgacgcgtacgcgcggtgggacgcggcggtggggtgcgcggccttcgcggagaagcaccggtcgcggtcgtcgccgccgcccggcccggcggcgctgcaggaccccgaggcggcgccgtgcggctcgctgcggctgccccacgtcgcgctcgccgtgaggggggtgacgtgggtgcccgacatcctcgacggcgtgtaccagtgccggtgcgggctgacctgcctctggagccgcaacgaggaggccctcgccgacacccccgacgtcgtgctctacgagatctggccccctcccgacaccgtaagtacacgatcgatcacctcgccgccgccgccgccgccatgatcgaacacctgtaacgttgtttgtgctccgtgggtgcagaggaagcagggcgagccgctgcgcgcgttcatggacatcgagccgacgaggaagcggtcggggcacgaggacattttcatcggctaccacgccgacgacgacgtgcaggtgacctacgccggcaagttcttccgcatcacccacaactaccacgtcgccacccacaagcgcgacgtaagcactctcaactcgaattaatccttccttcctccgaatgcacacaaatggcggaaacattcatcgtcgtctccgtcgccggcggcgggtgcgcgcatgcaggacgtgctggtgtactggtcgtcgtcgcggtgcttcgagcaccggaacaagatcgcgcgggagctgttccgccacctcccggcgcactccttcggccggtgcgagaacaacgtcggcggcggcgacaaggccctggagctgtacccggactgcgcccgcgacggccacggcgcggcggagtggtgggaccacctccactgcgccatgtcgcactacaagttcgtgctcgccatcgagaacaccatcgccgacagctactccacggagaagctctactacgcgctggaggccgggtcggtgcccatctacttcggcgcgcccaacgcccgcgacctggcgcccccgggctcctacatcgacggcgccgcgttcgcgtcggcggaggagctcgcggcgtacgtgagggaggtggccggcgacccggcggcgtacgccgagttccacgcgtggcggcggtgcggcgtcctgggcggctacggccggaaccggctcgtcagcctcgacacgctcccgtgcaggctctgcgagcgcgccagccgcatgggcggccgccacgcgccggcgcccaacgccaccgtgtcgtgacgagacgagacacgacttggccccggttggattgaaagcctatgaatgaaaaaagtttaaaacgtttaaacgaagtgtttgttacgtagcgtagctgcgttttgctttgaatttgttggtctgcgtttgctgtttaggaggagcagaacgattatgaaaaaggctggcatgagatggtttctgctgtccatatttcacattctttttgcagatacggatggattttggaccagcgtgctacagtaaccggttatttgtgctggcaaatactcgttccggttctaaatatttgacgctgttgactttttaaaatatgtttaaccgtttatcttattaaaaaattaagtaattattaattcttttcctatcatttgattcattgttaaatatactcatatgtatacatatatttttacatatttcacaaaagtatttaaataagacgaacggttaatatatgctaaaaaaatcaacggtgtcaaatatttagaaacggataaagtactttagtagtaatagttttgttcagttcgatacggcaattagtaatttaaaaccgtcgtgattccgaaccaatgactagacttgcgtggcgtcgtcaacctcgttccaaggtttttcaacgtcgctgtcgagacgaagagaaaaggactcgtgaatattaggcctggtttagttaaaaaattatttcccagaaacaacacatcgaatttatggacacatgcataaaacattaaatatagataaaaacaaaaattaattgcgcagtttatatagaaatcgtgagatgatttttttaagcctaattagttcatgattagctataagtgctatagtaacccacatatactaatgacggcttaattaggctcaaaagatttgtctcacggtttccatgcgagtttttcattcgtgttcgaaaactccttctgatatccaatcaaacatctggtgtgacaaaaataattatcttttcgcgaactacacatgcccttagttttgtgttcgttccaaggtcttgtgttcgttatcgtttccattttttgctgcagagacgaagaaaaatgactcgtggatatttagtttctgacgcatggcaaatgactcaggtggtgtttggatacagggacttaactttagtctatgtatttagatactaatttagagtattaaatatatactacttataaaactaattacataaatgagaatgtttactatagcatcacataggctaatcatggattaattagactcaatagattcgtcttgccaattagttcaagattatggatgggttttattaatagtctacgtttaatatttataattagtgtccaaacatctgatgtgataggttttacttccatctaaacagggtctgagtgacgcactagaatctccattaatgctgcggcaattttcagtgatttttttttgatgggcaggtaaaaggctgttgctgttccagcgtcgccaatgcattgctgatccccctctctgtactgaacgcgaacatatatgccttgtgcatgaactaacttatcagttggagccaccaaccctcgtgttgtaaaaacaccatactcattaggctccagcttgtcaagcaaaatgcctgctaattgcaaagcgtaaccaacccagtgggatattcatctatctcagtagttgactttcagtaaggaaatcaaatgtttaaagccttattcggttttgagggattgaagagaattggaggggattgaggaggaataattccatgtagaataaaatcccctctaatccctctctcacatggataactaaacatggcctaagtgtctgaaaccatcatcatctaacatccatataattgagcatgcatgattctctgtcaccagggggccatatccagaaattaatgagccaaggcctgggcttccaattgtaattttgggccgcatcttgcctttagtcataggccttgttacttgagggatcacaatattagccacaaccatcaaccacgtgagggaattgcaactgaatcctccatacgtaatcaaaatttattattccactagtttgggtttgacagtgaccaatcagatcgaggccctagggtgagtgtgaaatgtttaaattccacggtaaaagttcagtccatgtgacatccacatattcttttcccccctatgtttgatcattaattacatagtgtacaactgatcacaaccatatagctagcccaaaccacgccttccaaattcggaacgaatggtttgtgaaaaagcggaaaatcccccaaaacaaacacattttcttctttctgtactattttttgcatggatcaatcaaagttttttcaccataattaattagtaatttacacggtccaggaggcggagcgcttgaggacgggcttcatcatggccctgtcctcctcgagggagatcatgccgaggtgggaggggtcctccaccatcatcttggcgacgaggtagccggcgacggaccacgtctgcagcttcctcgcctgcttgcccacgtagcggcccagcttcccgtcgtagtactccggccacccgtccctcgccagcctcgcctcggcgagctcgatcgcccgcctcgcgatcttcagcctccccgtcttgatgcacgccgccgtcagcagccacaggagcactggccgccgcaaattaacacacaacacaaaacaaacatgctcggatcgttagatgagataactactcatttggtcactcgagtggatcgtacactcgttttatacatgccaactaaaaaatcgttaaaattgttttaagaaaagaaaaatgtgagcagatttgggtgcgtcattgtagtactaataaatgttttttttacagaaaaattaaatgcatatggttttcatacttctaatggtctaatcatttttcaaagaaaatatcaatgttcaatttttttttcttcccctcaaaagaaaatgttcaaaattcttaaaacatgacttgaaacacgttcggaacagcatgtttccgtgacttcaaagggagggatttgtaggatgtaattttatcattcttaataaggtatcggaaggtattatattttctaaggatagaaacaatcgaagtacaaaataactaacctggccaggatccgccattgtggtagctccaccgggtgttcttggggtcgcacccggtgacgaactcccactcgtgtgattcgatcgccgggaagctgatcttgagcggcatctccccgatgaggtcctcccaccgctcctcgatgaggtccatgatcgccgccgcctgctcgggcgtcgccatggacgcaaggatggcgacgaagttgcccagtgcgaaccatcggaagtccatccgggcggggctgacgttgccgacgaagtagccgccgcggctgggcatgaagtcgaacacccagtccgggatggactccgggatgacgttgaacttgttgaccgcagtgtgggagtactcctcggtgcggtagcggtagacatcgttgagctgctggaagtcgagccagaagtaggaccgcatgtggtaggtgagtgcgtggagccgtgtcgccacgcggtccatcgtctccttcccctcgggggcgtccggcttcagcatcagcagtgcgcaccgtagcgccatgaagaagagggcctggatctcgattgggtacccgtacacgccctgcaaaaaaaaaatcatttaaatttttattgaataaaaaaggagtaaaactattcaggcgcaagagaaaaaaatgtaaaggctcaaagccttttgcccgagattgctaaaacgtaagccagctaccgtagatgctttgtgttcgtcaagattcatgttttggcctctccttaattttggctattaggctagtcgccgaaagatcatgcggttcctttccttccatatctctcatacgactagcagtattagtgtccgcaggatcttcttggtgctttgctggtgccgtgcggtagcatttcaccactcgagaagcgtcgatgctgcttgttggcactgcgttggcttttcatttcatttttcagagagttcagtttcgattccatggtgaccacgacaccgtcggtgtcagatcgtatccatcagcgtaaatgtgtagttatcgatttatttctgggaatgggagtcgttttaatttctatcgattaggatatggatggttacggttagtttgaccgagctgcagtagctgcatgcatgtacaaacagtgctttttttttctgttttgattattgggatcaattaaccagacagtgatcagtaacaaaatttttcagcattatgttctttattatcagctaaagcagaaacttttttttttctggcagctaaattcatccggtaaggagcctcacccaaaattcatttagcaactgatgccaaaatgatcagcacaaactattttttttaactctttgatggcatataaaagtagatatggtgatcattatcaacaataataacatataggtgtaaaaaataagttttttttttaaattgacaaactagattaattatggtgatcattatcaacaatactactccctccgtttcaagttataagacattttgattttagtctgttttaaatttgactaaatttatagacaaatatagtaatatttataatactaaattagttttatcaaatcaataattgaatatattttcataataaatttgctttgggttgaaagtgttactaattttctctaccatcttgatcaaatttaaagcagtttaattttgaccaaagtcaaaacgtcttataacctgaaacggaaggagtaacatataaatccaaaaagaaaatcagtttttttaattgaaaaactagataaattacggcgatcatgataatcaacaataacgaacaaacatgaagctagtgaggacgaacgaacgacagtagtacataccatcctgcggtcgatcatgcagcagccgtcggcgcagaggagggtggggaaggtgtcgaagccctcggcgaggcactggttcatgatgaggcggatcccgcgctggcactccgccgtctccgccagcgacaggtcgccggtggacttggtgtacgcgcggaggaggatgatccaccagaagccggagtccaccggcgccacccgcccgatggcgctctccccgaagtccgccaccagccgctccgcccctcctcgcttcgcgtccttgagcaccttgaagctcgccggcatcgccccttcccccagcttgaacctgtcgatccgcttctcccacccctgcagcagcagcgtcttgagcaggaagttcttcacgatctccggctccccgttcatcaggaacgccagcgcgctcggcacgaaatccctcacgaacacctgcgtgtatatgcgtgcagtttcatcgatcagattgttgcttttaagattttgagaatatatgctgattggtagcagggttcaatctttcgtttttggcatttgtatcgggggtgctgatatgatgagattatttgaatttttaaataaaatttgtttaaatttgaacaaattttactaaattaaaatgtaataatttaaaaattttggggttttccgataggaacaaaatttcgaaaatttattccggaattttgaacacatgtgaattgtttgaggagctcaagattacgtccgtgggagactatgggcatgtttggggagcttaaaattaaaattctgagaagcagctggttggtagctagcttctaagaatctagaaaaaagctgggtttttcagtttctgatttctagttcattttctggattctacatctacagcttctaagaatctagtctaaaagctggactatttgaggaaacttctaattctgggtaaagttgcagcagctaaaagctcctccaaacagaccctatggctgctagaagttgaggacttggtatacctggtcgtagttgaggacctcgtcggaggagtggtcgacggcggcgatggtgccgaggggctggccgcggaagcagacgagggagcggcggagggcgtcccaggcgtcgaagacgagggggtgggggtcgaaggagaggcgggtggaggacgccggggtgccgcacagggaccggagcccgccgccgggggagtacatgctctcgtagctctccatcatcgccgggtaccctcctccgccgccgccgcggctggccgtgccggagatggagagctcagcgagggagcggtcgtcgaaggagcgctgcctgtccacgttgatccgcggccggtggttcagcatccgcgtcaggtcgaagtcgtccgggtccgccgccgccgccgccatcgacgcgtgcgacgacgccttcctcatccccgccacctccatctcgtacaccgccgccgccgtcgtcgcgtccgccctcaagaaccacaccgtacgtacgcgacgacgacgacgacgacgagaagagaagccaaacgcaacgagacgcacggtcgtcggagagtggtggtgttcacgtgggctcgccggagttcggtgcggcggaggagaggtcggtctctggctcgatcggcttcggcttcgggcttccggtttcgcgcgcgcgggtaaataaaggacaccgacgcggggggtgaggaggaggtgggccccacgagtcagcgacaccgcggattattgctgacgtggcgttgcgtgcgatgggggaagggaaggtggtgggggcggttacctgtctgcgcacaaaagggagtgagaggaggcgagatagaggcgacacatttgggattctttcccagataagggaatttcccaacagattttgaatgaagcaaaagggcaaacttgcatgtttgagttattttcttcgcaaccttatcattggcttaatacggtagaatgggttgagtggatggatgtacgtcatatattgtgttacggaattgatagaaaacttgcgacagttttcttctgtcaaattttcagcccttagggcatccacaatgtgcatataaagtgggtagtaagaaataaaatactactactaccagattatatacattgtgaaatagtaagtaataaatggtaatatgcttattacctagccataagcaataaacaaatgatttctctcatccctctctcatggctaatggttgtggggtccagcttactaccaactttttttatttcaccattgtaactacaacaacaactaatacccactgacgcagggcgcacccttattctcaaagtaggtagtaaacattggtgatgcccttatatccgctccaagattcatgcgggcaacaaggaaaaaaacagcagaatatagtgtcgtggaggggaatcgatcctagaccttgctcttacatagggcagcattccaaccactaagccagcccaaccgtaggtattcatatgctttaatctacttacatagcatttacatcctagttacatagtagttacatagcacttacaccgtaattacgtagtagttataccctaattatatagtagttacatgatagttacagggtagttacatttgtataaaattaggatttgcaaatttttttcaagagcatatgtgttttacttttgaattattcttccttatacatgttgaataatttcttaccattcaatcaactcaactgtggatgctaagatcctatggttaaaaaatttgaaagctttgagcctcaaaaactgtcgacagattactagctagttccttgtgttattatttaataggagtataggacgtaaatctcttctgctacttacagaaggagtttcgtcaatcccctccgcaacgcttccggtatgtgaaaaccctttcctttctcttaaaaataacatctgctttagaaaatgatttcctctaaaagaatccaatcatatgtctagaaaagataaacgagccactcagcccaattctttcaatgaaattgaataaaaaaattgtatcgaagaacatcatgttacaacacacaagtcaataacctttttctttaaaaaataatagtaatcccggttttgcttcaataaaagatagccaatgagcccataaccatagaaaatctgagggcaaaaaatatataatcaaacaatgcgggggtattctatatcttactaattaagtacaatccatctattaagtgatcctattaatacttgttgaaatttcatacaattgtgggggggtcaaagccgggcacatttgcctccactgtcctccaccgttgatattttaattagtttagttccttctcctctaggtggggtggattgagaaaataatatcattggcatccctagtcaagtgatgccaatacatttgtattggagcattttttatttctaaagtgtattagcaaagtaaatagcaaaatgtaattgacggttttacgagactgatgcttacatgttgaatccaccctgctactcctatgtgatgtgtcaaaacagttcgataaatatcgcagaacggagggggtacaatttttggcatgtgtgttccgatgttgcgtgcattgaacatggtacactgtgcgtttgcttattcgccatggtacatactcctattcaacaattgtctagcccaaacatggcaaagtttgaactttaccctaggagaatcttctcgaacttgctggatgctccacccgtttcagattataagtcattttgattttggttaaagtcaaattactttaaatttaactaagtttatagacaaatatagtaatatttacaacacaaaattagtttcatctataattgaatatatttcctgggttgaaaatgttaattactatttatttttacaaatttaattaaacttaaaacaatttgatcttgtttaaaatcaaaatgacttataatctgaaatggagggagttgtcaagtagaatagttgccctggattttattctatctagcattcaagaagatgattttgttgctattagttccttgtttgatgcatggtctcaacatgatcatggggaaacgccatcaaaaaaataattgcaagactagttgtcatactccaggtaaattaaatgtgtgtcacatcggtgtgggttccgattacacaatccagctgcaaacgcaagaaaagaagaaacataccactcttaataaattaatcatttctggaaaaaataattaatactgaatcatttcaagatagaagcatgcagaacaatccatctctttcattgatcatgcattgcaattgaatgcatgagctagattggatcacagaggggaaaagggattgtaaaccaccaaaatctttgttaaccaaatcaatgcaaaaatcaaatcatcatgcgtgcttgagtttgaaacactgccattgctgctggaggaattatgatgaattacaaggctccgcaagaccgcaatgaacaggtcaatataccagcacatgtatgattggcactttgagttttccagcctcatcttttcacttatacttatcagccaattttaaatttttaactttaaatttaaagttaaatttgggttttttccatcgtagtttattttttagtctttgtttttaaatcgttaagaacacatatatgaaaattttattcacaaattattttttatttgtaaatatgttgtttcactttttcctccaatatatcaaacgatgaggctgtttgaagcatatgtacatctactgtatattacgtgaacacgaagcaagaaacaattatacagtgtctctcaaataatttggttggataacttgtgcgtttgattaactgttagtgcaaatagagctgactacgcctatttttttggtggtgtttttaaggtaattgtgaaatgaaagctactgtttattttgtacatcacgttttattttaatttttttttccaaatgaggcttttgggaccaattgtcaatacctgctcacatcaatctcgtcattttaatttagatcttcgatgatgctgttacaaacgacggtgtgaataatctgaagattggcatatacactgtcaaacactaattaatcgttggcaggaataatgctttgttagcagcagtgctatcatagcttggttttcaatcctacatattttttcaaacggggatttgagtttcaccgcttcataaatatggcaattgaaaatgaattaccatcacgtgttaatttatagcacgtgggaataggatcaaagtgtgatgtgtgtcaaagagatatataccgtggcttatcaccaatgtcgctattgaggagcgtcgaattatcgaaggggtcacccctcttttttcaagcataggatcctcactgttatattgtttaagcactcaatgcgatcctatcaagcataggagtatcaatataatgaatccttgtcgatgttacaaaaaaccattgcacaacagtgcactccgataaaaaaaatagacagtcagtcatgtttatatggaataaccatggaacaacatttataaaaaaatatttacttattgtatatattataatggaaaaccatcgtcaaagatttattttagagaccgtgtcattttccaaaacatatgaaaccatagggaataaactttttagcatataaaatttgataggtttaaaatggggtgagctatatttcttttcatttctagctaaaaatattgaaggattgtaaaaagaaaaagagtttacccggcaatgccggatgacgtggccaaccgtttcccgccacgtggaggatctactggtcgctcggctgcccgcgtggcgcgctttgaccggtgcctttgcctcctcgcgagggaagaagaagaggagccctagctatcctatcatcgcctatactggctactgcctgtgccgacggcgacagtgatatgattcagggtagagttaattgggccgccggatatcgcatatcgccattcgattaatcaataatactactcctactagcgttcgagaaattttaaatcttactaatcatgagccttttcgagccttggattaagacccagacaaaaccagaaccgctcgctcttcaagggcgcgcgccgcgtcgtcggtaacgccatcgtcgcacggtgtacggcagcacggctgtcccgccacgcctccgggtgcgacgcgacgcgggcttcgccggcagcagcagccaaccaaccgatcgactagcttgtggcctgcagagacgcgcgcggctcgcgctagctctcgtggcggcggttgtgcgtgccacaccactgttacaagcttcccttggtttgaggtatacacgaatacggcgtgcgtgcgtgcgtggcgggcccctgcagctgcagctgctgctgccggtggcggcggcggcggggtggaagccctgtgcgcgggatggcgcccgttccagcggggcacgggtacccttcctcttacttcgcttctcctctcttcccttcccattcattgcatgccttgcctgcgtagttcgatcctagggggggccggtgtgtcaccgccattgcgtgcgcttggcgttgatcgcgacgctggcatgtcgaaggttacatgaaccggggacaacccggttacacgtcgtggaagagcagatcgagaccgcgatcgatcggctgggctggccacctttttcgcgaacgcgcaaaaaaaattgcatgttgatatattagaagaaaaaaagtttttgttacacgacataatcagccagatcaggctggcctggccacctcgaggctccatgctcacacgagcgcgatacctgcgcgcgtggtgttcttttcctcgaaaatggaggcagaacaagtaaaaaattctgtaaataagaaagaaaaagtaaattatattatgggtcatatatttttatgttcttttttgctttggattatttattgttaccctttggaccgcgtgatccacatgtaaatgacacatggataatagaggtagttagtttcattgacaggtagaccactcggtctaagtgtaacatttggtaccaatatatctactagtccagagtggaaaaacactgcaaaggaaattcaaagtgaaactttagtaagtatatgtggtccaaaatgcaaattactactcaataataaaagcagtagtatgctactggctgctggctggtgctggttgaaaagccatttgcaatgcttaccagaaaccgcaggttgaaacccttgaagcttcatcaacgatcatatatgctgggcaggaggaacttgctggatcacaacgcggcacagggtggttgctcccagcctcccaggtttaatttgagcatatcttagttttctcatgcaggtatatcaatatgcagcaaagcttaactatcgattcattgaaaagagataggtcacctgtgaatcacctgtgaactgactcactgcccctagttcgtaccagaagagaaacatatgttacaatcaaagaaagacatgttaattttgcaacacctccctgcgctctttatatatttcgttccccagtgctggaatgctaccatccaggcattagcttgggagagacaaccactcaacatacaacatacgctccttctcacagttatatcaaaggtagcagtgataaataaaagcctagcagtaaacaaaacctcgctccagatatacacgccttattactattgtatcacttgtacaaacgttttggcaatagttggacaacaaaaatatttttcacagaactgttcaaattagaactgaactaagaatcacattttctatcatgcacatgtggaagctagttttagttctaattaacaaataaacagaggaacagaaggcagaaccgcaggagagcacaactgcacaaggcacaactagataattgccgacagagatacaataatgtcagaatcaaccaataaaaccaggtccttcaggattgcatcacttggaagtttgaaacctgacctctgaactatatatatatgtatctcttggtggatagcctcttttggtaagcttctttcactcttcatgagctcgtcttacctgaggagtatcatcttgcccagtaaagtatatcatgacaccaagaagagcgaagacacatataagaatgtatagcgagttcaggctgacaagagagttcaggaaacccatgaaagatgggccactgactttcttctttgttgttcttcctgctctatatccctcaaggaattggcttatttgagaagcttgatcaccttcctctaacttctctgagccttccacctttggcagaaaacatttttggttaattacagggtgtaacaagttctctattagtgctaaccagccaagcagaaaaagatgtttcagaaaagattataagtagacaggaaaaaactaaaaactaaacataatacttctatgaatatgacagaaaaaatatgagcatgccatgaatatgcattaactcgaaaggtggctttatcagtaaaatagcacaggaaggggttgctgatgctggtgcaggcatggatttctaaggttctctacaattatacttaccacttcatactcctcatttctatcccagacgattagctttggcagctgtgagctcttggaaatatcaaaagtctcgacaaactcatcccattgtttgattccgacatacccaaacaccaagtcacggtttgcattggcagcagacctcaaaacttttaccaactgtgaagaagtttcatctgaatcatcctccaaaattgcaagaacaacttttctgtcatcatcatccaacattttgagtgtctctgtgttgatggggacagtcaaaggaagcagggattgccgtataaaatcttccaagaaacttcctgtgtgcacaagaaaaaagaattactaccacatatttgctaccaagaaattcatgggtgaaatagtatgaacaattgcaggtagctacaattaatcaccctttgttgacataagaactcagaaataatgtgatagtttgaattacttcatattagcatcaagaaaaatataaatatataataataaacacaagaaaagagtaaaaaaatagagttgcctaataaataccttcaaatgggccataaaatacactttgttctttgtactttggatgaagtgaaaccaatgcaggaaccttatcaaaatcataagtgaccatgaagtcctcagaaaaatcttttgcaacagcaaaccatgctcttttcttgtatttccctccataaccagcaatcaacgactcattcaccccaaacccaatgaacattggaaagctcgtgccagcattctcaacaaagctcttgatcgcagagtccgactcaagaatagaaacatcaggtgcaacaaacttattaagattgcggacaagcaagtcagcttttcttgaaccagtgtattcgatggggaccccgtggataaaaagcatcagtgtagggaacccgctgtattcagtaaaaaggaaaggaatattaggcatccaccggcatctatactgtcaagaaaaattgaactagttatgagggaaacatcttactccactccatatttcgatccaagcttcctgtacttgtcagcatttactttggcaactatgatgggctcactcagtcctgccaacaccggtgcagcttcatctaactgcaacagtttattttctcaatcttaagtcctagtataaaacagtataatccacagaaagttccctgctgccataagtagtaagcaaactgtaaaattcgagaacctagtaatggccaagaatgaaacatcttgatgcgtctacaagacaatatgatgattctcacgcgaccacgcccacaagcccacaataatacaaggacttgtctctctaccttttcacagtaaaaaaaaaagctcacaacaatttcctttcttgagttcttccccagagtaatctcgatcataatcaaaacgacggcatataacatctcatttgttgtctaatggtcaacataagaatcatagtgacaatcctaaaactatataataaaaaaaattatcatcctttaccctttcccccacacgccctaatctgcagttcatgagatctcatctcgccgaccaattacgatcccggatacctagtcaaacccaccacccccacaacactcgctgcggtgctgacgagatccacagcgggcggcaaccacagctcgcaacagttgttcactcaattcgcatcgcatcacatctcgcaacttctccgcacgagttcttgatactggtaacaagcaaacacaggtggtgctggtggtcgaggagaggggagtacctcgggggcgaggcgcttgcagtggccgcaccatggcgcgtagaagtcgacgaagaggtagtcgatggcgcccagcgccgcctcgaagctgctctcgtccagctctatcacccgcccgtcgcgcgggaactcctcggcggcggcggcggcggcggcgtggaaggagagcagcaggaggaggagaggaggcagaagcagcaggaggaggagggggaggggtctcgtcgtcgtcgccgccatcgccgccgattccgatctccgccgcgccggaagggagtggtcctgacgcccacggaacttgactagtctcttgatggattggaggggtttattgggatattttcgtattggcccctctacagtagaaacgtgtacattttgctacctacattaggggtctcatcgtttggctttttttcataataagctaaaacggtttattagagaataaaaatgaatttgttggtaaaatttttatatatgtgttctcggtgacttaaaaaccaatgctgaaaaaaaactacgttgaaaatatctcaaaatcaatatcaaaattaagtttaaaaattcaaattttggctttttctttggctgaataggccatccgatggaagcctaggattagatgatgtgaaagttaacctttgttaattaatttggagcgagttgcgtttcgagccttttatcaccaaactttcactttagagtaagaataaaagtgagctataactatataaatttatgtgaaagtaaaagataaagaaaaaacgagaagtattggatcttgagtaatagctagctatacatttgcttcaagacatttacattaaatatatagttagagaaagagatgatagaaaaaatatagtcaaatctattatacattttagttttagtatgagctaatagctactagtaacagttagctatactattaaactcgctcttaaatcatcctttagccaatctttgtttcgcatttattgtactctggagcacataagtgaatcacccgtacaccgacaatctttcaggcttacgtgtagaccatcatttgtaaggtgagatagtagatgcactaaagatgggattagaagtaaaacttcgataacaaagaggtggaccaaagtgaaatctactaaatctgtttacacgaattttacaggtcttttaaatagaaattagtccatttgctccaatattcctccgtaagatcgtataaaggagggcaaacgtacttgatttagcaaattgtaccggctaacactcgtcctttgactaattattttgttaccttgtacccgtcaacattatttgacgtttggagtattaagattagtactgccttcaacgtcaaatattattgactgaagggagtatataatcccgtatgtgaattctagctgacgtactgatttgagtccaaaaacatgtgtgacctccaacatttccgacagattggcagattgcacatctctacaaataatctgaaaactaaaaaagaatatgaccaacatcttctgaaaagaatggactcgtgaagctctgaaaagcacgaacccgtgaagataatactgttgcaggaaagaacggtaagtacagcttttcagaaatttccagcaacaacccatcaagcagaaccatgatatagatgggcagtgcaactaaaatacaatcgtggttagcatattcaagaactcaggttccgcttccatgtataatatccacatcagcaaaagaaaacttgaaaggcgaggtgtaaacaagtagtaaacatgaattccaactatcaatttcaatcacaataagaaataaaaaaaaatatgagttaaaacaactgtgatcacgctgcctggtttctccacagccaggaaagttcatgccatgatattattaacagaaaatagcagtattcctacatcaaacgccatgaaaaggagcttacaacttcaggcaagtgcaaaatggagtaacaagcaataaccaatttaaagtgaagtcccaattttaacttcgcggagtgctatagaaagtaagttcattatgtagcacttagagagcttatccggaggcggtcttcttctgctggaaaacaaccgcataaactgggactgcgatgccaatgccaactgctcccagcacggaaagatacaccttcggcttctggtgcttcatcctgtgcaagttgtacatgtgcttggcatggaggtagtagggctcatcatggccatgccctcccatcctcttcacaccagtggcatggaatccacgagaatctgttatatgcacagagaagagaattcagcaatcagaagtgaactaaaatagtagagttcacaatttgatgatacaggaacaagccaaacatctcgaaggcaaatacacatccaaaccaataactatatttgaagatactactaaacaataaaaaaagaacaagccaaacatcaaagatatatttgatgatactactaaacattaaaaagaagaacaagccaaacatctgaaacgcaaatacacatccaatccaatagccaacaattccaggtctccactcttcccccatccaagctactctgattatctctaagattcgctagaatgcaccatagatacatatagcatgacaagatggacacgtatttcgacccttggcagaaaaccattagtaatactgctcatcattaacatcacagacaaataaactagttaaaaaacggcagcgagcaggtgactagacattttgtgagaaaaacaggttatttgcacaatactctcctctgcacagatgaaaccagggcaaccaaaacgagaaattggacattctgccattgccaaaactaggttttgccaaaatgccactccgcaaaagggattcgttaaaatgccaatctcaacccgtggctacaagctacaatgctatacgggaccaaattaccctcgttctcctcgcctgggcatgtggagctgcttgctgttgggtcagtccatggcacggagcagcgaggacgtcgctggcacagcggctttcggcgaacgacagtgacggtggcgttcggcgagcggcggcaccggcaggaggcggcggaggcgaacgcgccgccgccaccgcctgacgtacgcgcgccgccgccgccgctgccgtccgacgcacacgcgcaccgccgcagccagcaacgcacgcgcacgtcaccgccgccgcccgacgcacagaatttggacatcagaatttcatcacagttcacaagatggccatccgtttgatcatttcacagtgacggcatatcgcagattcacattccaccggcctacggtcgattcagtcaccacaggctagcccaaaaatcaaccaccaacatggtccatcgcgggattcatccaaacgagaatgatgtagcgattgatctaataaacgcctacgcaaaccaaatcacagcggcccaagatccatcagccctagaaacatttcgatcgccaaacccccgattcgcttttccaggagtcgcggatctaccgtccaacgcatccaaaccaccacccgaacaaagagaaacgggaacatatgcatccatcgaggcgaatcgctcgccgcccggcgccgaaaccctaaccaggccgcctcgcgcggtcaacgcgacgcagctcgaggggattggggaggagaagggaggggtagggagcgcttgcctgtcttggaggcctcagcgccggtggcgaggaggcggatcccggagcggaggccgcggttgagcgccgtcgccgtcgccatcgccccctctctggtttcgctcgtgttctcgccttaggtcgcccccgccgccgccggtctggtggtttgggttggggttgggtgccgcggtttcgctgatcttggctccactaccggttaggtcaatctcaccactcccgagagatgcggggggagtgtgagtgggcttcgtaccttgggccccagcgctgtaacatgggccgtgtgggcctccatgggcctgaaaataaaagaagaaaggaaaacaaaccagacgagttgaaaggcttcctttccttccttctcttcctcctcgtctgctccatgcttccagcacattgcaatttcagttcttttcactgcacacttcaattctgccaagtgccaagaaccaaatgtttgaagccatatatgccatggaacgatcacacttgacacactgacactgataccttgagagttcctttttgagttttgataacccagaacgatcaggttgcctcctctatcatgacggagatgctatcaacctcctggcatatctgctcgatcagagggtgattgctgtcgtttgaagagaatgtgacgacctcccccttcagctcgatccagctacacccggtctccttcttcagccctcgttccttcatgaaccctctgacgctggcagcgctgctccacatctctttggcggcatatatgttcgacaggagtgtgtacattcctccgtcggagggtctagccttcaggacatttctggcaatgatctctccaagctggatttccccatgagagttgcacacgctaaacagcgtctcccacgcggtcgttcgatggtcagatgggattctcctggtaaaatcataagcctggtgtataaagcctgatcttcccaagagatcaaccatgcaggagtagtgatcagatcttgggaccaagttccagtcttcttgcatgctgcgaaaatggtagcagccttcatataggtaccccttatgtgcgcaagcagacaatatgcttaggaaggtcgcatgatctggtctaaatccagcttttgtcatcatgtcaaaaactttcaaagcttcatcagcaagaccatgataagcgtatgttgcgatcatggcattccatgtcactgtgtcccgctgcaaaatcagctcgaaaacttgggnnnnnnnnnnnnnnnnnnnnnnnnnnnnnnnnnnnnnn

SEQ ID NO: 21148 - DNA, 3919 bp, Oryza sativa
cacaatgcagccaaagatgaaactacgttggctagttacagtttacgcccaactgtttccagttgactacatggggtctcatactctcatgacatgccaagaaacgtcattagtaaggtgggcccacctgcacagtgacgtctgaaattctgaatgcagcagcttgtgttggtaaaatacgagtagtggtaaaggtttactaaaccgttatcgccactctaaggtttgacggtaaccgtgtggttatcatgtaaactgtaaggttactgtgaggtatattatggttttaaaaactgaaaatgttattgcacgtgataaccgtagttttgtaaaccctgataattctcaggaaaggaaggacgaactagcaacatagttttaccagttgggagttgggactatcctgttaactttcagcctcaggtttctacttcgctgtcaaacaacctgtactgcatcagttcatgggttttccgtgaatttaatgctgctttttttttttttacttctgcagtttcacagctgaaatgcactgtgacgatacttcgatatcgtgagtctgcaactagctgtgaatcacgtttcttgcccctgttatctttcgggcattcaggatgtaaaggtctctgatctgtgatctccctgttcttatccttagttatgcagtaataaccagttgtttgcactctaactaactactccatccgtctctaaatataataaattttattggatgtgacacatcctagtataatgaatctagataggcttcatgtccagatttattgtattagaatgtgtcatatccaatcaaaatttcttatatatagagaaggatggagtattgagttaatcaacgtatctagttccggctttggaatatgattttgctttatggttcagatggttaccagagacacctttatccaatgactatgaacctttttttttgagagagagaaaaggactatgaactactctctccgtattttaatgtatgacaccgttgactttttaataaacgtttgaccactcgtcttatttaaaaattttatacaaatataaaaatacttatgtcaatgcttaaagaacatttgatataaatcaagtctcaataaaataaattataattacataaattttttgaataagacaaaaagtcaaacgttggtcaaaaagtcaacggcgtcatacattaaaatgcggagggagtatttgagatgttccacaagtacgtagtattatagccaattatcccatcgtttaccttttgagcttttagcttatgtaagttgtagccaaaatttaaattctaaaaattttgggatttttcaacatagtttattttccaacgtttgtgtttagattgctaaacactcacacatatatacaagttttatttacaaattattctttaattatcgatagtttgttacaaacaatttcaacgtagtttattttttccgacatttgtgtttagattgctaaacacacatgtatatataagttttatttacaaattattctttgattattgataagtcgttacaaacaacttgtaatcattgtaagcgaaacaataacagtacaagacaacatcatatcttgtaagcccttccaaaaaatacattgggtgtttggttgtttgtgccactataggctctagcttagtccatacttctttcatcctaaaaggaaaatccaattctagcaatgattctaaacatatacatgtacggattgtgatcctttaacttaaatcacatgactttcagttattgacatatggaccctctttgttacgtgctcacatgttagtgagcctaaagtcactgtaaatatttacaatagatgatctcaatatatagaaatatagaatagtcaggattagattttctttggaatgcagggtgtacgattcttcggttttcaccgtgatttggctgattagatgcaatttagtcctgccactgtggctaagattgatatcctgtttggtcaaatgcacgctctttttttttttttggcttaaccactaccactgatttttcgagaacgagaggaattcaaatatgaaatgaaatctaattccagtggcgcagaggtgcagaagcaaaactcgccaaggagagcattgacgttaacccggcatgagccgtgcagctctcacttgatcatcttatcgctactcagccactcaaaaaccatccttaatttgcctttccctccacaacttgaacacaagagagagagagagagagagagagagtgagagtgagacgccatcactagctctcacttagctccaagctgagctgagctgagcttagccatggggtgcgcgggctccaaggacgtcacggtggccgacgtctaccgcccgccgccgacgagcgtctcgctgttcgacatcagcgccatcgaggagccctggctcatcgccaccggcaagaagaacgacgaggaggaggaggaggaggatgaagaagaggaggaggaggaggaggaggaggaaggcaagaagccgaccaccaccgtgatgccgctcccgctgctcgacaagctcgacggctacgacctcgcgccggcgtcgtggtcggaggtcagcaaggccctggaggacatcaagcctgcgctcagctccaacaccacgacgacggagaacgccaagaagaagaccaagaagaagaagaagaagcagcctgcgccgccgccgcagccaccgacgacgacgacgacggtgctgcctgagccggtgaaggcgatcgaggcagctgccaagaaggcggcggcggcgccgtccgcgcgtggcgctaacgaggaggttgacaggaggcctccgccgccggagctcaccgggcggcgcgtcgttaaggacaaccctttcctgatgcgcgaccgcgagaacaaggggaacgacggcggtgccgccgccgcggcggcgaggtggcggcggagggacccgttcgaggggtaccccgagcggcggcccccgggggcatccggcggcggggtggtgctgtacaccacgacgctccgcggcgtgcggcgcacgttcgaggactgcgagcgcgcgcggaaggcggtggaggcgtgcgccgaggccgtgtcggcggcgggcggatcccccgtcgtcgtggacgagcgcgacgtgtcgctccacggcgagtacctgcgcgagctccgcgggctagccggcgccggcgacgcgccgccgcgcctcttcgtcatgggccgctacctcggcggcgccgacgcgtgcgccgagctcgccgagagcggcaagctgcgcgagatgatgcgctgggccagggcgcgcggcgaggcctgcgccgccaaggacggccgcggctgcgagggctgcggcggcgcgcggttcgtcccgtgctgggagtgcggcggcagctgcaaggtggtcgccgccggcgccaccgccgccgccgccgacgtcgagcggtgcgccaagtgcaacgagaacggcctcatgctgtgccccatctgccactgattgtgctccaccgccgcgaatccttctagcgtttaatccgcgcccatgtatatttatccataatatactcgtataattgtgagtttaaactacactctattagtggtttataaatgagaattgaaatggtatatagtgcttgtaatagtattgtatagcagtgtattttttgtaaatcttttttgattaattattggaacaaatgctaatagtttcgtcttaattgttcaaaattagtaatctatcttaaccagtcaaccatcccagctctgtactacatctgttacatctgatagtgttatagtgaataataaaattaaataaataaatatagtaaataatttgagcaggtcaatctaaacacgctgtcaaggactagtactagtggaagggagagcgttgagatccaaa

SEQ ID NO: 21149 - DNA, 1489 bp, Oryza sativa
tcaaagaaaatgtgtttaattgtatccttattattacataaacaacagttttgatcgccttgctaattatgtttagctagattgtcttgggttaacacaactttacgatgaaggtaccaaaggaaaatcttaaccttcaatggcatatttagtttccaagggcgtctatttatattcgagatgtcactataaactagagatgataatgagactccatatggagctgtccattaggggtcatcttccatggaaactcatcttgctcctaaattaaaccaatattagcgatgtgtggtgataaggtgttccatgtgactaacttcgatccaatttgatcccttctccatgaaaattgggatatccattttgaaagacatcttcgatagttgcatgtttgtgcctgacaatgttgtagaggaacgagtactgttctcgcagggttacatttcccaaccatttgtcttcgcagaacctaaggataatacggataatatgccatatggcatattagcaaaataataatacagtaaattgttggtaaaatttttatatatatgttcttagcgacttaaatgccaatgctaaaaaataaactttgatgaagaaacttcaaattcatcttcaaaattaagctttaaaatttaaattttggcattggctgatgatgaatagagaaaaagatgggggcctaatcagggccggtcctaccattttgggggcctagggcgagagggaagtaaatgccctttttatcttggattttttttgaaaaaaagttgtttaatttaattttctgattgcaaagtgattgatatgcaatacatcaatatatacatactttatttaattttttttaaaaaattataaattatacttcattttatataaaatgagctaattatatatgttgatatttatttctattagaagttgagttggttttcgtgttccgagaaaaaaatgtttccgtattcgtgcccgatcatattcgatttttgttcgtatttgagataatccgtattgtttctgtattcgagctatccgtatttgtttttatatcggtaaagaatatgaacacaaatatgatacgagcattatctatctatatcccctccgttttcatcccacatcgcgcaatcgatccccgtgccgatgctgcctccgacggtgcgtccccaacgagtggcggtgagccgtcacaactcacaagacctcactgagatgggctagcaagcttggtgggctgggcccaggatcccaggggcccacaggcccagcctttttccttctccaagaagggcggcccaaatccaacggctcagctctctcctctttccccatctcttcctcgcatcgaccgaccaagcaaaagcattttcttcttcttcttctctctcctctctctctccttccccacgagaaatttcaaaaaccctacctccactcccgatctccacgaaaccctagccgccttctgctagatcgccgc

SEQ ID NO: 21150 - DNA, 2689 bp, Oryza sativa
gtgggagtcgctcctcccttccatagtctcctccctaggcaccgccctctccgccggggacatcccggcgaccaactccctcctcgccgccgcggcctccctcttctcccgcttccgcaatgccttcgacagcaacaccatccgcctcgacctcaagtactgcctcgagaacttcgccgctgccctactcgaggtcttcctctccacctcccgccgccttcaggctgccgcacccacggtcaccccgcctgaatcccgcccggtgtttgagtgccttcgcctatgctgcgagatcttctattcgctcaactccatcgacctgcccgagttcttcgaggaccacatgcgtgagtggatgacggagttccgtgcgttcctcaccacctcctacccgccagcgatagaggcagacggcgccccggatgcgctccgcgccgccgtgtgtgacaacttgcagctgtacatggagaagtatgaagaggagttcaggggatatctgaaggagttcgttgaggcggtctggggcctcctcatggcaccatctgtctcaccatcccgcgggcagcttgcggtgaccgcaataagatttttgacaacggttgctgagagcgtgcaccacgcgctgtttgggagccctgatgcaatgaagcagatatgcgatagtgttgtaattcctaacctgcggttacgggatgatgatgaggagctgtttgaggggaactgggtggaatatgttaggcgtgatgccgaggggagtgatgcggatacactgaggcgggctgcatgccggttgctgcgggggcttgcggcaaactaccgggagcaggtggctgcacttgtgtcagcacaggtccagcagatgttggctgcatatgcagctgatcggacgaacaactggaaagagaaggatgctgcaatataccttgttatttctcttatgcagaagcctggtgccacaggaggtgggacaccggtggttgatatggagagcttctttacatctgtgatcgtgcctgagctgcaggcccctgattgggaatctgaaccaatgctgaaggcaactgtgctgaggttcttgaaggaattcaaggatcaaatccccaaagccactgcactggcactgcttccaagtgtaataaggttcctgatacacgagtcaaatgttgtccattcatatgctgcgacctttattgagaaccttctgatcatcaaggatatggtaccagtaccaagtgcaaatgtgattaccagggctccacgctatgttgctgctgatatcaacccatatgcccagccgattgttcagaacctgtccaaggcactaagttttcctgaatcatatgagaacccctatctgatgaagtgcctgatgagagtgcttgggattgctaatattgctgggcaaattgttcatgagattactgctcgccttgtgggtattcttatggaagtgtgcaataaccccaagaaccctgattttaaccattacttgtttgaagccctggcagcagtgattggtcgggctggtgagcaggacccagcactacttcctgtgtttgaggcaagcctcttcccggtgcttcagaggatattggttgaggacatctcagagttctggccatatgctttccagatatttgcacaacttgtcaatttgagccgaccacctctctcgcagaactacatgcagctgtttggtgtcctgctcagtaatgctacctgggaccgtccaccgtgtgtccctgccttggttcggttgctgagagcattctttcggaaaattccaaatgagcttaaccaagagggcaggctaccgaatatcttagtgatattccgcagtctcctttcgcggagcagtactgaagattctgccttctacatgcttaacacacttgtggaaaatgtgagttttgacatcatgaatcctcacataaatgagatatggagtgctttgtttactcgactacagacaaggcaggcagtgaagtttgtgaattctcttgtggtcttcatgtccttggtggtggttaaatatggaccaggtgttcttgtcagttctgtcgatgcaattcagccaaatattttcatgacaatccttcagcgcttttggattcccaatcttaaattcatcaaagggactgttgaagttaagctgacatcagttgcatcaacgaagttgatctgtgaatctgcactgctgttggatggtgcagcagcccaaacttggggcaaattgcttgacagtattgttgcattgctgtccagaacggatcaagatggggcacaacaagatcagaatgatggtgctgatgcagatagtcagaggacatcaggttattctgtctcatttgtacgtcttcaatatgctggaaagagtgaagatgatctgttgaaagaggtaaatgatccaaagcagtttctggtcacctccttggctactctttctgcgcaatctccagggagatttggtcctatcattgagcagaacgtggatcctgcaaacaaaggcgctcttattcaactttgtgcagcttacaataccaacattgtctaggtaaacaacctctcagttccttcccatttattgcatcgagtcaatccaatgcattttcatttgttgtcttgaaaacatggaagtttttcatctataaattctaatattagctgtaagtgaactttccattggaca

SEQ ID NO: 21151 - DNA, 17321 bp, Oryza sativa
  unsure (1)..(17321): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtcccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcgatggcttctcagcaggaacgggctagctaccacgccggcgagaccaaggcccgcgccgaggtgaggtttcccttcgtgcatccgcgcgcgcgcaccgcacgtacaccaccacgtttgtcccatccgttgcgcgtgcgcttacatttgttgtttgcttgtttcgtgcgttgcaggagaagacggggcgcatgatgggcacggcgcaggagaaggcgcgggaggccaaggacacggcgtccgacgccgcggggcgcgcgatgggcaggggacacggcgccaaggaggcgaccaaggagaaggcgtacgagaccaaggacgcgaccaaggagaaggcgtacgaggcaaaggacgcggcctccgacgccaccggccgcgccatggacaagggccgcggcgccgcgggcgccacgagggacaaggcgtacgatgccaaggacagggcggctgacacggcgcagtccgccgccgaccgcgcccgcgacggcgccgggcagaccgggagctacattggacagaccgccgaggccgccaagcagaaagcggccggcgccgcgcagtacgccaaggagaccgcgatcgccggcaaggacaagaccggcgccgtgctccagcaggttcattagcactcgcagatcgtgttcttttcctaaccattctattttgttaaacattcatgctaattgctgcaaaaaaacgctctcttggtgtgcaggcaggggagcaggtgaagagcgtggcggtgggggcgaaggacgcggtgatgtacacgctcgggatgtcaggcgataacaagaacaacgccgctgccggcaaggacaccagcacctacaagcctggaactgggagtgactaccagtaatacggtataagaagcatgtgtcgtctttggcactgatgccaaagtgtacgtgttgtatcctcttttttaagtttcagctcgacttcgacgtgttcggtgtcacactttggtttttcagttgtgctcaactgttcatgtttctggttccatggagggccagtgtggaggtcaatgtttaagctttcgttttaaaatctgataataaagttggttaagacctgaaagcgttatcccttctccatttagcgacttggaaaatggcaaatgagcacacaaaatgattggtgcttagaaaccacatttggagatcaacatattttgttgccagggtttacaggataaacttcagataactgttcatcagccaaaaagacaatgaaaggaagaggtcaatggtgtaaatcatagaaatcaatcacacatcacaccttgcattaatttccagatggaacacattacacatcagtatcactatatgcacagcacaatatagtagattcatttcacagatctcgcactgaaattcatttcagatacacaatttagacgatgtagtagcaaacaaatgccacttataatatacccatgaaaaacaaacaaatacacacacgaacgcacacaaaagaatggggggcagcattagcaatatagcatctgccatcgatctgcgctgctaaaccaatgaccatcacggtcagaagccggcaaacttagatttgatggcgcccacttcatcctcgcccatgagaaacgtcttggcgagcacctccatcggcatggccggctgggtcgcgaagagcgcgaaggtcggcgtgacgaggccgggcgactggctgtcgaacatggcgacgaacgacgcgttgccggcgccgacgttgagctggaagtgctgcaggccgcggggcacgacgaagagctccttctccctgaccaccttggagaagagccggttggccgccgtggtgaaccccaccatgacctcgccgctgagcacgagcacgagctccgaggcgcgcgggtgcgagtgcggcgggttgaggccgccgggcgcgaggtcggtgcgcgtgatggagaggcccagcgtgttcaggccggggaacgcggacaccgtggcgcgcgtggagttgacgccgaacgggttgctcgtgctgggcgcctggacgatggcgtcgcagaagaagtcgtcgctcaccacggacgccgtcggcttgcacgggaacccgtcgaccgctgtcgccgcccgcaggtcggccacgcagatgtcctgaagcggcggcgagtccgcgacggcgaggcgcggcgccccggctgctgccacgacggccaccgcgaccagcacccggagcacgacggagcgagacgacgccatcgtacaccaatgtacgtagccaaagcgaatccctagaagtgaggaactaactagctgctcgatttttctcgagagttgatcatggtggtgaccatgcgctgctggctatatgtaatgctagcctagcgagatgcgtgcacgggtggacgtgacgtgaaacgattctgccgatgtggatgctagctgaatcggtgatggtgtcgctgcagctcagcgcaggcggttgacggggtcgcgaagcgcgcgcgtccatggcgtgcggccggacgatagccaaatgaaatcaagtaggcgcgcgtggcggcatgtactgtttgtcgctgtcgagaccggcgcgtcgggtcgggaggacacaccatttggcaggtccccgggaagtagatgcggagtagcttgcgtcgcgtttccaatgacgcggagaagaggaatgaggtgatcacattaagaaatatctacatgatagttttcttcgccgtttgcattttaaaggaaaaaagtccactctaactcccttaaagtaggccaatctaatttgtaccccttaacaagaaaataagatagaacgactccccgaactattaaaaccagtacaacttgactcctctagcaattttgaagggtggttttgctgacgtagcggtgttaacccagttttcatcccacgtagcatgtgggggcccacatgtcattctttctccttcccttctctcttccttctctctcttttctctcctccttttctcttcctcttcggacgcacgcggggagcgagagcctcatcggcggcggcggcgggcggcggcggagtggcgacagcagcgtgcgggtgagggctggagtgggggtgggcgggcggggccagagtgatagcggcggcaggcgctggagcggcgacgacggcatgtgggcgagggctggaacggcggtggcgggtgggaggtgagcactggagcgtccaccatcccctccagctttgcctcgccatctcgatgtcttcgtcgccgtccgcgtctccttccccacctttcgctgcgctgcctctcccctctcccttctcggacggcggcgacgcttcggcaggcggtggcggagatagaggagtagctcgacggtgtggaggacgcatccgagctcggcgatagagggcgggcgagatctcggcggtgccgcctctcccctttcccttctccacccccggcgatagcctcgaaaggcggcggcgctttggcaggcggcgacggaggtagaggagtagtaggacggcgcggagggcgcacacgagctcggcggcgttgcgaccggccctcgcccgtccgccgccaccgctctcggtcgcagccgccgccaaaaaccacgggacgcaccgctacagctctggtccgcgcccactgttgccgtcgctccagctctccccgcctcggcagacgccgcgtgctccgtcgattcaattgtggtgaacaccatctgggatgaggcgatggtggcgaccggcggtgcggaccagccgtcgtgtacctcgaccttgccgtccccggccatcctccccgcagtcccctcctcttgcagccgcacccgtcatcccgcccgccaccgccacggccgaaggggaaataaaagagagagataagggagggagagggaggggggaggaggaagaaggaatagagagggaaaggatgacatgtgggccccacatgtcagtgggtcccacattatttttctgagaatgacaaataggtcccacattttttttttagttctgatgccacataagcaccacgtgggacgaaaaccgggtcaacaccaccacgtcagcaaaaccaccctccaaaaccgctggaggagtaaaattgcactggttttaatagttcggggagtcgtcctatccgattttctgattgaagggtaggaattagatttggcctactttttaaagaactcaaagtggactttttccgattttaattggactcatctactactaaatttgggcccaataatttgggctttaaatagactcaaagaagcccattgttatgttgaaggcattgtatcccattaagatatcaaaagccactttacatccctcaagtagaggttgaattttattcgtgtccctcaaccataaactcagatacagagtatccccacctctaaaaccattgtagaccaagtccctcgatagtattgagagcagttttgactcatgtggcacttacatggcttgtttaacttggtgcagcgttgacgcaatgcgtacttgggaggataaaaatttaaaaaaatacacataagtatccattaaaaaaattaaaaatgtggtacgacccatatgtcatcacccctttctctccctccctcctctccctccccttctcgccaggacacattagtggtgagctgatgtcgggttggtgggagttcactagcagaaacctccaacaagacgagcaaggcctcccggacactttattcctccaaatcctacgatagcatgtcaatgtcgcgttcactccattcctgtgtcctctacctccagcatctatgatgagcacctccaacaacaacaatcgtaggtcttcctcagcgtcctcaccgccacgggtggacatcaccagcaagaacgagcagctcacgaaggattactacacgctaacgcacgatacgaatagaggttactggaatgcgtggtgtgcctcttggagtttagggagcgggagacaggagttcaaactgatcaagaattaagtattggtgagtcgttggggttagcgtgccgttctcgaggccgatgcggtgaggcggcgacacctgaagtctaaactaagagcaagtatagtaatgtacagtcagctggcgaaatcaaccgctgcgtcatccaaatccaacgtggaggagcgagaaaccaagaaagagaaggaaatgggcgagtcgcgagtcgccggctcgaagcgtcgtacccgaggcaaaacgcccgctcccaactcggtgctggcgattgagccggtgcctgctccacaacagatgctttgcacatgcatatattaattgcttagatgttttaattaggtaacgtatcagtcagcttatagtcaacccattatacaggtgagcttttaaagcatggctaagtgacatggcagtggctttcagccggctgctggctacgttactatccttgctctaagagcaagtacaatagcaagctattagccagctgtaaacatattttaatgagataaatgataaaagagaagagcagtgggctacagatttgtagctagctgtagcgcatactccaagacacaatgtgtgtatgacaggtgggaccatatattaatagtatagtaagcaactattgtatgaattggctatatataaattggagctagtagtgggctatactattaaacttgctctaatgcaccgagggagaagagaaagggttgataacatgtggccatgtgggtcccactacatttttaaatttttaaacaaacacccagtgactatgggtcccacaatatatttaaatttttcttatagtgccacgcaagcgccatgtcaatcgtcacatgggataaagaccaaatcaaataagcaatgcaagcatcacatcagtaaaaaccattcttaatattgccgagattcaattcgcactggttttatggttgagagatgagagtagaactcggcggtgaattaagggatgtatagtagactttttttatcatgttccaatccagcaacactgtcgagtgtcgacctcaggttgcctgcttgggccctaggcctagcatatttcggaaataagaattcctcgatgtaatcacgagcttaccagtcacagtcaggcagtcaccagcaatctaagcgcgtcatacatgcgtaacgcgttcacgaagtccatggtgccagccatggaaagctaactctgttggaactgttctaacttctgatatgccagctcaagtacacattatatctcgcttagtccagcgtgacagcgtcaaccatctgatctgaccagctggatcctggatcaatcatcgaagatgaagctttggaagtatcgggcccggggacgacagcgatctacgtacgaaaggctgggacaaactgaggtacgaaacgacgccgtattactgtgttgctgtttgattgccaatggccagtggagattggctcggaagcctaagtcggcagtcaaggggccgaggcgagcaaccagaatcctgtcaactcaatcgatcgggccgaaggtcactgttggtggacgggcgaggctgtccaaaacgatcgattcgacctgttaggcgttaggccattcacaatgcatctacatggcatttggtctcaactgtccagctaaacagattgtatacgtggagaagaaaagaaggtggggcccatgtattcaccagcttcgcgcgtcctcatttggctccgagagcctcatcagaaaaacagcttttttaatcgcatttacacatgagaaagcaggacagagagagagaagggggagaagctgacccaaaaaagtaaatttttgtggtggggcccgcatgagaaacagtttggtggggtccacctaaagacacgcgcccacgccgcattgtggagagaggagcttcacgctgtttcttcgtacgtggcttcgtacgtggctgtttaggctccttagaaaaatactacacagtgctaatgcccttgctaggcatctgtccgcgcgctcaccggcggcggcggaccgggtcacgcgaccctgaccgagcctcaccgttaaggatcacatcatgaagcagcaccaggccaccagcacgtactacctccgtctcagcagccgtggaaatccgtgtccaacgtttgaccatccgttttatttgaaaattttatgaaaattttttaaaaaattagtcacacataaaatactattcatattttatcatctaataataataaaaataataatcataaaaaaaatttaaataagatgaacgttcaaaacgttggagatgaatagtgtaaaactacatttattttaggacagatggagtactgtctgtctgctggatgtcactgctaatcgtttcagactgcatgcgcctttgcctgaaaggcctctgtttgggattgtttttttttttaaacgaacctctgtttgggattgtcgcggatgtgttctggacttctggtgttctaggcgcttggaggcatggatcagcaaactcaaccaacctgatcgactagcccttgatgtcattataaagcatggagcagcaaaccaacctgatcgatcgattagtagtccagtagtccttgatgtcattatacatgttccccatttttcctggaacatgtgccattcaactagtaggacttttatattagagagaaaccacaaacaaaaattgaacacatttttaggcccggtcgctccgccccaggggtgacgcgggcggcaacacctcaccgtcgccccctcctctcccacgcctcgccgccgcccgagcagccgccggtaaagccgggcggctgcaaagacggcggcggcggggctcccctttctcctcactcctggtcaagtggttggggcgccgatgagaccggagcacgaggggcgcagctcggcgaggactgccagatccggcgccgttgaattcggatccggccctcccttggccggatctgggctggacgcgcaagtcggcggcgaaggcggcagccgcggcggcgaccgcggcgcgagggccgcgcggaggaggcgacggcggcggcgaccgcagcgcgaggggcgcacggaggaggaggcggtggcggccgtggctcgaggaccgcacggcggcgactgcggcgcgaggacctcgcggcaacggtggctgcggctcgcggacgtgcgtcaactgctgcttctctggcttgtgtgcacgaggaagtggttggcggcggcgacgtctcttctcccaggcggcttaaaaaacccatctcgtggagctcctcccctcctatggccagatcctgttctggccgtggggagcttcaggagagggtggacgcggcggcttgtgcagaggacgacggtgccatggcgacgtgcgggaacaagccgcgagcctacctgagccgtggggtggtgaactgggctaactggtggctgatgaaatgatgtggtggttcggcgacggttgttgtgtggttcagtggtggcgctggacgaaaatcattggcgaaagccttgcttagcctttggctggcacgacggcggcggcgcctttggcatcgttcccttcttggaggcgtcgttatagcgttttctccacgctaccagtctctaggtgaaaactgtgatccggtttccggacgggcgatggcggcgtttcacgtcgtatcctccttgggggcatcgtcttggagaaccttacccatgcaccatttgccgcttgtggactcctgtgtcagctcgatgtgctagatgcctaggtgcttggcgaggccttgtccttcttggttcctttcttgtattggtggcatccagcttattcgtctgtctctgtcgggtggagtcgaaactgctacgtcgttggggtgcgacgaagcttggcaacgataacatttgcagtttctctctagggatgtgggtgttgctagtacaggctttggcgcttcaggggcttgaatgatgtccaaagtgtgagcttggtgttgctttgctcggtttggcggtgcctacaatgatgccatgatcgccgtggagttggagctgctgggtcgctgggcggctagctcggtaacgatgacatgtgccttgtgatgtcaacgcggtgtgccgcctcttcagcatctcgacatcggtgttcgtcgttggattccgccatcgtttcgttgatagtttggctagagtgatatagagctccgtgtgctgtgtggttgtaccggccacggtggaaagacttggcgagtctctactcgccgagagtttgttttttctttttctgtaacccgtctgggtttttactcctgtttaatgaaatataattgacagttctcctgccggtttagtttaaaaaaaacccaagctcatttttgagagtcaacgttgtactccatcatgcatactcatgtatgagcatcgcgctgctatttctctatgtatctggatgcatgcatcatgcgtacgtctctctcgcgttttcctactcttccgtacgcagttcgtcgattgcgctcttgttcctactcttttggttttcactttcaagtaaacgccgggtaacccccgcaaagaaaacggacgcccagagacatacggtagcaggcccggtttgaacgcccgccggcgccggatcaatccgtgatacccaagggtgccgcgccacgtatgacgtaccaatcccaaatcgagtcgagtcgagtcgccgggagcgcgcaaaggctttagctagccaacgcagagcatgtcttggaacgcgtctcaagtctctccagtctccacacgtcgttagttccatcgatgatgatctgtggcaagcagagccgcctcaagtagaataactcgcccaatgcacgcgtacattcctttcacctaatgcgtagtattggcgtattgctgacacacacaccctccgtcgtttgactgataatttttttctccccgtcgtttgattgataattcgacatgattgacagcgtattttagctaatccctccatactaataaaggaagtcgtttagaatattgatacggtctctaaaacacaactttgacttcttttttctataaaaaatattcattgaaaagtgatatatgtatacttttataaaagtatttttcaagacaaatctattcatataacttttacattttcaatcctcatgatttatattcccaaggtttaacttaaatattatcctaaacgactttctttacgagtatcgaggaagtacttttctctctctttccggtcaatgtttgatacctatatcaccttgattagaataaacactgcgtaaatatgttcaaagttgttattatgcttatcattagttcacaaccaagccaacaactccctctcggaggtctcggaaatacggcttttgttaattaaacgaaagaatcggctgctactgagtctgctaccctcgcgtcgcgtgcaccaggtgcatatgctgctcttttgtcctgccgcggcagcgcgcgcacggcgactcttatgccaaacccacgcacgcaacgcaagcacatatgcttcgttttgactgctccctgctcaacaccacacacgctctcgctcgcatataggcaggcaatacgtagctacaccgtgcgcgcgcgcgcacacgtacacgcacaccaccaccggccggcgtcgagcgctgtttgcgctgctcgcgcgtccgtacatggcggggctgcagcgatcgagcgagacgttccggcggtcggggtcgtcggggatggtgtgggaggacaagctgcagcagtcaggggagctcgggggcaaggccgaggcgccggctccggccgcgcgggcggcggcgcagcggagcggctcgagcggccacggcgggtacaaggcggggcacgtgcagccggcgctggacccgccctccccgcgcgtcgccgcctgcggcttctgcaacctcttcggcaaggacaagcatcatcaggcgcgcccgcgcggcggcgccagcgccaagagccggcgccgctgagccaggccgtccctgccatgtttgtttgttgagatgctttgttagctccgggctagttgcttcgtgcaaagaaaggttagaaatatatcgccatgccgccatgcgcatgatcaaaaagtacagatacttaagcgtgtttctccgtttcttgtacacacggtcacaatgtgcagtcctctttgatctcttgctctctctcatgaatcatgatctgtgacacttcaatactttcatcaacgttcttcatgtctcagccttttctttcggttattatttcgatttctaccttgtagggcttcaaattcgcagttttcttaaggaatatcgtatctatggacctgtttggcatagctccagctccagctccacctctcctggagctggagctcagctaaacagttttcagctccaccaaaactgggagtggagttgggtggagctctctcacaaaatgtactaaagttgtgaagctgggtttaggcagctccataactccactctagactcaactcctggagttatatttaggagttggagctgtaccaaacatgccctatgtttgcaatttcgattcttttccggttgcatttgagtcaaggggctttttactatttgccacttttagatttggcaaataattatttgccacccctatctcaatgacatatgggtccacatgtgtctatgacatgtgggtccagtggtaaaaagttaattgccacatctaaatgtggcaaatggttaaatatctcttgagttaaacggggctaatcataaatcgtattactagcagtccgtataattaactccgttctgggactaaattggaagcgtgaacccggcacgcatcctgtctctttcgtcctctgctcgttttttctcgcttcgtacgtatgcgacgaatcagcgcccaccttcccctgatcgtgcgtactgtagtagtagtaataccggagaactcactccgttccacaatgtaaatcattctagtatttctcacttccgttccacaatgtaaatcattctaatatttctcacattcatattgatattaataaatctagacatatatatttatttagattcattaatatctatatgaatgtagaaaatgctagaatgatttatatcatggaacggaggaagtagtaattagtagtagtaacaatcagtagttgcttcttctccggccttattttacggggtctgacctcattcgtcccgttcagacttcgcaattgccacttgaccctactaaacaaaaactgtcacgcgttcaaactgcagcacgtatggaacttgcctaggaaaaatacgtagatgcatacgaaatgtcgtttgggaatacttgcagggataaatataatcactggtcatacgtcgggctagtaatttcttccacacgaaagactgcatttattaaccgtagcacttacgtatatttcatttgaccaattgacctcgtgctccagattacattgatctaccttgaggtctcgcttcctagatgaatatacttcattttgttgctcttgcaataaatcgtacagtggaaaacgcaagtttgacaaaatgatgtcatctaaaaatacttgtagcacgctggtgcaataaaaccgcatatatccacttgtgcaaaactaaaggcccttcaacagtacgtttctgagttacattctgaagttaacaaaacaacctggtaaaaatgttaaaagagtccgaagcgttggccacttgtacacagatgctgggcaattctgaacagctcccagttctgggatgaaatatcagaactgtgtaatatcagctctacttttaagtcatctatccccctttatctcagatgtaaaactcaaaagatcttttgttgctacagctctggaaaaacataacaaggagggcaaaggtgctggttataagttggaaaataaccgatttctgtagtgttagaaagtgattacttttaccttcgagcaatggcaatgccttctttatctacaaaaccaaccaagagtcctctatcttgacgatcaacatgttctgaaactactggaagttgatccactccataagaatccatgatcttttcaacagtagttagagatgtctgaggtgtcacaggccacattttacacttaacggctccacaaacataagtttgtacaggttcctgtagcatgaccagaaatgagtaacatacagatagaactacaagacgacaaaaatatatgccagttaaatacagttagcatgttctgaattatgattgcacctcagaaaacaaataagaaaccaactgtatttttctttgaaaatctttaaagcaagcatgaaccacagaaacttcagagatcgagactggccaagggatatagatcccaaggggctagcaaactaaagaatatgttattttgatatgttccaatcaacaacagagaaaacaaatgaagctgggggcagctgatgatctcttattcaggaaagaagaatagaaaagagtgcataatggctgtgtatatccacttgaggatatagaggccagattcttatccatcatctaaaaaaaggaaaagagtgcataaataagacaagggtgcatgtccagttgaagtttggtatacataagtcataacttatgaattaagatcaagcagaatcgcagaaggaaaaatgagggaaaacgacagcaaatcacctcagtctgtaccctggtagttttcgcagttctgcagaaatcctggatatctttgagagttaccaagcctattagagatctgttgctctcaattatcataacaaacggttgcttttccacaagcataagatttagtgcctcaactactggagttgtctttgaaacagaaatatatttagtcttcatagcctctgcaacagtaagattttcctgaaaattctcatgcttggcatcatagacacacagtgaactttcaagcttacataggtcggtaataggcttatctgtatccacagaagctccttgtgtctgggagggcacacttttttcctgtttaaaattacttgatttcacctctgaggaatccggcttactcctattgctcctagagaacctctggggagaagcaatccaagatgatactccaacagcaccaagcaaaggtaaaactatacgatagtcctgagtaagctcaaacagtaggaggacagatgtaagaggcaccttgcatacaccagcaagcgtggctgccatacctacctgcaaagatagaacaaaaggaagcaaacatgcaaatcagttttctttgcttgatattttcgatcaatctaaaagaaaatacgcaaaagagaaaactattgcttatagacatattaccaggccatatgcttgaggtgacgccacatctaggaacgggatttggaacagtgaatccgggccagtaaatgtaaacctcatgacctttccatacgccatgcctgtagctgcaccaataaaaagggatggtgcataatagcctccaaccaatccaaaagccctgcacaaagatgtcgccaatacttttactccaatgagctgaaccaatacagctgctgagagtccacttgtgaatggtcgtgattccagcaaaatatcaacattttcaaagccccaataaagaacttcagggtatacaagggctagaagaccaacaataaggccacccaaggcaggagatgcagcctttggtaatccggttgccgtttgtaaactttgaactatctccatagaaagtgctgtacacctagatagtgtagtagacaccaacccacagaagatgcccagcaaaagatatagaggaagttctgacatttattaagtcatgtaaatatcctcatactttcaatctctggatcacgagaaaaaatatgtaaaaacaagatgttattaacagacagtaagactaatctacgtccaggagggtttaagaggtgttttcatacttgacaaatcaaccttactaatggcaaaactgaattctttaggaggatgaggtcaacaagagcacaaatgtgtggtttcaaaacaaaagccaaacatcaagattttcatgttcccttcatttggtagtaaattttcccttcttcaactatttcagttgggcacaatatgttttattttagaatcgtaaattaggaagtgctacacaagttacaacgagaacatgtcaaaataccggacaggcagttaaccagtagaaattatgtatagcctaaatgaaagtattgca

SEQ ID NO: 21152 - DNA, 563 bp, Oryza sativa
aattagcaccagcatagcttatggatcggcaatgctacatgtgagaagcgttttagaagggatttggaagcaaattgtagcttaaaactttgctatgtaagttcgttgtccaattgcatcgcatattcacatccaagtcggggaactagacgtgagatgtgtcgtcgtatgggtaccgagaggttgaagaggacgacggagacgccactgaggagcccgacgaggcaggcggcgagcgtgacgaggtcacggccgggcgccgccacctcctcctcccaggccgcctccacccgctcaccccgccggtccccgtcctcctcctcggtcgccgcgccgcatcggatggtccggaggcgcgcgcccccgtccccgccaccgcagcggcgacctgccgggcggcggcgggagagagaaggcggggatggggtcgagacgaggaggacacgcgcgggacagggtgccacggacggcggcgccatgaattgggagaggcatctcatattctcatccctagcatactactgcgagtctgcgagagaggagggagtgccgcgaggccacgg

SEQ ID NO: 21153 - DNA, 705 bp, Oryza sativa
ttcctgcagcccgcatcatacttttatcttatcttgaatccttgcccttgcctctgtattatctgattcttcctcaatctctactgaagctacagatgccagtgcaaactgaccaacataatcttcaaaatagtcgctcccaaaaagcattccaaagacagcagttggatcaatcatgttatccctaaaaaagccattttaaaagttcaatagctttatgttgataataactaatacaatgtacatgcagcatgcagctaaaacttcaaatcgcttgtgcaattgaattttgttttacaatttggccgatccaattctatagaaacaaagaatttggagcttaatttctatctaggttgatagaatagtgacagaaatattcaagacttactgtggaaggccttcttttccatgcttgtcataagaatcctttcttacaggatcactgagtatttgataggcctcacccagttccttgcagaagtaaccaattttagttagtaatcctcctataaaggtagtgggtgaattaataaggcctactgatagggatgcaagcgggccgacccatgaacccgcttataggcaaaattagtgagcagtggcggagccaggataaatatagtgggggctccttagtcttttgagccttataacaatctcagacaaagtttattttagcccccttgcaatagatatatggat

SEQ ID NO: 21154 - DNA, 12036 bp, Oryza sativa
  unsure (1)..(12036): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaggcaaggttgttttgcaaatcttttgttttggaaatcattttgaaatcactaagtgatttatttctttctaagtttgggccaaaaagagatttgtgtctcgattcgactttaagagatgtttttcaacagctcatttggtaatgtaccgacctcccggttcagatcattacttctcggctcccagagccatttcacttgattaatcggctcccaaagccttttcattttctcggactcccagagtccagctgcccagcagcacaacaatccgcttccactcaggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggcacggctgttcgaacagttagttaacctctgcagaggaggtacactttacccacacgacattactaacctggatcacccagccggagaccctaaggccgagataacgggccggccagcctaaggagacacggcccattagggcgcgcgggaggcgaggagagagggaaccgatggaccgggctcacctcgcgtggtcccgagtgggacccgcttgttagcggctcggctcaccgtgagcggggcgcacgcggagcgcgctagggtttgggagggggagtcgcagcgcacgtgcggtttgcggtggacgcggatgcggcgggcccacgagcagcctcatggctcgcggtggaccgcgcgcgcgcgagcgggggtgcaggggagcgttggaccagggtcagccttgaaccggtcgcagccgagatggcgccgacgtggcgccttcgtggcagccacgcgggccagcgggaggaggaagaaggggaaggccgagatggacggcggacggcggccgagttcaccggagctcgacaagacgactatggtcaagggggagcacaccggattggcgagcggcacaagagaggacgagccaatggctcggatcgcgccgggagaggtcaagggcggtggattgcgacggcggcggctggcggcgtgcaaaaggggaaaaactggcggggcggcgagggttcgattcaaggcgtcgggagcatctccgttgttcggggaactcattctcggggtcggatgggacggaggggcctcgagggaggccgacgagcggcggctccccggaacgggtggcaatggtggcgaggccatgccgggcggcggcggggcttcgtctacgcgcgttcaggagggctaccgagctaccacgcgagctaaaagagggagagggcaagcgagaagggagaacggagggaggcactaccgagccgagacgggcgctgtgacgagcgcccgacggcgcggggcatgatcgctacggcctcgggccggggaagaggaagatgagggtgcccggagtccgcgttagctcctcgcgcgcacgccggcttcaccagcacacacggcggcggagggaggcaaggacagcggcagcaaggcggcgagggtggcaagaacagagagagagagcaggcgagcggcttggctgtggttttataggcgtggggtgtggagcttcgaggggaaggaaccgagcacgggcagtcaaggggagctcggttgggtcaaggtgggggcgacagtggaggtgacaatggcgctggtcagggaaaaagaagaaaaggggagagaaagggagctctgcccatgccattttgggagaaaggaggagggagagagcgcgagctctggctccgcgttttggaagcatgcggcatgggggcgtcgggactgggcgatgacagcggcgatgactgcaaaaaagcgagcggggttcggcggctgcacggcgtaggcgtggcagggctgacgcggcggcgactgggcggcagcgcgggcacgggcggcgaccgggcgacggttgccaccagggcgcgcgcgcgcgggggaaacggcggccgaccgaaaattgaatggcggagagcgggggatttgacgccggtggaggagctcgacgagagagagagagagaaacagagagggagagagagaaagaacgagagggcgagagctctctctctctcggctcggctcagctcggcgcgtgcaatgcacgtgcgaggctgagggaggagatgggccaagggaggaagaatcggcccaacgaccaagagggagtcaaaatagacttctgcttagaatttgaattggagagaattgcagcttggatttgaatctaaatttgatacttgtgcacaagggttcaaggagatgaggaaggaaacaaagcgggagtttgatacttttgggaacaattatttggagaggattcaaaggaggggattgactttaggaatttgatttcggagactcgaatcggaattggaaacttgaggtgggggattttgatgaggcgatttttgaattcgacgagagggatcaaggagatttatatcgagatccacggcacgacttagactcagcactcaaagaatgaaattttcgcatataggattttgccgaaatagtttttaacgcctcacgaaatgcggagcgttacacttgcccgcgagggtaatttccataatctcttgataattaccttatcgtatacggaaacatatcatacatacgaaaacatgccgtatccacatattccataagtcataggatatgagatatgccttatccgtaaccatgacagtagccccccgacttcaactcaaatgagtactcgttgtcatccgagacttcacagtcaacgttgtcatgctcactaggtcgttctcgatgaaaatcgagaaggacatggagtatgcggcatcattgaaagaaaatttattctaacccacagcacactgcatatctctagatacttctcttgatttattttgttttacagagcctagcaattttttacacttattaatttccaattatttctcaaacattgttgtgccacgtggaccaatcaacaataggcaaaactgccggcttgagaaggattgattgatattgtttaagttatcataaacaacatcaatttaatggtttatagctttttttcaatgatcgatcaaatatgatgattatataaacttatattatttagttatcttatacgctatttctactattatcataccaagctcccgtaatattgtgcgggatttcatgtagtttcgttaagaatgtgcccttgtcaagtaacatggcattgctagtattttgtgcatatcttgtgccgttcttgtaagggacacaaatgcaatatgttggaggaaataatcaagacttgaatcctgacaagttcttttagggggagaatcttgacaagttggaccatttgaattcatgcttctatgattttctaaacaactattgcccactccaatcaggagggcaaataatatattggtagggtagatctccatattcgatctgctgatttaaataaacttgagtcaatttccggcaaatataaagcccgtaagccagctatgttcttagggttctgtttttttacaaaagttcaggtatgatagctggccacgtccaactataaacagggattatctatagagctcaaaataaaatcccatccaatcacttttattctctctcaattttattattggttgctacacagagctggtttcttcgtaagaaatgatttcttcatcttttttttcatctcttctcattaactattttatcgcctctttttacttatgtgactgttttttttttaaatacgcgagagacgcatctttatattaagaaggaataaaagtatttacagagcgggccgaaaaatcaaaaacacgaaggggacaagatacaggagggggaggaggaagaaaataaaagtctaatctcccaacgaatgtgacgaacttccatccgacataggtgactgtatatttaacggtatgtaagctaggtgtgagaaagagggtttggactgctctaatgcctttgctctaatcctgagcactagctgttttgcatgctgcgcgcgcatgtggacggatccattatctgctgtctggtaattaagcagtactggtgacttaggagtagatgccaggttatccaacacgtgagctcgtgctcctcactacggacatactgatcagaaggttgaccttggcgtctataaattgcgggattatgtgaacagagtagacacgaagcagatcaaccaatcatcagaatgaggggacggtcccgagtttttctcctcgccttggtgctcttcctcgcgctgcaggcgccggcgtccgcaggcacaaaggcaatgctctttcttcacttctctctcttaccctctcgatctattcatcatacatgccctcaatattttttaaaaatatatccgccaaagtcattttgttctttaattgcatgtcctctcgtttctcttgtatgtcattcgaatatttatgaaaaatatttttttaaaaaaatgtatttaatggattttttaatcatacatggagattatatttttaaggggatgctcttttacttcttgccactcaaatagttttacaaaaaaaaatggcaacatatataacatattcatatgtgatttaaatttgatcaattataaatcaacaactaaattcaatgagaaaatcaaactaaactgtaacgtgtactacttaccgtcgtatttatttatttatttctaatttagagttacaaagagtgatatatcacatattaatttgtgttgttaaatttatttaatttttataactatttcgatgatatatgacagaaaacagggtatatattccttaaaactgcaaaaatgtttttccatcgtatattcgtcacgtacaatacaagcaagtcaacaaatataggactgcgattaaatgttctattgacgatctctaatccatgaagcggggtactttcgtgcatgcagacttatgtgatcgtctttgatggcttaccagcttctccttctggtttgcttgctacagtcgtcaccaggtcagaaaatactagtgtggccgttatggatgtcggtgctaccgtactaggctactagctatgtactcctacatcactaatgtgttcattttgtgccgtaaaaataaacagctttcagttactgtacgtcttgagccccatccaagtgatcgtggtgcagatcgatgagagtttcgtaggagtcatcaagcgtacgccacatatatcatcatgttatagtgtgttccccccttggagtttgcagttcatacctgtcactgacgagcgcgttctttttttcgcgtactttggactcagagctgcccggcgtgctggccgtgatccccgacgtcctgcacaaggtccacacgacgcgttcctgggatttcctcgagctagagcgaaatggcgcggcgaccggtgcgtggaaggacgccgcgaagtacggggtggacgctatcatcggcaacgtcgacacaggtaccactacttgaaaaatgatattcgagacgatcaaaatggatttcacgagcgactggtacaaccgctagcaaccaaaaactaatgaaaatcgaattttttaaattaatttttcaatggatttttttttaaaaaaaacgcactaagagcacccacaatagtaaagtaaggtgctctctataaaaatgtacatctcagcaatagactagattgatagtaaaccacctcaatagtatgtctacatgggtatctgtagctctctcatccattgcctcgtttttctctataaactatctccagtttagtagatagatttactctctctctcttcatttaatctgttccaagtagaaaaatatgctgacatggatctcttgtagagagtctatagataaccattgcgggtgccctagaatatgaggaagtgaaattgagaaacacagccccaaataatgaacacagaacgatcggagcgaatcagttattccgtgcatcggtacatgcttcccgatgagatacatgcgcgagataacttaaaataatcaccccaagatgacatgaggttaacagaatcaaatcccaagaatacgggaactaaaaagtcaattcaaacctcgcaaaatggtagcgtcgccatgggcgcagtgcgcctgtgcctctgttggattacgggatccctggtggcctggttcagatgtgctgtcgtcctatctgctgtactgaagtgctgtgcagttagccatagccggaacctgttctgattcctgaactcctgattcttattttctgtgcgtgcacgtactccctacaaatgaaggtgtatggccggaatccgcgagcttcaaagacgacggctattcagtcccgtcgaggtggcgcggcaagtgcatcactggcaacgacacgaccttcaaatgcaacaagtaactccactgtccacagctgctcatcaagctgcatgcaactaatgcagtaaattttctggcgagaaactaacatgtcgtacatgcagcaagctgatcggcgcggggttcttcaacctcggcttcctagcgtcgggcttgctgcaggggaagccgccaagccaggctgcagagctgtacacgccacgggactacatcgggcacggcacgcacacgctgtccaccgccggcggcgggttcgtgccggacgccagcgtgttcggccatgggaagggcacggccaagggcggctcgccgctggcgcgggtcgccgcctacaaggcgtgctacgccgagggctgctccagctcggacatcctcgcggccatggtcacggcggtggaagacggcgtgaacgtgctctcgctctccgtcggcgggccggcggacgactacctgtcggacccgatcgccatcggcgcgttctacgccgtccagaagggcgtcatcgtcgtctgctccgccagcaactccggcccgcagccgggctcggtcaccaacgtggcaccatggatacttacggtcggcgcgagcaccatggacagggacttcccggcttatgtcaccttcggcggcgtcacgagcagcatgaccatcaaggtttgacaatacgaccgaccaaatcacactgtagtttgcgcacatgagaatacggcgtacttttgctcatgccattgggatttgggcaatttgcaggggcaaagtctgtcaaacagcactctgcctcaagggcaacggtacgcgatgatcaacgcgaagaacgccaacgccgcaaacgtaccgagcgagaactcgtaagaaatcaaaaactcagatatcatctcgacttgcaccgatcgaatcgaaccgacgtcgatttgcttgcactgctgcgtgcgtgcaggacgttgtgcttccctggctccctggacagcgacaaggtgcgcggcaagatagttgtctgcaccagaggggtgaacgccagagttgagaaggggctggtggtgaagcaggccggcggcgttggcatggtgctctgcaactacgccggcaacggggaggatgtcatcgcggacccgcacctcatcgcggcggctcacgtctcctactcccagtgcatcaacctctttaactacctcgggtcaacagagtaagcatcgctcatcagcacatagtactacttttcaggtgcaacacatcacagcatggttatatactatactaattaacgttactgctctggttcatgtagcaacccggtcggttacatcactgcatcggatgccaggcttggcgtaaagccagcgcctgtgatggcagccttctcttcccgtgggccaaacccgataactccccagattctcaaggttggcacattgctcatcgtattcctacagatactcgagagagaaagcttgccccttccaaataggaccagcagctgtgtgtgtatgctaacctggtggtgattttgcagcctgacatcaccgcgccaggagtcagcgtcatcgcggcttacagcgaggcggtttcgccgacggaactctctttcgacgaccgccgtgtcccctacaacataatgtccggcacctccatgtcgtgccctcacgtgtcgggcatcgtcggcctgatcaagaccaagtaccccgactggacccccgcgatgatcaagtcggcgatcatgaccacaggtgagcgagaaatgcagatcgcgatcaatcgagccagcgcaaacatcacataaactctgatcgatctcacgtccttaatatgcctgtgcattgcagcgatcaccggggacaacgacagcggcaagatccgggacgagaccggcgcggccgcgacgccgttcgcctacgggtcggggcacgtgaggtccgtgcaggcgctggacccgggcctcgtgtacgacaccacgtcggccgactacgccgacttcctctgcgccctgaggcccacccagaaccctctcccgctcccggtgttcggcgacgacggcaagccgcgcgcgtgcagccagggcgcgcagtacggccgccccgaggacctcaactacccgtccatcgccgtgccgtgcctgtccggctccgcgacggtgcggcgccgggtgaagaacgtcggcgcggcgccgtgccggtacgcggtcagcgtcaccgaggcgctggcgggggtgaaggtcacggtgtatccgcccgagctcagcttcgagtcctacggggaggagagggagttcacggtgaggctggaggtgcaagacgccgcggcggccgccaactacgtgttcggaagcatcgagtggtcggaggagtcggagtcggacccggaccggaagcatcgcgtgcggagccccatcgttgccaagacgacctgcgggtagcacggacggggtcgattcttttcgagtcagaactggaaactgaataactgttggtgttgtcacgccaaggtccacaagtcgttagggctaactgcctaaatcctaatggcaggagacttggttagagaggagaggatcgatttcgttttatctggcagatagatgtgagctatcgaatccagatatttgttctgattccgacggtcaagttgtttttgtgctactcgaatagtgtaatgcatcaatcttcatcttgttacgataattatatacttctcgtcgggccggcgaagcgccggccgaaatatataattacgataattatatacttgttcgttcttttctgccagagatgtgtcgctacatttctccatggaaatcagtcaaactttgaactgtataatttatactgtgttttatgctgtagtgttgcttggtttctcttttttgcctcttcacggaggagtgtaatttattttcctaccataaactgtgacgaacacatgcaacccctgaagctagtgatacatgctgacgtcttatttgatatgccataaatattaaagtgtaaatgagaaatttaaaggtgtaagatttgaataatttaaaatcgactgctttttagtacaaatgggctgtttggttaggtgccacatattgccacacaacatgttaggcatgccacagattgttagcttagcgtttggttacttgcttcagttgtggcaagccacactttcttgttccatggatatacatgtcatatacttattttctagccaaacattgtcacacttgtggctaacaaattgttggccacactatatttgccgtgccatacctatgataaattaagttgtggcaatgttaggcaacaaccaaacagacccaaaaattgtagcgctatgatatagtactcccatactttcttctagtttcggctgggactatttggtgggattcgtggcccaatctcgcgcgatggaaggattgtttttttttttttttgaacttgatggaaggattgttaggagttaagaagaaatggaaactatggaacgattggaaaaggaaacgatggaacgattggcccagactcccattcgaaagctggcaactgggccggcctaaatcacggaaaaccaattgggcctccgaacatacaacaatgggcggaaggcggcttgagggctgaggcgacatagggcggaggaggacagcacgcgctccgctcgcccgccgccccacgccccccgcacgccgcggcccttcgctcggctgccggttgctgccgcgcccctccgctcgtccgctccactccgcgtcgcagcaccggggtgggagccggcgcggcgagtccggccggcctcggggaagcgctgccgcgctcttcccgactccggcgactgcaacggctgctccacctccgcctaacgtttcccatcgtcagcctcctccctcttatactcctgcagttttagctctccgccactattcattcctttcctttcctagggcttagctgaaatttctccgtagcgaagaggaattgggtggtgggggattaaacccgatccatctgcagtgaggattttcccccatgtgtcaaacaagcatgctgtggacttacatataggatgatagaacttagacgaggtgcaggtgcagtcagtggctcaactgaacccccttgtcccgcgttaatttccgcctggttttgttgtgagtgccatggcttcgcattaccaggctgccaccttgatcgcgtcgccgtcgtacccaaatgcaatcgcttggtcgactgagaacctggtggctgttgcctctggtcaccttatcactatcctggtatgtgtggtttcattgcattagtgtattcgaaccatgttgtcctcctcaggagttatgactgttcatcttgtgtttttgattctagaacccatctgcactggaggggcctcgggaactggttgttcttcgtcctagcgacccatttcccataggagtggttaacagagaaggtacggtttccagtgaaacacatgaatttgtgctgcattccttttgcttttcacgtgttatcagtttagacggataatatgattgccgaagtggagtggaagagatgctcggtgttaagtttctttatgttagcactgcatagtaagaaaaaatgattgggacagcttgagtttagcagttactttagagttctgtcaacaacttaaatgttatgggtggctgttgtgcttgagatcacggtggacaactccaaatgatgataaatatcatcaatatgtacactttgctttctttaaaaattattaagcaatgccttaggctaattgcatgtgaagatgcaattcaacaatatgcatccagaagttacgctttcttaaacatcaattcagcagtgtggatttgagttcctacaaaaataaaattgtaattttaatatgtaattatcttgattacatgaaatttttggcagtcaacttctcttgtgacaaactgaaaagtaacactggacatcgatagaaggtgcgcaccaggaatcagtttttattgcttattttgcagatctctttgaaccatgtataatgcccacttccttagcacgtgaaactgaattatgcgctcgatctatttcatggtctcaacaagggttttctcctaactccgggtatgtctttttttaagtcgtttcatcacatcatttttgtctctctctagatttattcttcagcactactaggttcatttgcttatctggcctctgtacttttttttccctatatggattcagttgtctgttggctgtttgtactgttgatggtcatgtaaagctttatcggtcaccattttgtgaattctgtgatgaatgggttgaggtaagcatgttcacctaatgtattattaatttagtt

SEQ ID NO: 21155 - DNA, 16993 bp, Oryza sativa
aaataagcttaacaatcactgcaccacctagtagacattcaaccgtttgttcagtactacttctgacttcgattacagacaaaagaagatattctttttggcagttttgtttgtatttctctgtgtttttcttgctgtttgtcatgtcccttccttttccttttgccattagataaaatatttattttcattcaccacttgtaatcatttgaacctatcagttacatatgcttaggatatctcagggtgtatgtgttctttagttttctcatattctgcctgtcaacttaaatctattggtctaggttgcagatatatctcgattgctgtttaagttttacaaaggtatagaatttggggaaaatgatggtcctagttcacttcctcaggtattctcccatccatccactctatcaccagtgtctccctttcattggttgcctcagaaaattttttttttgtgaggcagaaatatatgttattgagttaacttacagaaagtttgtcttctgtgtcaggaaaaagaaaatactgaacaaaaccagcaagtcatgtgtattggtaaactgcaagagcctcttctgagcatgggtacagaacggagaaaaaggaaaccagcaaggtgagtcacactcttctgtttgctggccatcaaagtttaagataacaagatggtccaaaggggttagttcaagaaataagatgatgggttctatgcttacaatttgatgtatgataatgagtgcctagagtcgttcaaaaaaagataatgagtgcctagaagtataaaatgtatttaccagagaaagatctatgcttaacactggcagactggcctagtgcacttacttggtttctctggtggtacattgtcaatgggtaaatattctgcatgtgctatttgaatcaggtttaattttagccagggaaaattgaagataatctccaacaaactgaaaatggcaatgatagcaactcagtttcccctttcctgacagtctttgacttagacgagcagacaaatgtgtcaaggattgcaaaaaggccattttattttctatcattaggtggcgagaggctgcttataatgtggttgtataaagtaattcttttttcgtttggcacgacacacttgccatgtgtggttttggaataagattgataatttagaggctcttgtttgctaatttttacagttgaagtactgaattactgacgattactggtagaaaaactgtagtaagtatttgctatgggttgttgctaagcttattataggatgccaattgttcatatgtcaacctatccgccactgattaatgccttccttttcgcactaactttattttgcaagaagctatttttggcctataatcgtatgttaggtctgaattattttgtttcattttttagatttgaaggttttgtttatcatgaggataatggtggcgtagatgctccaatggatgcggactttttattggatccaatctctaatttaaagaaaaaaacattgaagaagcgcagtgtagatgctccaaaggatgtggactttatatcggatccatctaatttaaagaaaaaaacatcggagaaggacgatgtagatgatccaaaggatgcagacttttcattggatccaatctctaatttaaagaaaaatacactgaagaaggtaggatttacatgttcacatttaggttaaagtccccagtgtatgcccattagttgttaacattaaaagctaaaccttgtttcataactaaggagagaactatttgtgctgttaaatcacactcgcacatagcctattttatatgatttttttttctttggcatcctgtatcttttacctggttgtgattgtaggtcacgagacctggacttgacgatgctgtcagaaatggtcagggcaacactcaaaatattcagacaccatcatactgcaatggagaagacaaatctctcccacttattacggcaaaacagtattcatgtcgtgaagcacttttgtcttctctcgtagttgcatggtctccagttctaccatcacctgacagaagttcttatttcacgggacattggtgcattcttgctgttggttgcaagtctgggagtgtttccttttggaaaatacacaaacctgaatactacacaatagacatcggcatggttactagagatccaatgctgatcggggttgttcaagctcatttatcatgggtcactgccataagttgggaacttttttcctcaggctcttcaaaacctttgttgcttttggcaactggatgctcagatggaaggtcagtacaacttccgtcaccactgtaaaggattttacatttttgtcatactatgtgacagctaactcttgaatttgctcttccatggttccatctctctctctttctctctctctctcgacaatttaagcataaaccactaaaattgtgatgcttccttaatcctcccaaatacctgttttactcaaaacctttcaaattcgttttctggggttttttcagctcaaagatatggctgggtgatattgaagggttaaatcaatgtacatgcgcaaaagaagtgcccttgacattagtggctgaggtacataattaccattaccctgtgttgtctattgatatacatatttgattcgatatatgactaatatccaatattctattaataaaactagctgggtaacccgcgcaattgcgcaggtatctagttgtcttaagattttgaaaaccaaaccttattgtccccttgtttctatattatttttatagttttttaaaatcacaccagttgccacccttacttgtgtcatccccttctttatttgcttgctcgatctaccactatttctattcattctctcagaacctttaaaaattaagccttataatttctagagtttattgtctcattggttccatttttataattttagaagtcccgttaaatgctgccattatactattctgcggcccgtccgttgcctccgcttttattgtcattgggatttttaaaaatcaaacataattattgtttgggtttattttttttactttatagaagtccagccaaaccgccagcggctatgtcacagtactcctctacggctcgcccgctgcctctcctctttattgtgattgagattttaaatcgaacattatcatcattgttttttttttactttttagaagttccgaacctactttttagagtttattatctcgttgggttttatttttataatttttaaagtcccgtcaaatactgacactatactcctccgcagcctgtccgctgctttctctctttattgtcacattgggatattaaaaatagaacataattatcatttggattcttttacattctagaaattctgtcaaaccataagtgactttgccactataatactttcctttacggctcgcctacagcctcccctctttattgtcgttaagattttaaaatcaaacatggttatcattgggtttattttttaccttttagaagtcccgccaacagtcgtgatcatgttgtttaacggtatgtccgtcatctctccttttaatattcagtaggattctatttggggttttattaatagtttttagatgtcccattaaccgtcaccactctacttctttacaaacatgttacttctcccatatttattgacatttgtcatctgtgttctagattttatttttttaaaaaaattccatatttttcattccgatattttttatttacaacattatactcctatttgaactcttataattatttttctattttcagaatttattttatttgttatttggaattttaattaatcttgtcatgtgttctagatgtctcttcttccaatagtatttattttttattacgaattttagttatttataaattgtatttctagttgaattcttatttttcgttttgtcatttcagaaattattttttattttgaattttaatttaatcttgcattgtgatatatatggactattctccgattgatatggaaatttctaatccccacaacgtttgtctgtgttaattaaaccgacggaccatgataaaaaacgaaatccttgcgtatttttttattaggtatagatataggttttagaacggaacaacatgtgtccaaagtgaggactaatagtagtactcggattgtttgctttgctgtatgcatatactatcgtttatgtttttctctgcagcatgcaaactctctctgttggtatgtgtttctgacacccagtgtggaaagtgctacttctaaatagagttatgccagagtttagttggcttaagaataaacactaataagagtctgattattagaggtgactgcttatttttctttgatatttagctgggaattaggcagtcatccatgggaatcggacacaaattcgtacttatgtagctaaagctagttttctatttttgtgtttgtttccaacacttacatatggtaatatgcaaattatatcagattccaaataacaaaacaaatcaagtcaaacttacatatggactgtcattaaatctctaccattaaaatctagtcatatcacaatacaacggttaatatttttctctttttctccgattaatgtgggaatttctagcccccacagcgaacgtgatgcctcctttcaaagctatcttaataatataatagattgaaatgcccatcttgcactttctagttccagctaatgcctttctgttattaaatatactgctccaaacgttgtactgtcaggtcactactgattcattagcaccagtctcgtcaatctcattatctgcaccagctcagcatcaagactcagttaatctggcaattggaagagcatctgggtcactagaagcatggtcgtggaacatatctggtaacaaaattcagaagattcatgcatgtgacgctcatgatcaagtggtaaaatttcattttaccttagtatgtttacatcttgataaaagaaaaaaaatatctaacatcaccataggtgacaggtctgtcatggggttttcatgggcattgtttatacagctgcagtcaggtgtgtttatgtcctcgttgcactttgtaattaattctgattttgtttttaaataaaaccaaagttccgttgacagtatgttaacttttctattaaagtgtaaactattttctatgttctcagtgtattcacgatctctgtctttgcaatattactagctgctgattacaaaacgtgcataaataactgatggcagattgacgggagacattgatttctgtagtattttggagttgtgttagttaagacttggaaagctgaagttttctgaaagttatattttatgttctgctgctggatcataaaatcctatgcactgtgttgacttattttcttgaaccttcaaaaaatcctgcgcactgtgttaacttattttcttgaaccttttgttacttgcttatgcataaagccttgctactttgtcaggataattctgcacattgttggatgttcaacgaaaaacatctagaagaaattcctctgcacacagatggtccggagctgaaagagtccgtagatgtaaaacatatactcaataaccctttatcctgaacatgcaagttttttcttctggttgacatctgaaatgtgcatgcagctcacagaagtatccgatcgatgttatggccttgcactagcacctggagaactaatgattgctgtggtatgctttaggctatctcttatatctgacgcatattgcttaactgtgcaacatttgtacttgagctttcatatataataagctaaaacaatttatgaatgttatctccttcaggtgcgcagcttggactcaaacttgttaaatcagatgtatcaggccaggtaattttgtttgggagttcggtatgggaagtagtgaggtctgcttggatctaattaatgatttcttttatctaacatttagaaaatccactgtcatcacaataattttgtgaataaaaacaacaggacacaaaaggcagtggttgagttcatttggattggtggtcagttccttggtattccattggacaatagcgttatcctcagtcttcagtctgccgccttatctgagactaatttcttgtggtggggatccaacattttttggtcactgaagaaatatgagaattgtgaaacagtgcttgtcttatgggatctcattgctgcactacaagggtttaagaaatctgcacctacctttcttgagacattgatgcataaatgggtgtcaggtttgttttcagatgatccacattgtgcttctatcgacatcccatcacattcaattcacaacatgtccaaagtcagctcgcggaagttgcacttgctgaatatcgtatgtaggaaagtaatgcttagtgatcaaccgcagtattctcctggtgcagaaaaaggtaatgatgtaatggctgatttgtggaacaatcttctggtaagaagtgaaagggagctgcaagagaggcttgtggctttcacttttgctgctgtcctcaaccgaacagcatatttgctcaagggtgcccctgctgaaaacagctggtttcctgttggagttgcccagatggactcttgggcatccatgaacgatggagaagtgagggatgagctcaaatttcttagaacgaggatcaatgatctaggagacaggtaaaccatttttctaacatcatttcacttgtgaaacggcatagagcatatgccacatgatagttcagtagaattgccttgaaatggcttcactgaaagtaaaattggatgttgaacctgttcagtaactgttttgcgccatgcaggatcaactcagtgtgcgagtactcagttgaagaatactgcacctactgcaatgcaccagtccccttcgagtccgcagatgttgccatgtgcagtggtagcaatcctgctactcccccagctgaagctcacaaattgtcaagatgcacagcgtcgatgcggctgtgccctgttcttcaaccaacatggcactgcgcgtgttgcgggaggacggtcgacaagctgctgccggaaatattcttcaccatgcccacatcattttgggatgtcactcatggtaacgaatcgcttgatttatcagcgccggccgtcccattttgccccttctgcggcatactgctgcagaggataaagccggagttccttctctctgtctcaccggtatagaagctagtgacactaggcagcttccagctgtaagttgtaatactgaatacgtcactaatgcactttgaatttgttgttggtggggggctgcttctaaaaacatgtgcttaaaataagcatggctggtttgcgctaggtgtggtggtgccatcataatgtaacaacccgtgtaacatgtgacatctgtaactcttggcaataaagcgggcaatatatactacttgatgtgagaatatgagatacagggtgtagagcataatgtggcaggccagatgttgtttgctgcatgtacacatgacccacaccagggaggctggaaagagcaaacagacagacaccgatgcttcccttgcaggttgcagccaacgggagcagcctcgaaagcgaagcacttgcgagagattgtggaggacgaggcagtgggtggggtccgacccaggaacctttcccggatttgaccacatgatcgatcgcatcaactgactcccatcatctccgggctcaactcctccctcctggccaggtcagatgatgaccactctcctcggcatttccgattcttgactggcttgttctctctctctcccagtaaccgatcttctcgtcgggctccgacgatcagttgcagcacgatccaggaagaggcggcgtaagccatggtggtggacagcgcgtactacgacgtcttgggggtcagcacagacgcctccgcggcagagatcaagaaggcgtattacctcaaggtgcgtggttcttggcccgagatcgagaacgctggcatatttgtttttcttgtgtttttttttctttcgtgcaatgtttgttgttgggttcatggtttcagctgttcttgcaatgtttgggtttctgtaggccaagttggtgcaccctgacaagaatcccaataaccctgatgcggagcggaggttcaaggtagattttcgcttctgttttgcgctgtgtgcgtcacagttcgatgttctaggaaaggaaacagtataggtaatggctttagacgataagacgactgaaccaaagagatggtggtagctctggtcacttctgttctcttgtgaacttttctgttctaccttttttttttcgagggaaacctccgaaaagggcaggcatgagctcatgcgattcactattagaagagagttatccagtttataaacaaaaattggacacaaaaatcttacaacggttaattagggaaaccggtgaaaactcttaatgccttatgttggtgcattcttaatgtcagtaggtagggatgcaaaccggccaacccgtgaacctactaatatgttaaataaaaggtaatccgtgggtattcatgtcatggctcggcttgccgcgtcgtaaagatataagtggatcaatccataaagctatttataggtcaaattagtaggtaacccgcgggttactcactaacagtggcggaggcagtgtgggggctggggttctttagaccccccctaaaatttaaatccatatatctattgcaagggggctaaaataaactttgtctgagattgttataaggctcaaaagactaaggagcccccactatattttatcctggctccgccactgctcactaattttgcctataagcgggttcatgggtcggcccgcttgcatccctatcagtaggccttattaattcacccactacctttataggaggattactaactaaaattggttacttctgcaaggaactgggtgaggcctatcaaatactcagtgatcctgtaagaaaggattcttatgacaagcatggaaaagaaggccttccacagtaagtcttgaatatttctgtcactattctatcaacctagatagaaattaagctccaaattctttgtttctatagaattggatcggccaaattgtaaaacaaaattcaattgcacaagcgatttgaagttttagctgcatgctgcatgtacattgtattagttattatcaacataaagctattgaacttttaaaatggcttttttagggataacatgattgatccaactgctgtctttggaatgctttttgggagcgactattttgaagattatgttggtcagtttgcactggcatctgtagcttcagtagagattgaggaagaatcagataatacagaggaaagggcaaggattcaagataagataaaagtatgatgttccagtaatgctctgtaaatgcacacaagatgttatctagtagtgctccagcctttttagtatccatctcctcaaggttggcagttcataattcatgcttaggccttaataatatctctggattacaggagttgcaaaccgaaagagagcaaaagcttgttcaaagccttaaggatcgacttcaaccatatgttgatggaatgcaggatgaatttggtgattgggcaggtgctgaagctcagcgtctttctcaagcgggtattgccctccatcttcatactcatttgcactgttgtattttttgataagcatggacatttcattcaacttttgctgctgtatgtacagtatatacactcataccactgaattttctattatgccttatactgaattgctgattgcatttgttttaattccttggtgtctgttatgaattgatttttcagctttcggtgaggctatgctccacactattggctacatttatgctcgtcaagcagcaagagagcttggaaaaagcaaaatgtatatgggtgtgccgttcatagctgaatgggtaagagataagggccaccacgtaaagtcacaggttaatgcggccgcaggtacatcataggatgctgtactaccttttcctacatcacctataatacttcttaatgagtctgaccctcggtgttctacatccctcttttgttaaagatgagtctgatcttttactgtaggtgcaatttctctgatacagctacaagaaggtataaaaaagattgagggcgacgacaaggaaggccagcttatgaagagtattgaggagaaaaaagacgcaatgttgaattctctgtggaaaatcaatgtagtcgatattgaatcaacgctttctcgtgtttgccaagcagtaagcattgtccacctcagtttttacctcatgttttgcagtactgtaccgatatgcttgaattttgagatatcttagaaataacatacaaatatggatgatcgtggcaaccattttgacttcaggttttgagggagaatactgtttccaaagatgttctgaaggtgcgagctagaggactgaaaaagctggggacaatattccaagtaagttttgcttcatctttctatcttctccagctactatggtaggtcaaaggaggattgctctaatcaccaggacttgataccgatcattctggcaaatcttgtttgcaaaccgtaaaacattgaagtttgtgttgaaactaatttggaacaaatatgtttccgtggcctgtttctgtggagaaattttgtaaagccgttgtaaatcgtcacagaggtggcaatttatataggaaactagttcagagaactactcggagtttttgtttggagggtgagagatgatgattggcatatgtaacatgtcggaggttacgaactatatgaatggtttcatacgcgtcttctctcttttcttgatgtccttttctattttgcttacctttcagactcagtgcgcgttctgctttcatgtagtcttttgtatcttcatgtcaagcactcaagctaattgctaatgctatattgccatgttgatttgaaaaacatcctcgtatttttccattggttaaccaggttgcaaaatcataatgagatttggatcccgttttccatgtgaaaccagggtgcaaaatcgcattgccggcgcgagaacagcctgcgtgttgaggctcgcgatgcagaagcaacaccgtcggattgatcaggactcaggagcagcacggcagcatcgctacaagggacaccactccgccgaggcttcattttgtgattctttttgcttttctgtaggagcatttgatattcgttgcgtccagcattccagcaaagatgttacgatgtggatagtgtgttgcaagaccgatgtttggtccatgtagccacgcaatattcttcgatattttcgagcctttgatgctttagaggtaatttggatagttataatcaggtcttgagatcttcgatggctatctgcccgggcaaagtgtacccttttactgttcacccggaaccttccagagatcaggccgcaacgtggcgcgcccggcgcttacgtgcccttctccggtcacgcgcgccgtccttacgagggcacacgtggcttgcctgcagggctgcagataccgcctgtcgcctcctgtttcctcgtacaaatacgagtccgcttccgcttcatcatcatccaatttcccatcagctcgatcgctcgtatcactcatggctcaaagagggtaaccgagttagaaactgaggaggaagcaactcgacgacaccaaccaatggcggagcacgccacgggagtgtacgggcacccgtacccgcgcgtcgaccagtacgggaaccctgtgccgccggtcgaccagtacggcaaccccgtcccggacgagccggcgccgcgcgacacggccgcggggtacgtggcgccgccggaccccgcggtgtcgactggcgactacggcctcgccggcgcggaggcgccgcacccgcacgagagcgcggtgatgagcggcgcagccgccgctgccgtcgcaccaggaggcgaggcgtacacgcgcgacggcggcggcgtagttcccccggccggcgagaagacgttcgcctacgagggcacggtcagcgccgccggcgtcacgggcgcctccgggcagctccagcccaccaccagggaggaggggcacacgacgctcggcgagacgttgcgccgctccggcaaatccagctccagctccagctcggtaacttctctttctagtcgttgtgttcttgattaattttgtcgatgggctgactgacttgatgagcgcgtgcccagtcgtcggaggatgacgggcaaggtgggcggaggaagaagaagagcatcaaggagaagataaaggagaagcttcccggcagccacaagcaggaggagcagaagcaagctggccacacggctccggcggccgggacggggacggggacggggacgcatgcagcggggaagcacgagaagaagggcatcgtggagaagatcaaggagaagctccccggccacggccaccactgagcgagagctcgcgcgcacgcactttcatcggttgacgttcgtgcaactgtccatgcatgtatgtataataccagtcgtgtttcagttcgttaattttacggtcgatgtgtggtctcggtaaaactaggtggtgtacagtgcgtctatgcatgtacggtgtatccaataatccagagtcagatctcttttaattatcctttataacgagtcacgagtgctttacgtttcgcaccaaaaaattgtcacctggcgaatcgaattcctctgagacaaccgtgcgcataactgatgatggtgtgagacaaaacgaatgtactatatgatacgtttaggcaggaccgccgattgatcggttttggtcgatcccgacgcttcacaccatggacggtcactgcgtcaagtggtcaagccgaaacaggagccgcggcggtggcgcggtgcgacggacgggaggcgaatcaaaacaactactggccgcagccgcagcccgcaagtcggagtcaagacgaactggtgggccgtaaactgaacaaccaaacaaaccgccaggaacgaaacacagagtgcgccaaccacattgcgcgcgcaacaagagactgagcggccccggcccaggagaatttgacacggcattcactcacaacttcacgccttccgctgtttcccagcgttggctttcggtagacaagtagtggctttccgtgatccgcgtcgtccatggcgacctctgtccggtggacggcaacatcgttctcggtcacagggtaagctcatgcagaccactcatggacaggttaatacccggcgtcaggcgtgcaaggaccaaggagtaatggagtatacagcgatgcactgaccgcagtatgcaatgccacaagtgtgtacggtcaaatgtttgtcacggaacgttgtcatgtttttgtgttggtactcactcccgtaaggagtacatgagccggccatgagtgtaggtgggaacacctaatttgcctcgtcttataccgtatttgttttgactgacgtgcgttaggtcgcgagaatctatccctggaaatccgttgtgtggaatttattttagagaagtatctcattctcaatatttgcttggtttacgtagagcatggaggacgcgagtggagcacacggaattaatgtgctgtaaagtatgtgaatcagaagcagcatacagttgagttacacttgatagtaatccctccgtgctcgtactcgtaaaggaagttgttttgaacagcgatacggtctccaaaacatactttgacttcttatttctataaaaatatttatttaaaagtgatatatgtatatttttatgaaaggattttcacgacaaatctattcatataatatttatattttcaaacttaacaactcaagagttattcataatttatattcccaaggtttaacttaaacattgtcctataaatataaatataagaccccctataaagggattgatcgaatcacaattcataaccagagccacattgagagataatccaaagaaaaccaaagcctagttgtcgtattctactcatctagacgtactcgatggattctatttggcatgttagagtagcctacagatcaccggttgtaacatgtgcgatatctttcccagtaatacatataaactagagtagggttattactcatctcaatgacccgaaccagtataaatcattgtcccttgttctcttaatatgatatcgtgtatattctagtaccaacgacccctatactctagtacggataccattgttgtatagcccctcgagataacaaaaaatagtacaaaaatttccacctttcaaccaggagaacatgccactagtttgtcttcgatccgtagcggctatggtgcagacggctaccggaactatggccgatgcaacggcgtgccccggcagccagctacgatcaagccgatagccagggcgcgcggtgcggttgcgcgcgacgtgacgatcaggattgcgaccgacgttgtggccaacgcggtgacacaacagtcaactttacggtccacttggtacccacaacgcgtggtccgattacacttagcatgttggctaggacggcagccggcgctacggccagcgcgtgcagtgcaactactcaacaacgacgggacggttcagcggcagtgcggcaacacagcgactgtcttggcttttggtgtcccggtagcttgtggcctatagcctcatcggccaccacctccataggccgcacccccccccctcccccaccgtcactgtcacctcagccagccgttgcacccaccccactcgtgcctccgccctttgggattgagctgagccaaatagccaagaaacccactttcatgtttggttagaataaaggacaaatttctaccatctaacaatatagattatacgtttctttaggggaaaatacttttttttcataggaatttaacgatcaagtaatgaaaagggtatggaagagattcgaattaaatttaaatttaaggatatatatggaaataagaaaaaacagggatatatggaaaaggaattaggtaaatatacacgcgtatggattttgtagtcgaataccaatccaacgcaaagattcgcgagcgcgcacgtgtttgcctcgtggcggcggaggcaaggatccaatccaagggccaccagcccagagcccagcgccccagatacgtcgccctgctacatagccgccgctgttccggttcaatccccaacagcatcacaccaatcagatcgacaatcgccgccccaccccccggccaccccacagcacggagcccttgccagtgccacctccagtgcagcttctgttcaaggaccatccccgaccacgtcgcggcaacgacaacgccgtacgcgcggcggcctctatcgtccctcccgctgctgcgcgccagggctgcgcttcaatgcgccacaggggcagcatgcatatccgtcggccgccgcgacgccatctttattcccccgttctctcgtcgcgcgcgcgcacttgttcactgtgatacgtcgcaccgtgctgttcactgttcagtcgtcgtgatcaatcaatcgatcggtcgaccccagcaagtggacgctacggtgcacgtagcgcatgcaggcgcgtatacgttatgcgagatctcgccgaactgtgcccccatttatgagtcaggtccactcgctgtctggtccttttttttctgactgctgatcagccggtgcaagacgccaagacggatcagacgtgatcagatcgatcggatgtttgcagggttcgaagctgggccaccagaaaggggggaaaaaatcgaggccgccaacgtgctgcgcacaagaaacggcggataagttttgtaagttttgcctgagccgcatgcaggtaggtgtgcaaaagcttgatcgaaggttcaaatcggatcgaactcattcatagtcataacgagctaaaccatgttagaattatagttcgtgaaattaacgagtcagatcgtgtctagctcacttgtaataaaaaaaacgtaaaatacgtaggtgatactacatacaacttataagatacacgaaatttagtcagtcatctcgtaaaattctcaaacaagttttagtcaaaaaaaaattctcaaacaaatcactcatcttgttttttttttcaaatcacataagcacagtggtggagtcaggataaaattatagcggggctaaactaaagtggaaaataaaaattgaaatatgtctcatataaattggctatatttctaatacaaaatataaatatatggattagaattttataaggtattatgggggctctaatggtacattagggtagagagtctaaagaccccagcccccaagttgtcactgccgctgcataagtacatgtgtcaagttcgctattaaattggatacatgttgatttatttttgtaagcatgaccacactcaatgaaaaaacaagccaacttcaatatgattgatactaaaatccaatttaagatgattttgttattgcttgctaagtttattgaaagcatacaagtagcaactaacataaatgaaaatacgggtgctaatatttaattttattgcttgcctataaacatgtcaacttgtcctgcccatatcactactagaaaaagtatttttactaacgtgagggccttatttttgcaggctgatatgacccttagagccaaatgaccgtctacaaaaatataaatcggggtaaaatttgatgcccgcttgcgaaaatagattttcgcagacggaccacttaagtggcgccgcttaagtggtccgcctacgaaaatagacttgaatataaatagacttgcgggccctattttttttttaagtcctcacacctctcagtcctcccctcgctccacacctctcctcccttcctcaccggcctctcccctccctt

SEQ ID NO: 21156 - DNA, 10422 bp, Oryza sativa
tcccctcccctctcagatccggccggggagggcggcggcggcgagccgcgtgcggcgatttttttgttcgttttttttttttgcattttcgcaggcgggccgttgccccgactgctaaaatcgatgattttcacagtcgttgtgatgcaggcggacctccctcccgcctacgaagattagttttggccacctgcgaaaattagttttctagtagtgtatgcctcacacatgtatttatgttaggcttgtatggcttctaattgagaaacaaacaatacatgtgatgtattttacatgattttcaccatcggaacaagatggcgactcatttaaacaatttgtaagataagtgactaaattgcacttatatcacaagttgtgataccacagaatacattttactcaaagaaaaatcagtgtctttatatgcataatacttcctaactattctatctatcctaaaattaactactagtcatttaggattaactacctagttatagttatattcaaatttgtaatactagataacgatattttaagatgaagagagtatacatattttcttaaattagtctaagctatttatatctgttgagttctttactactacttccacccaacatttcaaacatttcaatttgaagattgtccaagaatataagcattcatacactactgcttactctcagttaaatttatctcatcgtactcccaaccaccttttcaccctaactctctctcgttaaatgtgggccgggcactaaaatcttttttcttcaatcttaatctttgctaaataatctagaaatgttcgatgaagggagtagttagtttttgttgttatgttaacgttgataaaatagtaaattaaaaattaaaaagatgatactccctccgccacaagccgtatgttgtctcgttacggtcaaaatttgactaacgattatcctattttgatatactttttatgacgtaaaattgatgttgttatattcatatttaaaagtaatttgtatcatattgatatattagtaaagtgattgttttaaccttgtcttagattggcatgttagaattgaggagatggctatgtttttaaataatttgtggcaaaagtacaattttacccctacacgtctatatttttatggataatcatacctcttcatatttctactattgttaaataaggttatagtataaaaagatctgaactctcaaataaaattagatttgtggttcagatcgattaacttctactactagtagggagtaccatggtaggactcaaataaaatacgttatatttatatgaagtagtgtaaatgagaaaaaacttgttctaacgagcttagctcaaccaaatccgtcttctatcagtcaatctagaaggcctgggtgccacccaagtgcaaattcttctcttggctagtcacgcaaaatagagtttggacggcagataggctggagaaaagaggatggtaaaaccaaaatatttgcccactttgctgcactgttgacgaatcgtccttacacctcctggccaaatgcagactcacaaagaggatatgagcagaaatccagagatggactgggacttacctccaaatggacgattgggaaaactgccactcagtcgatcagtggtggaccctcgtaacggaatccccaaacaccccgcacaaacccctaaggaccctggtgattttaatctcgtgggaaatctggtgcgaacgaaacacaagaatatttcgcagcaatgcatctgcgccgtcctcaattttagcaaagatcaaggagaaaggaagagcatggatcaaagcaggggctgtaaccctgcaggagtttggaactttgggagatatcacttaatatccgccttttgtcttccttttgcgggttattgcttttttctggctaaccctgtatatatcttgttataatttttttctactctattaatatatacaagacaaagctttttccttctttaaaaaaaaacgagcttagctcagctcacgaactgagcaaagttaactagccttaatcaatcgagctgtagcctcgttatccacctcaggtgtggctgctggcttggcttgtgggcttgtggcagcgtcggtgtgggggcgatgattttgcactcgatgctgtgaccttacttggaagatgctatgctgctattcactggcccgttcgtttttgacagccttttgtggcgtcaaggcttgatttgatacacgatgttcacgatgatgtctccagccatcgtgccttggcgccttgcttctgtcgctagcagcggtcagggtcttggcgtcgaacatgccatcatggctcgccccgacaaaattgacggactcacgtcgcatgatgcttactattaaccattcaatggaagattggaagaactagtgtactattatggtctgtgaatttccaactaaattaaaaataactaaacaaactcctcgcctgtttggtttctatttgaagagaaaggtaaaccagagtggttagcgtctttctttaatcccactggccttttgtttctcttcaagcaccgctagatttattctactacatcatgggagtgatacatgtagcttttggcaaaagcgaccttaggagaaaatttggattggaagctaacagcagcattaacaatgccacgaaattgttgtccaaacattactacggctcctaaacaataattggaattgactatcatggatggtgctcctaaacagtatctatctttctcattgctttcgtgggacacaaatcaagaaaagctaaaaaaacaggatagcgacttgggcaagcaattagtgagaaccttgattgttccttcttcaggagaggaatacacgttacacagtcctcccagtggcagcaacttacagagtacaagtgtaagaaacttaattattcttacaaaatctcatagtagtaattaactacacagtgttcacatttctataccctttatttatatttttacccatgcagaaatcataaaaaggtgttaattaaggagtatggactagtgaaaattaacagagtacagtctctactctcccggttggtcatgccctctgtgtaaaatgccttggaagaatattgtatatacgataatggcttaattcacaagaacctcatcggaagtactcgaagttgaagtcgccgaccaccatgctccggctgacgtcgaagtcgaaatgtgtcatgccctgctcttgctgcccatggcagggcagcccgaacttgtgctccatggcgtccccctcgccgtagcccacgaaaggctcgaccttgctctcggtggcccaatgcagcggctcgctctcgagcgcattgttcacctccggcgcgcccacgccgcagttccagttgctgctgttgctggagctctcgccgtagcccaggttctccgacacgtcaagcacgctgctgtagtccacgaacccggccgcgtccttgccgccgaggtggccgtacaatggcatgcccgtggcgtcgaacccgctgccgaagctgtcgatcaccgggaacgggtcgaacacctgctgctgctgcttcagggcgaagccgtcggcggtggccggcggcttctggtcctgcgtcgacgtgtccaatgccgccgccgcagcagcagcagccgtggagatgggctggtgggtgctggggtcgatgccgcgctgcctcagcttcttcttgaggcagctgttccagaagttcttgatctcgttgtccgtcctccccggcaagtgcgacgcgatttgcgaccacctgcatcggattcgcctcgctgatcaggccacttatcgctaacaaatcacctccacacaaccacattgcgacgaaaatagtactggtacgcattattgccggagcggcagtacgtacgaacctgttgcctaggatctcatgcaggccgacgatggcgtcctcctcctgctgcgagaagctgccccgcttcaggtcggggcgcaggtagttgatccaccgcagcctgcagctcttgccgcacctctggagccctggagcacagaagaagatcgttgcacggcacgggtcagcgatgagacactgagacacatgcatgcaaagagcggatcgagcagagcaggagcagcttacgacctgcgagcttgggaacggagctccagcaaccgacgccgtagcggtagatgtgattgtagagcttctcgtcttcctcgggagaccagagccccttgcgcagcttctgctggacaccggcggcagagcacgcgtgccgtcccattcccgcccgacacgcgagcagctacctgccgctgggttcgttgcccttgccggcgtgtatctgtctatcgatctctctgtcgatcgaggcggccggctgggcgcccgatccagggggtatatatggggaagcgtgccgagaactactgcacacacacacgtacggtgcgcgcgcgcgagggaggcagcagatcgagcagcgatcaagtggcctttaagcaatcaaccaacgagccacggagccaagcgtctctctacctagtactcctcttctctgtgtgtactacctggtgcgtgcggcttgatatcgtgcttccgctacaatggattggagcttaagatatctccggttcgtgagagaaattaggagaggagaggagcgcagacactgggccagcgagcgaaagcgagcggcaagctagggccccgcgggaacaggacggaaaggacggaggaaaaaaaaagcagggttagttggagattatgactaagatttttccatcaacacttggttagggaagaacacggtacagccatatcactattaatctcactattaatccctccaggaaacttgcaagttgcagctacacgaccgaagctataagcgaggcagcgaaaaaacacacgcctcgtgcagcgctcgtacactgggagggactaatgggcgggcgatcgccgctcccctatactctatacactcctccctcccttcccctctccctcctctctttcttctcttcctactatagtacaccacacaaatttttttaaaaaaacaaaaagttagaaaaatttatgtataaaaatactatatataaaaaatttgaattcaaattcaaatttgaatcgggtatgtaaactttagacttataaattttaggtgtatagaaatactatatatagaaaatatttgaattcaaattcaaatttgaattcaaatttaaaattgaatcggctatgtaaacttttgacttataaactttaggtctataaactttaggtgtataaactttagatgcataaaaatactatatatagaaaatatttgaattcaaattcaaatttgaatcgggtatgtaaacttttgacttataaactttgggtttataaactttaggtgtataaactttaaatgtatagaaatactatatataaaaaaattgaattcaaattcaaatttgaattagatataaaaacttttgacttataaacttttggtctttagatgtataaacttaaggtgtataaactttaaatgtgtaacttaaggtgtataaattttatgtgtataaatttactaaagtagaaaagtaatacggtgccaaaaaaggaaacaggtggagagagggagggaagggggattgatcgctaccccccccccccccccccgcgtcccaggtgatcaatcgccgtttaggatttccgtactcggttgctatacctatatagcccgtggggccaaatcaacagggtaagatcgtacggcggccatagctctgccgctaattaaacacggcttaattagtctgctgtgctacgcaatgcagatggcggtctttggccacgtcttcaattgattgtgcccggctcggtcgacactggccgtaccgaccgcgtgtgtgcctgtgtccacgcatggcaataggcgaactactaccgctgctgccgactgtcgcgttccatctatccgtgttgatttgcaggtgccagccccgtgcgccggtgcgcgggtggcgcggtggccaactgtgcgcggcgagacagccgaaggtaaagctgccatccaagttgcggccggtcgggggacgtcacattcgtgcgtgtaaatacggcattgtttttcatagatcgggttaaactgatcactgtccacgagatcctgaagaggatagcagccgacagttggaattgcagcgttggccccacgtctttccacgtaagagtccttttgtggggtactggtactactacttgtagtaggaaattttttacacggccgaatcgatacagtacctagaacattctttcagaatttctactttgttatgttctaaagaaggcataaacacttaaccaggttgcttatcgcacagtgtcagtttcatgcatgagaacatgtacaggatacctgtcgtaggatctactgacatgtgggtccgatatgcgtccgtagacggaagaagaagttgatgattttttttttcttccaagtagagagtggatattctgtaacagttaaaatgtcgaagcataaaactatctttaatttaggtgcgggggtaaaaaccttgctcgttctagaaagacatgcaaaggtgaaagttacacgctgaaaggtgaaaataacgcacacgctttggtctcatcagctgcaagaaagcagaaatgagagagcaaaatgaccacagggagaggggtacctgattaaccgccgagcctagccaaagttactgcagaacaaaacgggaacaaacaaaccaagcaaagcagcacagcagtaggccctggccatcgtaccactaggaaggaaaaggtgagatgcagatgttcagttcaacgtaccagacggctcgatcgatcagtcgactccatcctaaattcgagtactacgtacttgcagtgcgtggctcgatcaaccgtgcaatcattcagctttcagtacactaaaagcgagggtccctaaagcctcgggccatagcaattgcatgcaggacagggcagcccccgcttaacccccagcacttagcctcccacgcttgtgcgctaaagcatacgcatgatcgagttgtacacgtcaacctttttattttcttttccatctatctggaggccctaggcactaattaagagcacgatactaaaacgatcaaacttgccataatgccatgcacgcgttgcaacgaatttctcaataacggcacacatcatccgtggtgttcatgctgttcttgcatgccaacgcagcttgtagcgcgaaaacgatctgaaaaccacttaatttaagtgctctggcctgtaccgattaattagctagtgccgtgaccctcgttagagtggcttgaaggctcgtgccaaatgatggcagctagttctcagcagtatgactgtgcagggagatagagataagaggccaagagcagtgctcgatcgaggctggctacaaccgcaaggataatgatgtagcgaggggtgtgtccgttccgtccaggaggggagggggggcaaagctagcgtgctccggagaaagcatgcagggttagcgtagcgcggagaccaccagcaccacccgtccaccgggcgcgcacggcctcggcaacaagtttggtggccaatcagggtcaggcttagcttccagcctgctccatgtacatgtcgagttcggtttagttgggaaccctagtatccctaacggccgcgcacttaattttttttaacttgctctgggcgttgttttgtgcgcgctgcaactgcaaatgcatgcagacacaccaagttgcaccaatgtgctcatgaattgtaatgcattgatcttgtgccttcacagatcgattggaataacgggaaaattgtgtttgcagtgaatgatcagatctgtgaatgctactgagcatttgtctgattctcccctcttttgacttgagagactgctactctgctaggcaatatcagtgatcaatcacttgcctaacggtgtctacaaaagctaattgcttggaaataacaacacatgtgtgagtggctaagtggtgatagcagtgcggagtcactataatgctggaggcacaattttgcatgtcaccggtaaaaaaaggcatatttttcgccagataaacctgcatgagtgaaactcaagaaatgtgcgtcaacgtagtagtgttaaccttctgataaaatgggatgatctacatgttccataggcgacaatgcttcttctccaattcttctgacgaagttacccgcgtaccaggaccagggtaggcagcttttccctttcgaccgagcttgcagcagttgctaaaagacaagctggcctctttttcacccacaagaaaaaagaggctcacttgaagaaagttggacaataacacaaaaaatatatttgttgacaacttggtactgttatcatcctctccttcctttttgtactctgttttttttctttcttcaagggaactccaattgtagtaccaagggggccgggggcaactgcagtgtattcttgcagttgacgttgattatttcagagttcagacaagtggacggctaaaagaaggaagaattaggactaccgactaccgagctacgtagccactataaggcaagttgttaccgctgcaacttccgcagcactaactaagacgacgactacgtggtagtatgcgggatgcatgggcgacatgtaaaagaatcgcccggcaaagtagtcactaatcgatcaattgggaattacctcaagtgcatgtctctattgtggccaaaaggatcctccaggattctcctacctgaggcttgatcttgacatgcctcctctataaaggaaagtactactagtaagtaaaaccccaaaggtgagagagcgagagaagaaagaaaaaaaaaacaaactaaagaggtggtgcatcatggtagctcctctttgaagttatgcaagcccaaagctagcagctaagtggctgcattacacatcacatacacatgttactactagtttactcatcgccgagcgacgacgtcaccggccgatatctctgggctcccgaggttggtgcgcccggccggcgctgccgctacgtagtagtagtaatactagtagtacgagttagaggccgttgctgtcacaaaaagatggcgtgatgtgcacttgccttgcatgactaacctgcatgattgaacttgctgctggctagctgcaatggaaagcgcctgctcaagccatgcagaactgaactgtgcactaattaattctcccctcacctaattcagctcgcctctctctgttttttttttcattaggaggccggacttgctgcatgcatgcctggctgtctggatagtgcgtactgttcctttcctacccctctttctcgctctcacggcacactgacaagatatgggctaaggtacgtagctaatagcctaatatctagtagtagtagcaactaagctagagccatggaggttacgcaacggaagccaagcaacataactaatcagtggtactctccagtactgtccaactgtcctgatgcttggagcttggaaagtttggatgctagctgcatttcagagtaaggagcgtccgtacacgcagtttactgaattttccgttcttcagttcagaggattgtttcttcccgtcgtcctctgcttcgtttcaatattggtgccgtccgatctaggagtagaaatggaatccgtttctagtgcattccgagctacctgactaatcattccagcgtgattgctttcaaacggaatcctaccgggcttgaaatcgcgggcgcaatgcagttatcttcgtagtgcgtaccaagctagacaatagtattgcgcgtacgtcatttctacgtatcagcctaatagcctattagtgatcaatgcatgcatcagatgcatcttagaaaaaacttacgggcaaagcaagaattaatcatctggccgtgcgggtgtaatccgtatctagccacgaggaaggccgtacacatgtttcattgcttaatataacaaacttgcagtactgcacccacggcgaacgttgaaatgcaacgtgaatcgttctgccattatttgatcatccgtagctcgagtttctgaatattattgggtactccagtctccaaatgaagtttttgcaaaacaataaagtgtagcttcaggggcagaaaacaacgaacttccagtcgttaagtggaggtggccttcagctccacaaagctgcacattttctgtgtctgccctccgggctgcggcttcagaatgttctgccggccgacatgcacgtcagaaccagcatggactagtcgtgtgtgtgtttttagagaagggtattttttacccggcctctacatccaaccggatatatacggccattgaaatagggaacttagccctgcaaacaacccaatctga

SEQ ID NO: 21157 - DNA, 21851 bp, Oryza sativa
atccggttggatgtagaggccgggtaaaaaaaatacccttatctaaaaaaaataaaaaaaaaactagtcgtgtgttaggtcacgctaaaattgaaagtttggttgaaattgaaacgatgtgacggaaaagttggaagtttgtgtgtagaaaaattttgatgtgatgaaaaaattaaaagtttggaaaaaaaaagtttagaactaaacaaaggtgcagttttgctccgttgtcatgtttagctggagatgtgtcccgttctcttacattttgattttgcagcccagatatcatcggtgtctggccatcccttttgatatccctcgtttttcaaacgatatgacattttctttttgtgtgtgtgagatcatctcaactgtagtaggcattattacctcagtgaaaatgatacggctgcactgcacctttaataatcctatgacaactttccaatatacgtagcacaccggagattgcacaatattgtaaggacccctttgaatcgtaggaatgtaaaagcataggaatagaaaaaacgcaggattctgacaggaatgtaggtgtaaaacagatgattgaaaaatacaggaaaaacacaggaatgatcgtttgattggaccacagaaaaaacacaagaatcggatgagagaaatagactcaaaggaatttttccaagaggttggacctcttgctaactttcctccaaaatttctatagaattacctattccataggaattttaaaggatagtataggattcaatcctttgtttcaaagggtttcataggaaatttttctataaaattaaaatcctttaaattttctacattttttctacaaattgaagggacctaaaggtggacgtaaaatcttgcatgccacctgcttcccagggaagatttgttcatgaccctcttctgatgttaacttctctgccaggaaccttcctgacatgtccacaaaagcatattctgcctttttctttttctttttgtgtgtgtgtgagcgtgttttttgccacactgtagtacccttctgtatcaatagaaaacaaatcgtagaactgtggccaaaataggggtcaaaatgtttggaaattgctcaaaccatttctcgactatggccttgtttagattctaacttttttctttaaactttcaattttaccgtcacagcaaatttttctacacacaaacttccaacttttttgtcacatcgttccaaattcttcaaacttctaattttgacggggaactaaacacaacctatacttttttcttgaaaaaacggataaaatggtatagtaagaaaacgatatagaatatatcgaaaacatggcaccatagtgtcaactgtcaagcaaatgaagccataaatactttacaaattacttggtgaagtcgtgaagattcaaagcacaactaataaatactactgaggatgccatagcattcaacacactagtaacacataagggtcaggggttgattagggtttgatttaataaaggattgtttgtgctgggttgccagtacaatatagtagtttttgccaaaaaaaacttatgaaaacggtacaccggcgaaactattacggcttgtttggcaacttgaagcaggggattgagagtttacatgaggaaattgatgtgagattgattaagatgagaatttaatttttaatcctaatagtttgtttggtagagctgatggaaattgataaggagtttagttggagattaggttattaatgaaaacggataattgagatttgtttaagaaaagtaaaggaggaatttcctcccgattaccactccctacctagatattgaaaatgagggagtttcttaattctccgtctccatcccaccaaaattcttatgtctcccaaccaaaataaaacagttaatattcccatccctctaaactctcaatccttcgtaaaaactcctcctaaccaaacggccgttaaaaaagcctcaccagatcacatttatgcttccgtcaattccaattccaagtaaatggtcagtacaaaagggggaaaatgttcaggatagccgggggaattccatactattttcaccttttagaccaaaatatatctgatctcaagtgaagcaggacttgcccaagcactggtgcgttacatctgaaacaaacaaaggaactgtgtaccaaaatcttgacaaccaaacatctaactttgtcaatattttgtcttggcttaccttttcttttagtataaggtttaggctaccttttcttttggtataaggtttagggactatctatacatttgtcaataaattttttcttaaaaaattaccaaatatagatatagtatgatcgtagtataactacattataacttactcctacatatgttatacaacgtaatttgtcgacaaatgtgtagtaaaatcatttaagttttagacttgacacgagtgcacacattcacgagtaatagtttttttagtgatattagatatatccatcggcaatcagatacctgtgataactttgttaatcgtaagatatattggcccagtttttaaagtggctcatagtggtagggtgtacatacatgtatatgagcatctaaattcgtgtgtactgtgtattagaaaaaagcgcgaaaaatctgtcacaagtgaaattgcaatttgcaaatccgaaaagaaatcgtaaacaaaacctgtgaggctgctatactgagttactgaccaatccactggatggacatacgcggcccggcccagcggccggtacgtggtctctccgcatcagggtttcaggattcaggtcttcaggggagctgcttgcttttgatcgtgtgccacaatcctgccgtcatcacactagcactactgccgcagtgccgctactatacgtacgtaccgaactacggatcgatccatggcgcggttgctttcgcacgctgctgtgcgatattccacacctaggaaacaaagatagctataggggcgggggagagcgtggaacgccaatcggccaatgcccaatatgtcgacggtggtgcaggccccgcatggcgcactcacaaggatcggcggcgttcgccgcccggccgcgggagtgtcggcacgatcgaggtcgcggaaggccgtaagctagatagcgagccgccctatcactcgagccatacattcgtgtcgcctgcagtgcggtgcatgcacagctcacccgcacgtacaccaggcgaaatcaacggtgttggcgtttgccgcgcgcacgaacgtcgatcgggtcggactgatcagccgagacgtcgagcgagcgagccgagatgcgctagcaggagatcgtgtgacaaaggctcaccttaacgacgacgtgtcacgtgcatgcctcgttccatccatcgatcgtcgcatccgtccaactccatatctccattcaccgactgaaaataccgtcaggtcacacagcaagtcggcaactaattaagcaagcaagcgagaagagttttagcacgatccaacgtaccactaaacctacgtgacgttgaacaaccacgcacatctagtcatcaacaatgcacacaagcgatgccatgcaccatctgtaagaaattaatttgctgtgtgtatagcgacagccatgtagtactacgatcgactcggatagacggatggacggcaggacgggatatctgaatcgaaaaaaagtgactaatatatgtatcaggacctaattaatcgctcggtaatcgcattggtttagcgatcgtaatcgatcgccgtggggatcattgacttcaatgtcacgttaagtgcgattgggaaataacccgtcgatcgattggtgatgggggctgggtgacaccactgtgcccaaacatggagttaactatatgtacacaaggtggattaagattttggacccctcttatgttagtgtcgaattgtcgatccgtctcgtcgtggtctccatcagccaatcagcgaggaaagccgagggtgtgtgtggtgcttctagaattccttctcttgcggcacagcttgattacagcggggattaaaacttgatagctgaccttttcttatcatgcctctttttcgtttgtagtagtagtagtagtaatacgcatggtactgcaacggtatatgtccaaatctacctattgtacagtgactggacgtgtacagaccaacctgccaataggccattattgatcctcattccagatgtccaatcttcgtatcgtttttgttttttatttggatattttaacttaacatattttggggggggggggaggggggtgtttgagagagattgttgcggatgcacggtcacaacaaacgaaaaaaaataattgctcgtcctatagctatctatccgagtttatatatagaatcgtgcggttatcgtgtttatcatgtgcgataaccttaccagattctgaaattacgatataccttgcggtaaccaccaaaccatggggtggcaataatcccaccttaaacggtttggtaaaccctaatagttatcgcccaaccacaattgcaactagctgtaaagtaacacggtcaaacaagttcaaaggttgttataaagtactcctagtagtacaccacggtgagattttcttttcgatactttagttgttttattttcatttttctatgtgggtatctacactccatggatgggtttctttacagggctgccatctaatgtgggtgacttacatgtgggcacgattttgtaagtaggttggacagatcgtggctggcttgcttgagtcgactcgtttcatttttgtgaagagctgagctcatgttttaattagttcgttagagataacaaaccagctcaagctagctcgcgagctactcatgagccaaacaaggtgaaggtctagagcacttgccgcagccgctggtggtttggaggctcgtgcttgttgccccgcccctcactgtactctattggccttgacctggttgtactacatgcgcatgctgccgcgtgcgctctcgccgccacttggatttggcagctctctgctctacttcccatcacgttgtggcgcctgcgctgcatgtatcgtcatccgttgactgttgtccttcttcttcccgtccaagacgacgagatgcggaggatgacgagtccctgtttcgacagaagactggtgagcttttgcgcgtcgtggagcctgttgcttcggtgaggtcggctggtgctgccaaccatgacgttctccttcttgtttcgctcgccatccatttgcgctgcccactagcccctcctactcgtgcgcgctcgtggagaagatagggcatggtgctctgcctagtagagctcgcgagctagcttgagccgagtcgagctaactcattatcctaacgagccgagtccaagcccgagccagcttgatatccaccctttgatgtgtaaggctcaaatatcaatcacttaaaattaaaggataatattacagaggattggtttccatactccatatgaatagctttcgacgagaaaaaataaaatgaagcatggatgcacgctccttgtctaaaactgtgtacaaatgaagaggagcctatctgtgcatatgcatctaggatcataaaatactttccactagccgagaaccccttttatttgcgactaaaaaagatgacaatctttcttcttttctgcaaaaaggtatgctaatatatctggcggtcgttttcctgggcttagagtatgttccctgtcaagcagtgatcgaatccataaagttttgggtaattagttttcagttctgcctttacacttattgttcccatctcctttacgtacttttctcgcctccttaattttccttgcctccttgagcgatcaacatcgatgagatcatctttagcttgccatttcaaggagaagagatttgcggctcggccataccatctctctttcagggctagcttccctggctgcacagtttttctgacgagacagaaacgttgcacaagataaattagttacttccaggtaaagtaattattaccaggccgacaactgaaccggtaaaaaccaaaacgagggaaaactccaaaaccagcgcctctatcgatcagtttggtgatgatttttttttcctttttgaaaaaaaaatcattcacaggtctagctttagaggcaaagtaagtgtactcaagtaaactaaaatatataaaatgcatcagatcagatgcatcgatgaaccagtgtcggcgactcggcctgcaatcgtacatcgacgaacgacgtataattccgtttgcggtaattggagggtgcgggatttttgggccctggctcacatgttttgggagaactggacttccacgcagcctgcagctagcaggccatcatccatcgcgcccgcaccaaacggtgtccacctctgttccggccgcacacacgggccacacactgaaagcccccaaagtcccaccgcgcgccgaggtgttagcgcgggcctttcgctgattgattcgctttcgaagaaaggaataagttcacttttggttcctctatttgtcgtccagtctgattttcatccctgaaccgcaaaaccgggtacaacccgtccctcagcttacgaaaaccgggcaaacgaggtccctcggcggttttgatagcggttttggttgacgtggcgcctacgttgctcatttaactcggtctttatctgacatggcactgatgtggtacttacgtggcaatttgatccggaaaaataacaaacccgtgggacccacatgtcagttgcacatacaaaataataaaaataatggtgggacccacgtggaccccacctgtcaccctatttctcccctcttatcagttatctatatcctctctctcagtccccggtgggagaggaccacgtgaggtccgccgtgccaaggctcgggaaggctgaaggctgacggcgctcaggaggcggacctcgccgtcgacgctgccgcatgctccgtgcactgccacgcctacgccggggatggtcgccgccggcagcaaggagctcctccgcaacgaggatgggttcaccacggaggacgtcgtggccatggactcccccaacatcgtcgccctcgctgagacgccgacggcaaggacatcgccgccgccgccgctgccgaccacctcaaggccatctgagcgagctagctgctctcctcaaggccatccgtgcagcgccggcgagccgcccggagatccttggcgtcgaggcggccgcggcggagacagcttcccgctccccctgccgccgcggctccttgtggtgctcggtggcgtacgcttgcgggtgaaggtggcagagcagcatcccggacgtgtccgcctccaccctggccgacagctgcctcaaccgcgactccacccagccctgtgagctttggcccagagaaacaacaaaacacacgcgaggtcacacacgcacgaaggaatacacaagtgatgcaaatacttcagtggacaaacacgagcttgcggcgaactagctacacttccactcttatttctcagactcagtgatttgttagtcaagctgcaacacatacagttaccgatcattaagaccaagcagtacttaactaatcaccacccacatggcgtcggccttgacgatctcctggcagacgtcgtcgccgacggcgagctgctcggtgatgacgcgcagggtggcgtctgaggccgagctcgccgtcgtcgtgctcgatggcgcgcagcatcaccgggctgggccacttccaccgcgcaaagccgcggaagaagcgcgggagcagcatgctggggatgtgttggggtagagctggcacatgcgcgccacgaggatagcccagccgatgccgccgaggaagcccgcgacgttggagtagacgccccgcgccttagcccagtgcttcacgcaccgcagcatggtgcggaacacggcggtctccgggacaagccgcaggatctcgtcggccacgcggatgccgttgaggctgcgcgccgtggcaaggtcgtcaaggccgcggagcaccgaccggtcgcactgaggtccactccaggttgtcgggcaccacgggaggcacacgccggcgtacacgagatccacctgcacgccgcggaacctcatctggatcaccggcaagggatgtggcggtggcgggagcggcggcggagtccgtggtggtggcgctgctgtagagagaagagatagaggaaaggggatagagatgaagatgccgagagaagaggaggaaatgaggagtgacgatgacaggtgggacccacgtgggtcccaccatttttatattattttatgtgtgcaacttacatgtgggtcccacgggttttattatttttccggatcgaattgccacgtcagtgccacgtcatatgaagacaagtcaaattagccacgtatgcgccacgtcagccaaaaccactgtcaaaaccgccaagggatctcgtttgcctggtttcgtaagttgggggacgggtcgtgcccggttttgcggttcagggacgaaaatcagactggacgacaaatagagggacctaaagtgaacttattcctcgaagaaacggggacgctccggcctcgtggcctcctcgtcgcaacgccccggaaatgtcaatgtggaccagaaattttcgcaaccaggatcctgctggaatttaaaatttggaacaagttcactcttgctccctcatcttgacgttgagtttgagtttgaattacatcaccgaactgtaatgtcagaatgttgaacccctgtctttcaaaaccaggttaaataaaatcataagacagtatgaatggctgttttgattggcgtggcatcctaatcagaaagaaaaaccatgtgtggctcacatgtaagtggactaaagaaacaagctctcgcgtcgtcttcccctgggggcggcacgggaggcggcaacccggccgcccctcaccctcccctcttccccctccgcctcgccaccgcccgagcggccgccggcaaagccggccggccgcaagggcggcggcggggcctctcacgtcctctctttcgggcgggcagggggctgtcctaggcgaagcagcggtgaccgccagatccggcccgctccggccggatttggcggggcggcaactggcggcggcgagggtggcggcaacgacggcggggatggagttggccgagggcgcggaggcggcggcggtgcctcccagatccgcgcctctcggccggatctggagggtggaggcagttggccgacggcagttggcgacgacgacgacgacggccggcggcagtaggcgatggtctcggccggatctggatgccggcggcagtgggcgacgacggcggcagtgtggtgacggcagcggcggcggccgtgggccggcggcaacgtggtggctgccgtgtcatctggcgacggcggtggaagcaatggcgtcgggctgctacctactcggtggtggagggcgatggcgcaacggcggttttgcggaggcggtggttggtgtcggtggcagcggcgacggtggctgtgactctagaggcggtgatgacgttggtggcggggaaggagtcgggtgcgaggtggggatgatgacggcgaggtggttaggtgttcggcagtagcggctgtggtggtggtgaccgtgttcacggtcaccggaggcatggcagcctcggttgactagccgaaggcgtgggagacgtccgcatctggccggcgtggcaccgttcgatggaggggtcggagaccggcttggtgcagagaaacgcaaccgatggcagcggaggtcggctcggcgcgagaggcgtgggcggcggagatggaggccggcttggcgcgagaggtgcgacggttagagggaggccagattggcgcgagaggcgcgtccggtagaggaggccggtttggcgtagtgaggcactgccggcggtggaggaggcgacctaggtgtgaggaggagctgccggtgggtgtggcgcggtcttcggcgcacgaaggctagctggcgggggatgccggtgagggggtcccacatgtcggcaaagcttgtgtggtggtggagcatcggtgcgtcagccgtggtttcgcaggggcgatctcgtctgtgccctttgttggtctagtggcagtcggtcacgcttagcggcggccgatccggtggtagccttctcctgggcgtgtgtgttggcgatgtcggcgtgtgggtggtggtatttttttccttttcctagttatgactctctagggttataatcttgtaattttttactactctatcaatagaacctcgcaccgtctcgtgtgagtcgttccaaaaaaaatgtaagtggacttctacctatcgactctttcctattttcaactctcccgtctcttctctaggagctcgccgatgaggagagggacaacgaccgatgagtctgtcatgggagacggaagcggtagttggaggtcaacggcgaaggggtgtcggtggtccacagcggaggaggaaaaggagctgatgagctcgagcttggcagccgtttccttgaaagcgacggtagcggtgagcaactagagaggatgcgtttgtggctgtgtgaggcgacttccaccaccacgaccgcctcccaccggttggccatcgctagcacgaggccagctcctgcgtggagagcacctcaccgcgcctgcaggcgaggaagccaacgccaccatcatcaagctccatgcgcatcccatgctagcctgcctcgacagccacaacagatgcaaacgagcgtctccatggtgcctggagccctccacagggtgttgtggaggccacaacgccgaaagacttggaggtgacgctcgtcctccaccggagccgtcgcatcatgtggtgtggccacgatgactcccattgcgccctgcaccacacgtgtttggcctctaccttcgcctgatctccaacgctggacacccgggggcggggggcggggggtgtatggctcgtgcttgtgcagctattgccgctggtaggggagagggaagggcaagggaggaggaggatatggtcgtcgttgttgtgactgccgaggcgtcgaggccgacaatgtcaccaaggcccgagccatccgtttctgtcctacacgcagccaatgttgtgcttgggagacaggagccgtcgcatcgtgttttgcccaagcaccgccctcgatgctgcactccggtcgtgaggtgagaggagtgaggcgagtaggcgactgcttgagctctatgactccgttgccgctgccgccttgctccgttctcactagtagctgaccgtctccccccagcaagctcctatggaggagtggggagagccggagaggtggagatggggaagaaagaagagagcctctagaagcccacttacatgtagccccacattttttttttgactaggatttcacgtcaaccaaaataatcatctttattgctttaggatcttatttaatttggctttaaaatttgggggttcgatatttatgatattctggtttaagaatataattcaaacttaatatcaacatgagggacataaagtgaacttgatccggttttatctcaccctttgcgggtgttaccaaactggcaggcacggcctcttttttaacgagggaagtgtagcaggaacggtctttgccttcgcgtaaagagagaagagacaactagacaagagagagagaggcatatgtcaccttcccacgaagacttcagatttaacttgcagatcacccattcacccgttctgcacaaggtaaagagcgtaaacgcacgtatgcaacgagagcgataacctcaggctcaatggatccccggaccccgcctgtttacctgctagtgcacacgacaatattgataccaaattgagcgtctcggtaattcaccgatggtggatctgcgatcgggaagtgaccagaaaggtttgaagtaccgtgtcagaaacgggatttctcaaccaaaatgaggaagcggactgctggtagttgcctaccacatctacagagacgttcaacctatacagaggagctccgggtcctctgcggcagcttcatgaatcaatttcctccccccaaaaaaaaagagaaaacaatcaatttcctgtgatgtttgctatataagcttcattgtcagtagcttcgattcaacacaatggatgaggcagcgacatctgatgagtgatgatccctctcgtcgtccttgactgaaaggcactgtatgattcaagatatatagtttcagacaagtaatgctgttttaaactgttgcacttcacctaccattacaatagagatacacacaagctagtaccttttttttttaccgaaaccaaatcaaactcgacattcaaatatataaaatcgtgacctaaatgcaatgtttaaggaaacaatgtgtcaatgtattagtactacaggatgaaatcaacaagggatctttgttgagtcatgccgtctgcccaccataaaccgaacctctgtggctctctctccttgcgtcccacctaaacaaaaccaaacacaagctagagcctaagagccatgagaagcattggcgggaaggggacggttaggccaaccgtttttatcttcaccacaccacgacctccactcttggcgccaaagcaaagccgttagattgttggtcaccatctcaaacccaactcgatcgcctcctcccctcccacccattttatcccttgacgctcaaatcagccgcgcccccaatgcccctcccccttgaccggccaccacaatgcggccgccctcgtcgtcggcgacgcccgggacgggccgggtgtcggcgttcacgatgcgcgcggtggcgcgcatgtcgagggcgcggtggttcatcttcctgaggcgggtgtaccagtaccagaacggcccgaggtccgacctgggctccaaccccttcaactcgcccggctggctcgccctcgagctcggcgtgatcatggcgcagatggtcgtcaccaccgccgtcgtcgccacctcccccaaggagcgccccgcgtggccgctccgggtttgggtcgccgcctacaacgtgggcaacgtgctcagcctccccctcctctactggcgccaccggcattcctcctccggcgcccgcgggggcacgctctccgacgatcccgagatgcacggcgccaacgaccctctaaggttcataaaacggcattagctgattagctttcttaatttcttgatggaaattgaaattgtgtgtgtgggatgcaggaacaggtcgtatctgatgaacaaggcacgggcgttcctggagctgttcttcgcgatgtggttcgtgatgggcaacgtgtgggtgttcgacgcgcggctcgggtcgttccaccgcgcgccgaggctgtacgcgctctgcatcggcctcctcgcatggaacgccgtcgtctactcgctcccattcctcctcttcctcctgctctgctgcttcgtcccggccgtcggctacgcgctcgggtacaacatgaactccgcgtccgtcggccggggcgcctccgacgagcagctcgccgcgctgccgcagtggcggttcaaggagccggccgacgcgccgagagaccgcgaccacgacgatcaggtgagcgcacgttccgttgccgcgtacgttaatatcgtgggatatgttagttttgcatgcacagagatgattaggcagtagcaaagcagcgtgcatgtctctgcggggaggtaggaaagtttagcgatgcagagaggggaattaaggagaaactcgccaaacaaatgattggtgaactcggctattggccagaataggatatccaaaaagtgatgaaacgtgcgcaccaaactagaacaatcttcctttttgggcggatatactaagataagaactgctaaaaccttacttttccccatggttcggtgcttaggaacaactcagccaacatgagctagtgctaactagctaacataagaactgctaaaacctttacctttcccattggttcggtgcttgcttaggaacaacttaggcacttagccaacataaactagtgctaactagctatgatgtgttgatgttgtccagttttatacatctaagccaattagtttgctctctagctagcttattattgtttagagctcacaacttataggaaactaggaattgtccttgcttttacatacttactggaattaaatggcaggagtgctgcatatgcctggctcagtacaaggagaaggaggaggtgaggcagctgccgtgcacgcacatgttccacctgaaatgcgtggacaggtggctcaggatcatctcctcttgccctctctgcaagcaagagctcagctagaaaaacaagctgacatgaatacggagctactgataccgcgccttccgacgcatgcgtcgcacctcacggaagaagaaaaagaaaagaaaaaaaaaccctggcacgccaaccatgcgtgcactgacctagttcgatattgctgatgacggcacgatgaatatttatgcatacacttgcatgtgaaaaagatatgcttggattaattaggctaggtagacaagcgggaaatgtgtaaaagagtttttttgtgtgtgtgtgtgtgtgtgtgttgtttgcggtgttgttgcatctctcgaatgtggtcgatcgagatgcgcgtgtacgtagtttttttcagcagaaaccaaacgagaacatataccagggtttgcgctcgtgctccagcgaatgccaacccaaaggtattcggcccggtcgaaactactacagtactgtattctaggcctggctcagagtgggccaacattttcggcccagtttattgacctactgcccagcctataattatcaatcagcccacctcgtcgctgcgccctgcgggagacggcggctacgagcctagagaccgttgtacgaccggccggtgaaagcgagaccgtcgtgccgtttcttccacagacgcgatcacgagagggagaagccccaagacaaaacacacaagtgacacaactctatatacaaccaaaacacacacatgcgtctcgtgcgactcgctcgtgaaattaacgggcgtactacgtgctagcgtagggcctgcgccgtgcgccactcgatccgttggtcaagtacgtccctggtctggtcaagccacctagccacgtgatagttgagcacctgggcacaagccgccggccttcgcggacgacgatcggtgcctacctgcgtacgggcagccactttggtcactggtgacggcatacggtggtggggggattgggggaaaatcggtggaagagttctccggcccggagccccggaccccggagagcgacggagacgcaccgcgcggagatggcaccgtgcctcgagaccaagtagagccgcagccgtgcaactcgatcctatcgcctatcggtgtcacggtgtgggccgcggccacgtgtggatctactgtgctggcatgattgggaggatacacacgtggccggaggttacggcgccggtgcttgctcctcgttgacaggtgacaatccagtagtaagcccataagcccattggaattagcgagcagttcactggcactagtgcactacacactgtccaactactctactcctaaactccctgagggctttcttttggcatagcccggtgcttcctttctttcgtcacatgactcgcgtactcctagctcactgctcacgtgtttgcacagtcgcactcaacgtgttcggacggccgaatcagaaaatatataatgcatacgtgtagcatcatcatcttgattagtcccatataatcttaacaaagtggattgatcttacagaaaactaatgcaaatgctgacaggataatccattaagaatgacatataggctgagttccttcccctattttccaaactaatatctctctctctctcttttgacttagcatgtttttaaaaccactaaatggttctatacgaaagagtataaccgatcgtcgactattatttctttgactactggtttcttaccctatggagcaattcgtgtggtctcgttcgactttattcttttctgtttttatcttttgattttctttgaaaaaatagtacaaatgcaaaccctcgtaacatacgtacacacatattctatcgctatgagcacctctaaaaaaattagacgagtatatgcacactcatccctataaacacgaagacacacatcctatttctataaggacatccgaaatatttcccatgaacgtgtacacacacatcctatctctgagcacattcagaagactggaacatcatgtattgttattgacaggtacgttgcctgtcattaaaataataattagctataattgcgagtacctgtgtcaaatctaagacttgaatcaagtgggccggttccatcatatggaatctaactaattgagctacacttatttcgtgattttggatttttatttgcctgttttccaaacttataaacgttgtttttgtaaatttatttttgttgtaatatttttcgaaagcaaattttcaactctgtaatggttcatttatccgtatgtactttctaatagctataaaaaaatcagattatacattatcaatttcagttatccaaaatacagcctaaaagtactcatggcctccaataatcctctcattgcagttgattatattcatgttcttcgcttgctcggcctattactatcttccaagggagttgtaccaggagcttttttttcggttgcccacgacaacaaaaaaatccttacctcgtgcatatcgcgaatcaatcaatgttactttgtcgttcttacctgccaactactccgctaactgatatgcgagattctccatcgctaccatcgacccatcgtgccagtggagtgtggagtgctgacgttggcatggggagctaagtaataatggtattctataagcgtatataaaggagagagagaaaaaaatcaggtcctatgacttagttcttcacatacttaaatgtagatgcaccaaatataatagaggagaggaagcgagatgagaaaaaagagatacaccattgtagctcatctattatgtaccctctctgtcccaataaaaaaaccaatccttccaggctcgtagctagaaattctttttttttacgtagtagtatatattagttgtaaaatgcgcttataccggctcctgagctgccaccgacctcgttaagcttgcgagttgcaactcggcctcgtcgagcttcgacctgccacttcgagagtaccaccggcctcgtagagctccctcgctacaccccgatcacatcaaagctcctaacctgccacccaaagccatcaccggtctcatagagctagaggaagttgacgagggataggaaataagaagatactccctccgtctcatagtataagaagttttagagttggacacggttattaagaaatgtaggtagaagtgaatgatgaagcattgtgattggatgaatagtggaggtaggtgggaaaagtgaatgttggaggtttgtgattggttgggaggagaatgttggtagagaagttgttatattttgggacaaatcctaagagctaaaaattattatattttgggacaaatgaagtaataactagtatgagcatttttggtccatatagaaatacggtatgaaaaaaactggtttaacaacacctcaaacacatataatggcataattcaaatttttaaaaataccattgacacggagccggtacaataaataataatgtttttttttcattacggtaaatttgtataccatgaatccgatcaacccaaatatattttgttttctggattattacatgacatgaacatgcatcggtagattttactaatgaatactttaattgtagtggaaattctattgagttaccatgcatttgcagctaaaacaataacaataaatgtttgtatctaaacaaccaaattgcaaattaaacaaaatagtatgattttgcggagtactacccaaatcagtagccaagaccgcactgtcagtctgtcgccctccaatccgttactcgtttattcgtatctcctcccaattattctacacgtttctttcaaattaaaatctccctaaactctgtcaaattcacggtgttttctggaaagggtggaacgctagttccgcaaaccagccaagcaagcaaacgtgtgcctctcacggcgcccatctcccgtccttaaataaacgcgtgcgccgaagctgcttctccccacaaaattttgtgtgtcctcatcccccatctcctctccaatactcgccactaatttcttctctctttctctctctctccgcgccctcgcatcgcacgtgaggcagtcgagggatagcggcgcaatggcggcggcggtggtggcgaacggcgcgagcggcgactcctccaaggccgcgttcgcggagatatacagcaggctcaaggaggagatgctcgaggacccggccttcgagttcaccgacgagtcgctccagtggatcgaccgcgtaatgctctcttccccgtctcgatcctttatgctgggagggatacggatgttggtttttgatctggtttagcgagaggggagggagggggtggcgttgatgcctacgtgctcgcgtgacgcgtcaaaggcttttggaatttcgccgggttttctgggcttacgagtggcgcttggctggtggattcgctctgttattggtatatgtgtttcctgatggtagaatgttaggagtatggagtatgcgagcaatgactagggggtaacgaagtaagtttacgtctcacatacagatcgatatggtgtgttgaattgcatagtgggtctgaactctgagcaacagagcgagtaatctctctctcttatctgttaacaagagtaggtgaacaaggaaggcagggcttttctaggctacagtgattgatcgatcaacttgttaggaaaagccggacaggagtgtctttttttacctacagtcgctggtgaagtagatcatataaagtcaccttatgaactttaagcatacggatttcatttctgttgtacaacagatcctttaaaaaattagtaaagctagccttttggacaccatgttctcttttatttgtgtgtgtgttggaggaaggggggcacaaaattcttgttgagtattttgatctttgcctaagtacatcttttggaatatttagatcgataaggtgaaaatgctgtgggtttccttgacataaaagatgaactcaccgtatgttgagttgttctatattgcagcaaaaacgatctatcaaagctgcatctccttaaccgtggaaagttaaaaagagctagttgtttttactactttgcatgtcaatatttcagatccaagctgcatctccttaaccgtggaaagataaaaagagctagttgtttttactactttgcatgttaatatttcagatcccgttggttagacagtataaatattacagatgttccttcaaaaataaagagtaaatttcactttgggccaccttttattactgatgtttcgctttggacgatcctttgaccaatgttttcactttaaaccaggtaaatcttgcctttgtttcactttgggacaccccaactctcttgtcaagcatatgaatgacctcgagtatgccggctcatactcgtcaataaactccctcggctatatgtagatcatttctttgacatatgaatgcagatggataaaggagttgagggtggcccaaagtgccacaaaggtaaattatccggtccaaagtgaaagcattggttaaagagttgtccaaagcgaaacaccggtaataaaatatatataggtgaaaagctggggagcacaatacattgttcaggtgtattctaaaagttttactactttttactgttaatgacacaacagtagtagctaagtgtaaatgattggttgctgatggtttgtttctgttgtttgatttttatcctctacctattaccatttccatttccatttaccattgttatttatgtgtattgatatcagaatcatacccacagaaattggacatacagtatatttgagtatgttaaagtagttgacattttttttttatccggagcagatgctggattacaatgtgctcggaggaaagtgcaaccgcgggatctctgtcattgatagtttcaagatgttgaagggcactgatgttctgaataaggaggagacatttcttgcctgcacccttggttggtgcattgaatgggtaatgttttctccaaatgctatcttgtaggatgtttgttagccaagtgaagttatatgctaagtgtggcaccactgatggttctgcataattttgcagctccaagcttattttcttgtgctgatgatattatggacaactctcaaacacgacgtgggcaaccttgctggtttagggtgctcaggtcagtagcagaacaatcatcctttgtatgcatcaattttttatatatattgtttttttataactgtatgaattataatccagaattgcacaggcattgaaaaaaaaaggtcatgcattaagtaactgattcatgttcccttttttcaatccttgtaaggagtgtgatcagattagcacaatgttgaattgctatctgttacctataaaactaaatttgtgtatttcattgttttgcaataggttgggctcattgctgtaaatgatggtattatccttcgcaaccatatttcacgaattcttcaacgccattttaaaggaaagctgtattatgttgatctcattgatttgttcaatgaggtaagttgtatcttctgacatgcacatattgttgggaaaaaaatactgtacgcttctccctgatgcccagttgtatgtttttgttttgttaggttgagtttaagactgcttcaggtcaattgttggatcttattactactcatgagggagaaaaggatctcacaaagtacaacttgacagtgtaagttcattttgcatttacgtgtttgtttctttctttctttgcatgatttcctgtccatttgtttctaaaaataaggttcaaacaaaacaaaggaacggaaaaaataacagatagttccttttctgtgttccatgtgtagtttctagaatgagttgtatttgcactatattttattttagcagttcagaattgggttatgatcttcatttaatggtgttcttttaactgacatattgtgcagtcaccgcgcattgttcagtacaagacagcttactactcattctatcttccggtaggatttaccattctcctatggattttttccatctttaaactctcacttcggtaatctgcgaatagttgtcatcactagcaataatatttttctttatccaaggttgcatgtgctttgctgctatctggtgagaatttggataacttcggtgatgttaagaacattcttgtggaaatggggacatacttccaagttcaggtaccttttcaccttgttggttgtgaatttatatattactggactaccgcactaatacgagttttctcacaggatgattatctagattgttatggtgatcctgagtttattgccaaggttagtgtgcccgttgtggttgtactaatcccaatgagtatggttactgccaatcggtccattgctgtccaggcttattttatctgtagcttatgatctgatcagtagaaatcttaatgcagattggaacggacattgaagactacaagtgctcatggttagttgtgcaagctctcgagcgtgctgacgagaaccaaaagcacatt

SEQ ID NO: 21158 - DNA, 7799 bp, Oryza sativa
tcctaaaaaggcaaaattgaacatattgccttgcagcaactcgccctacacataattaacacaaacccaaagtattatgcacctattccaaaacaacatcttcaactcttttgtacaattttctctccttattaatgaaaattaactgtggggtcttcaagaaggtcaagacctatatgtgttgcggtcataaaaaaaacatgggtggatttttatttgaaatgtaagacaacaccttcaacaacgagacaacaaataagaactgatgttgccgaatctagatgaactagatcatagtttctgccatgccatcatcattgcttatactccatgtcactgtctagctaaagcgaatatagtaggggtaacaattgcccatggtgactattgttcgtcaaaaacatccgaagggtccgctcatgactagtcatggttgctagaccaatttcaatagtcgtcaaccaatcttcccaatcaagacggagatcactacccacgtagcaaccccatttgatcgccaacggcaaagaccaggcatcaatatcaacgtacaaccccaaggacaaagctttggtctcctctatttgcctccatcgagcgaatgaaagaaacattttccatttggaacattgaagaaggaaatgtaaaaaatcgcatggcttcaaacgaagccaacccacctccatcgaccatggcaagcacaatcaaattgaatcgattttgctccactgacatgtagtcataaactgactcaaaaacaccacaaacatatccaagtcacaaaacaatatcatgagaatcacatgtggataatctgttcagcattatgctatttttcaacttgaataatctttctagcctaagtaccttaaaattatagcatgttggatagggtgtgaatgtgtgtatctttcatgtaatcgaaaatttccaatatttttaccttatgtactttggctgacgtttttgtcttggtttcggtttctccataatgatcctcatgatgttaagttccaattattccaataaatggatgtagccttttcattgccacttaggctaagttcttatcccaatttttccaactcacatctctcgttttccgcatggacgtttttcaaactgctaaacggtgtgttttttgcaaaaaaaaactatacgaaagttgttttaaaaatcaaattaatctattttttaaaaaaatagttaatacttaattaatcatccaataatacgtattttgttgtgcgtgccggggaggagctcccgaagacagccttagacttcatcatctccaacatgcccatgtcaagctgagatttgggctcattgtacccattggcaataccaaaattttgtaggacataattagaaaggatatgttcatttggtgacaaaataaggtgcatacaagatcaatagatgtgttttatcaaaattttgataggacagtgttttgatggagatggtttgcttggtgggatagcaaatcagacaaattgttggataaaaataagttatgtatattgtttcattgctggtacaaagaaaataaaccccacaaaattcaaaagaagccacagaaacctactccctccgtcctaaaaaaagacaaaccttggtttccgtgcccaacgtttgaccgtctatcttatttgaaaaaattatgaagaaaattaaaaagacaagtcacgcataaaatattaatcatgttttatcatctaacaccaataaaaatacgaattataaaaaaatttcatataagacggacagtcaaagttggacacggaaacccagggtttgccttttttgggacgaagggagtaacgatttttcatccaaacttttgtacttgcccaatccaatttgtttgatcgctgcaattcaggtggtgtttggatgcagggacttaactttagtctctatatttagacactaatttagagtattaaatatagactacttacaaaactaattacataaatgatagcgaaagggcctgtagcctagtggttacaagagcctcagtagcacctgaggtcctgggttcgactccccgtgggagcgaattttccaggatttaacggcgttgtgctttcagtggtaggcgacgtacccatcgacagcgaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagagaatgtttactgtagcatcacataggtttttttaagcctaattaatctataattagagaatgtttactgtagcatcacataggttaatcatggattaattaggcttaatagagacacatgattaattacgctcaatagagacaatttttttaagcctaattaatctataattagataatgtttactgtagcatcacataggctaatcatggattaattaggctcaatagattcgtctcgtgaattagtccaagattatggatgagttttattaatagtatacgtttaatatttataattagtgtccaaagatctgatgtgatagggaaatttagtcccatctaaatatgttctcaatattatgagtttctgacaatcgggtccgagaacccagagagacatacctgggacccaccgtacagtgggacaggagagaaaacctccccggatcctgcccctcctcaccgtctccactcccgatctccccgctccccgcgtcccgtctccgatccacccaaacacccgcaccgccgcgctacgcgagcacggcaccgcggcgcggcgcgactccgcaggcgacaagccgaggagaatcccgcgcccgcccgcccgcatcaccgccggatggccgccggccgtcgccggtagggcgataggcgggtagatccagatccggcggggcgggatcatatacaccccgcgccgatggcgggcgcggtgtcggcgctgttccttctggacatcaagggccgcgtcctcgtctggcgcgactaccgcggcgacgtctccgccctccaggctgagcgcttcttcaccaagctcctcgacaaggaggtaagcgctcgcgcatcccggcctctctctatctcctcgtcctcgtaggatctatgtggctcgccggtggcgttgcgcgctaagctgatgtgaaccaacagggcgactcggaggcgcactcgccggtggtctacgacgatgccggggtcacctacatgttcatccagcacaacaacgtgttcctactaaccgcctcccgccagaactgcaacgccgccagcatcctcctcttcctccaccgcgtcgttgatgtacgtatacccaccctggatcctgggacgcagatgacatgttcagcgttcagtttgttcacgaagttggtttgtgcatgagtgcaggtgttcaagcactatttcgaagagttggaggaagagtcgctgagggataactttgtcgttgtggtaagtaatggtgcaagcagctaagcatcactctggtttgctgcacaatctactggatttgacacaagatggtgtttgatttgtgcctgcagtatgagttgcttgatgaaatgatggattttgggtacccacaatacacggaggcgaaaatcttaagtgaattcattaagacggatgcgtacaggatggaggtatcacagaggccacctatggcagtgacaaatgccgtgtcatggcggagtgagggtattcggtacaagaagaatgaagtaagatacaggctcactctgttattttgggtagttttgtgatggtgctttccaaattatctaaccgatgtgtttccaggtgttcttggatgttgtggagagtgttaacattcttgttaacagcaatgggcagattgtgagatcagatgttgttggggcactgaagatgcggacatatttgaggtgagcctacaatgttattgtggaactagtagtatgatatctggatctgtaattcaatagggatcacatttatatgagtgaacattcagggtaccttcaatcggatctcaccaatagatgaagtgtccaacctaattgcccatttagaagaccatttatcagaaaattgaactgtttaagtgatggcctaagcaaacttttttactttctttatttgtgaagtaaacgcgtcatcttacttgctggttcatatgctcatttttcctgtaatcatgcatttaatatgtatttgtattccaattgttccattcttatgtgtgtcaaactaagtattatactaccgcttcacttctgaaatttcatgattttatcatgtagccatagtgtttcattgaccttttgcctttgaaagttttcaggaagtcttattctagaaacctcttcgtctctaacagattactgcttgtagattcttctgttatgcaactagatctatcataaatcttggacaaagaaatgaaagcatgctgaatgtcttttgagctagatcaatttccatgcaatactatctgacgactttagaattggttcaaagttcaaacgtcaactattgttatatgaatttgatttgccaaggctatcacgtatttgtataaagaactgctattgccacacattaaatcatcaaggaatttgatcaaggtagaaattcactctgtaagcactacctgggagatgtgccgcaccgtttttttctaatttttaaaatgtctatgcatcttttatatcccatattcagaaagaatggtggtctctcatatgatcataaagtgacttgcagttgaaagatggacatacaatttatgacctgggaacatcgatactgcatttcaagtgtttgatgttggccatacccatcacaaaatgttagcaaatacctctaaatgtcaattatagcttcggagcctacaaattaagattattaggatataagcaatgagagtgctttgcagattaccagaatttgggagtattccgtttaatttgtttcagatgtctaccttttagcagacattctgaactgatcatctgatgatgctcatgcgccatgctccccatcgaattatgttttccatctatgtttcaaagttcaaattatttgtgttatgctgtcaccccaaccatttatgttttcctgcacatctctgacccccactaatactgaacaatattgtgaatcagtggaatgcctgagtgcaaacttggattgaacgatagggttcttttggaggctcaaggccgagctactaaaggaaaagcaatagatcttgatgatattaaatttcaccagtaagtaaacagtttagcatttttttcaagtcactttgacaatttgagcagggccatatatgacctctctcttctgttattactaggtgcgtgaggttggctagatttgagaatgatagaactatatccttcatacctcctgacggatctttcgatctaatgacatacagacttagcacccaggttttctctactgcttgtgatttacagctattggatgctttagatacctgaaatgcactgccttgctccgctattctcatgcctgtctttttttatatatccttaaggtaaaaccacttatctgggtggaagcacaaattgagaaacattcaagaagccgaatagaacttatggtgaaagcaagaagtcagtttaaggaaaggaggtgagcattttacaagagcaatgtttgctgttacactaatgcctcttggaaggtgacatatttcctattttcacctgcagcacagcaacaaatgttgaaattgaagtgcctgttccttcagatgctacgaaccctaatataagaacttcaatgggctctgctgcatatgcacctgagagagatgcaatggtctggaaagtaaaatcatttcctggtggcaaggtaagtttcaagccaagtcatctttgccttctacttcatgctacctagaagtgtgctaatatatgtgagtttttctgttaggattacatgtgcagagctgaatttagtcttccaagtataactgcagaagaagcagctcctgaaaagaaggcaccaatacgagtgaaatttgagataccatatttcactgtgtcgggtattcaggtaatcaaattactattgcaaatatgtacttgattgctcttatggtacttctttgctatcttcactcaaaatgtatgccatcttgtattttctgcaggttcgctatctgaagatcattgaaaagagtgggtaccaggcgcttccttgggttagatacattacaatggctggtgaatacgaactgagacttatatgagttatctctgatatggctgctcaaagattttgatgctaaatttcaactcccaagatacatgtttgatgctcgatatacaacatatagttggcattgggacgttgccatggaagtctttgaaaagctcaaccatgcaaggtttttctgtctcgttgttcatcttgttagtgttactttaccatggttactgtaagttacccatcaagtatagctttgaaaaaaactttttttttgttcacttgtatcattattgatttatttttgtgggtgtcgaactttcccccttttgtactacacaaaaatcttgagctgaattggtataaatgaaatacctgggcggtgcttttgaagtccagattaaaactgctgaacctgtagaactatttttaaggcatgctttctgttgtgtacctgcacagtgacggtttcctatagcagtgagaatcagctattcagagtttcagaccttacagggtgttgatcatcttgtcaatgctgtttccgttcgtgatccattgttgccacatgccaacattcttctttatataattatattccatggcttaaaacaaatttcgtgtcgttaaggtttgcttttttggttttttgagatgtttatgacgttcaattttggtgattccaagtctttctgtactagctagactagctgggccttgtaaagaacccactttatccaatgacactatattcccaccttcgcagtagattgtttcgactcgttcaggtgtgtttacaacccaaacccgtttacctttccatcacgacctttttatagagggatgatttttgtgggattgatattggatcgtttcctagtactgcatgtaatccgttgaggtagttctggcctctgggtagttgacacctctgcggctctgccacatcgatctttgtctaacgttttctcaacatctcagtttactccgctgtggtttgcgtcgtctcgccggcctggccaagcgaatcgagggatcgtcgcatgcgactccctcgtggcatcgtcgcgaccctatcaatcgataattaaaggaaaaagtacataaaaggtccctctcaacttgttatcatcgagttattataaaatcatctccgactataaaactggatatatgatatccctcaatttataaaaccgttcactttagtttctttggtggttttgactataattttatgtaacatggcgactgagtcagcgtgagcccccatatcagtatgccatgtcatcaccctctctctcccttcaccctctctctctctctctcacttttctcctctctgctggccggccgacgggtgggaggaggtcgctggggccaggcgggagagga

SEQ ID NO: 21159 - DNA, 4889 bp, Oryza sativa
tgccatggccgggggggggcttccctcttccgcgccagtggcccctctgatgcctcgttgtgagctagcctatggggcccaacctcttttgtcgccgcctcgtgccatgccgccgctgccaccctttcccttcccctcctccgcctcccccacctcgccggcgatgacgaccatctcctctttgccggtgccgatgcccatctcctctgcgctgccgccgacgccctcctccacggcgccgtcagttgctgccgcccgcgccctttgctgcgccctgggcctccccgccgcggcgccgctgtccccaccgctccgtccggtgtcatgtgaatactaggatggcatgtgggtcccacatggacccatcatttttttttattttctagtgtaactggtacatgggccccactatttttattttttttcgacttgaattaccacgtaagcgtcacgtcaatacccatggaataaaggcctagtcaaagaagccacgtagacgccacgtcacccaaatccaaagacaataccaccgaaggacctagtttgcactggttttgtaagttgggggataagttgtatccggtttgtagttcaaggatgattttgtaattgggtgacaagatgagtgaccttcgatgtatttttccataattaaatacttaagggtgagtttgaggagaaggagatacgcaaaacgaggtgagcaattagtgcatgattaattgagcattaactattttaaatttcaaaaatagattaatatgattttttaaatcaacttttcctatagaaaatttttgaaaaaaacaccgtttagtagtttgggaagcgtgcgcgcggaaaacgaggtgttttctcaccagccttagtatgtactgtattggaccaataatattttttctaggtcagccactgcatgcgggcttgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaataaagtgtcaaccagcccccaatcgctctgggatcggatctggagaaggccttgtgtccaaaagtccccccctatctaagtgggcaaggtcctccttttatatctcaaggggataccacatgcccctctccctctccaaactggactgttcttctcttcataaatggacggagatcggtacggttgctctccgggtgcccttctgacgggacggcccatatctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcacgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcacatcggtaatggtgacttggctgtccataatgggcggtctcttcgagactgccacattacttgagcggcgtacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccaggcacagcgatggcaagggtataaagacaccgaggaaaggatttgctcccttcctttcgccattattccccttgccttcgctgcttgagccctaactctttctctgctgcgcctttccttcgccacacgcgctcgttctcaatcatcccttcctccggcgccatggcacggggttccgctctgctcgacggaagcgtacttccgccttctcgcatcgtgagcgagaggcatgccgggctgccgcgccgctttatgccggaatctgccaccggccgggagatagtgatgctgggcgagggacgcccggcaccagactacccggggcggtccgtcttcttcctccccttcgcaatggcagggctggttccgccattttcttctttctttatggatgttctggatttctacgatctccagatggcgcacctcacccccaatgcagtgatgacattggccatcttcgcgcacctatgcgagatgttcattggggtgcgcccatctcttcggctgttccggtggttcttcaccgtgcagtcggtgtcgccgccgtcggtggttggtggctgctacttccagccgcgggggccggtgttgaaccgctacatcccctgcgccctccgcaagaagtgggacgactggaagagcgactggttctacacccccctcgccaacgaagcgcgcctccgacttccaagtcagcccccggcgcaggtctccagctggcgggcaccggtagatctgggggatgactatgacgccgtcctcgaccgcctggcgggcctgcgatcccaggggctcacaggggccatggtgtacggcgactacctccgtcgccggattgcgccgctccaacggcgcgcccggggcgcctgggagtacaccgggtccgaagactacatgcggacccaccagggagtcagatgggattgggctcccgaggacttcaagatcgtggtccaacgggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttctgggccccgcgccgggggctcggggagcagccgccctgccgacgcccaggggaagaggaagctgggaggaacacctcccccatctcctccccgagggggcggggcggtgcgtgccagcagtcggcacccggagggggccgcgccgacatcgcagcccgagggggagcgcaagaagaagcggctccgcaagatgggggagacggaaccatcccggggaaacctgatttcccctccaaggtggtcatttaaccgaccccctcgcaggttcgtcccactctcattgcgaccgtctttcttttatcccaaaagcaagttttctcttacccatcttgttcgtcttctggttttttcttttgcttcaacgatgtcccgtcacgttcctcccgccatcccaagtccggccagtccgaggccgaagatccggcggccgcagaggaacggaggcgagaatctgaccggcgagaggccgcagatcgccttcgggaagctgaagaggccgcccgggaggccgctcgggctcgccatgcagaggataccgctcgggaagaggccgcccgggctcgccaagccgaagaggctgctaaggaggaggccgcccgggctcgtcaggctgaggcgatggcgtcttccgaggcagctcacgacaaagctgcgggcgcgtcgcttgggcccactccctcgggcgacgctcaggcgacagcctccagggcggctcgcgacgaggccgcgggcggatcgcctgggatcggatctggagaaggccttgtgtccaaaagtccccccctatctaagtgggcaaggtcctccttttatatctcaagggcataccacatgcccctttctcagaagggcacccggagagcaaccgtaccgatctccgtccatttatgaagagaagaacagtccagtttggagagggaggctggcgatctttccacataccgagagagcttgagatttcaccctaagcccccggccgaaccggcaaaggggggcctgtgcggtctcccggtgaggagccacgagctccgtcatctggcgcgccaggtagggggaaacgcgagacacgggcgatgtatacaggttcgggccgctgggaagcgtaataccctactcctgtgttttggtggatttgtgtatgaacaagtaataagtgtcaaccagcccccaatcgctctgggatcggatttggagaaggccttgtgtccaaaagtccccccctatttaagtgggcaaggtcctccttttatatttcaaggggataccaca

SEQ ID NO: 21160 - DNA, 1406 bp, Oryza sativa
accccccctcggggaaatcaggaggagggcggacacctcaccctcgggcccgacgtccccgaaggtgccaggccacgtgggcgattgtgtctgcctcaagcctctggtcacgatactcccggtcccatatcaccgacagggctcgtaagtcgtaatgcctacctttgtcagccctgctcagcccctgcacctaattacgatcggcccatatatgttgggtcagaacgggagcgtggtgtatgttaggcttatttatactcggaataggttcactttagatttctcatttgacatggagtttccgtttctaaattgaaatactagatataacctattccttaactaacaaaaccggattactgaaggtcccatgaaagcagtattccttattttgtctaacgtggcgagttgatcgtagtcaacaacgctaagtcgacgtgggacctacatggaactcgcgtgttatggcccttatctccccccctccgctctgttcccatctcaccagggcggtaggcggtgaggaggatggcggcgagcggtgagaaggtcggtggctggcggctggcggtgaggacaacggccggcgggaagaagctagctcagccatttcatcccccaacccgcgccaaagccagtgctgactcgacggccggatccactcggctgcaagctgctgctgcttcgggctctaggaacggctgctggtgcagggttagtcacacaacgtccgtcacgagcaggtacgacacgcgacgatgagatcgctgtggaggaactagctcgacggcgagaccattttactccctcacgacaacggctcgccctttttacccatcatttccttctcattggcatcaggtggggattagggagcagctcggcgtcggcaacgaattcctatgatgccaccaccccctcaagctcggctgcaaccggcaatatccttccagagaaatactctacccctcaccgcctgttcgcatcagcgcctcctcctcgcgccccttgccacccaaacgcctccctccttgctgatgcgctctactcggtgggccgtcggttgagcttggcccagcacttgagtgggaggataatgcgttggggtcgacttcgatatccctcgttggcaccctccacctcctgttgtcgtcccctgaccgcctcttgcatctacgcctctaggtgttgggcaacgctgtgctcgctgggaagcaccatcgcaccgttgtctaggaagcgtagggccacagcggagaggaaggagacacgaggaagcggtcgtcgcgagagcgtgctgctacgggcggagcacgacgcagaggaaggccgtggaaagcggctgcatggcgccacacgagctgaaaattttacattttggtcctttttgaaaacttattttacaa

SEQ ID NO: 21161 - DNA, 15297 bp, Oryza sativa
  unsure (1)..(15297): unsure at all n locations
tcaagattttcatgttcccttcatttggtagtaatttttcccttcttcaactatttcagttgggcacaatatgttttattttaaaatcgtaaattaggaagtgctacacaagttacaacgagaacatgtcaaaataccggacaggcagttaaccagtagaaattatgtatagcctaaatgaaagtattgcaagatatggtttgtatgcatcaaactgctgaaaaatatcaattataacaaaaaagtacctgttggcgagcggaaatcatattctggaacggtaaaagcaggatcagaaccaagaccaatctctgaaacaacagacgctatcactgcactgagtatcaccataggtgttgagttggaaagggatgaaagtcaacagaagtaggccacaaaacagattccacggcgaaaaagcacccggcaacagcagcattaaaacctacaatacaagcaatcacctgaaatataagtacaatgcaatcagaaaacagaatgcatggggaaaaggattacttggccagtttgaattgtaggactgtgtggagtatccacaaaaggagaatatcatactttatgctgtgtcaacttaggtgatctattgaccaaggaacattacacaaagttccataaatagattctttgcgtttggatgctacatagcaaaaagttccaaaaaacagacgcttgcgttcagatgcgtagcttctgatacaaaaatatattccatgtgtgtaattaattaaaacatgacagaccaacttaaaagttgaagataaaatatagagaaatattctgcagtgaatggaattttgaaaaataagaaatatgagaagcaagattcacctgatgcgattccagctgctgatccagctgccacaagagaaagttttttccctccttccaatttaaacacatttccaaatcctttggctatagatgaaccaatctccacacttggaccctcaggccccaaagaatttccagttccaagagtaaaagatgctgccatggctttcaaaaatggcctaaaggcaccttttatcttagacatagtgtcatttgagttggttgctatagaacttcttaatgtgttaaacactccaactataatgcctccactgactggaacaagtatcactctctgccagatttcaccgatggactcctcccttagccatgaagcgcctctcaatggtatgccgtcccaaaagagatcacgtatttcatgaacctatgccaaaataatacaaagttcttatctcaatctgcaacatgtgtaatagtgattactttgaggacttgtatgcaatcaagatgctcaaattcttgaaatacattatttatgcctggcagctgcaacgccaacctccattttcatcaaacatctatgggcttagagatcgagattatacacactatccactatattatcagtagggaagaatcaggaaatggcatcttgtgaggatgggtgaggactggacgcgctaattggacaaacacaattcgaaccaagctaaaacaggcacacagcagacaaggagtaataaaactagtaaattttgaatgggaactaaactaatgcatggatgcatggaattangcacccagcattagcttaatgggatccggcaatgctaacatggtgagaagcggtttagaaagggaatttggaagccaaatggtagcttaaaaacattggttatggtaagttcggtggtccaattgcatcgcatattcacatccaagtcggggaactagacgtgagatgtgtcgtcgtatgggtaccgagaggttgaagaggacgacggagacgccactgaggagcccgacgaggcaggcggcgagcgtgacgaggtcacggccgggcgccgccacctcctcctcccaggccgcctccacccgctcaccccgccggtccccgtcctcctcctcggtcgccgcgccgcatcggatggtccggaggcgcgcgcccccgtccccgccaccgcagcggcgacctgccgggcggcggcgggagagagaaggcggggatggggtcgagacgaggaggacacgcgcgggacagggtgccacggacggcggcgccatgaattgggagaggcatctcatattctcatccctagcatactactgcgagtctgcgagagaggagggagtgccgcgaggccacggcaattcggcaaagcgtctcctggcggatttccagcctatccaattccagatggaggctggagcgagctgttctttttttttttttcattcctctcgttttatgtggtaggctggtagccaagaaccgcgatcgtctgtttcatatcatcatcggcctctctctacttctctagtctcttggagaagtaagcaggattgggctttgggaaatgataatgcgtttttgggttttagggccttgcttgatttcgagtgaaacgggcctaacaatttcctgttaattactccgcttaaggaaggccatttcctaatcatgtcgaatatgtgtttatacgttatcagtgtccttaccaaaaggtctctatttgactagattgctttgctccaaacacatgttatcgcaactatacgatattggtggagaaatactttttactcctggttggtaatccctatagtcccggttttctaaccgggagtaaaaatacgggactaaaggttttttttctttttttttctattttgtatatctcacgcacattatctcacatcattcacaataatatagttcatcctaaatcattcacagcaacataattcattctaaatcattcacagcaacatatttcattctcaaaatcattcacaacagcatagttcattctcaacacagatcgaatcacacattcaacacaaatcgaatcaacacagatcgaataattcagcacaaatcgaatcaacacagatcaaatcacacattaagaaaaaagaaaaaaaatacgtgcagccacgccgccctccaccgcctatcgccgcaccgccctccgcgccggccgccgccgcccggctgcctcccctcccggatccgccgtgcgaggccgcctgtgccgccgcctgggcgcatgagaagtggggaggagaggggagggggcggatccggagaaggaagaggaagagatgcggtgagtgaggagaggagaggagaaagagataaaggtgagagaggaggagatagaatttattaactgatcccatgcgcctcctcctcctcgatctcgcgcgcgtgcacgcctcgttctctccgcgcatgccaatcttttttcccggttgtttaacaaccaagactagaaatagatctttagtcacactaaccgggattaaagataacagagggtctgacaccgcttgcctttttttatccgggactaaaaatgatctttaaggttggtgttaccaaccgagactaaagatcaaaaggtagctctaaccttttgaaccgagtctaaagatatctttagtcccggtttttattgtaaccgggactattgtggaatttggtcgaccgaccaaagatggtttctccagtagtgtgattagtgtgctaggatctttctgacatggaccaataactccttcgcatggaataagttcaagactttgcggggaggtccgtgtatccgttggcgatccatttgtgtaattaagagcaaggctaataatatagccgacttgttaactataaggttctttgtagccttctctcagcccacccatataatagttagctctttacgattaatataggacccacttatctctctcacagagttttttggtttttgtgtccaaaccggctataagtttacagctcgcttctcctctctcttctctcttctcttctacacctcagcatttagtcggattatagcctccttattatacttgctctaaggataggccaacgtgagactttggtggatagccttgaagatgctcgaaggtggccacgtgtcctctgcacgggtgcacatggctatctagctaattgcccgggaaccatgtcgtggcaccattcgaagataggaccccacaacccaagtttgcatggaaactgccaagtatgtttacccaagacacggtcaactggagttggtatgttcactcaagaagaaggtcgatcttcgcacatcctagggtgtgtttgtataatggaaaatgaggaatgtaattaggaatgagaaatgaatgaatggttatgattaaatagaagaggaagaatggatggttagaatttagagatgttttggtgggtgggaaattatttccctatcccattagccaaacagggctagatgtctcgtttcaggaatcacttgtcagctcggtaaaggctaacgtggcgtttcttgaagaacggtggaggcacatcctacggacatcacacatccatcatatacgggtggaggcacatcctacctctactaaaaaatgatttttcatggcgtcaccctataattttcgctggcagttatacgtgaaaaccgctactaaaaatgtaactaggggtgaagggttacggacagccagcgaaaatcggtttttgcttttcgttggcgcccccactaagaggtccgccattaaaaataactctattttcgctggcggctacgctaagagacccactataaaaaattgggttttcgctgacggccgattttcgctggcggcagctaacttacaccgactatgaaaaaaatattccctttattaaaatcttttccaattttatcccttcccattcaccttttccattccttcttttcctcctgcagccttttcacctcctgtcctccttcagcctttcctcctcctttttcttcaccttctccttcttcttcttctgtgtggagtaggaaacccgcgcggattaacgaccgtgacccgcggcgcccggaagggcgcctgtgtatccgcgcccggaaaggcgcacgcgcgcgggcacggctgtggggtatccggccaccgcagagccgcgggcggcggatccggccgccggagggccgcggggagcggatcggggcgcgggcggcggcgcgcggctgatccgggcaagggcggccgctttcggacgccggcggcagtgcgcggcggatccaggcgcgggcggcggctttcaggcgctggcagggaggctagatccgccgccgctagatcggtggcgcctggccggtggtcaccggggagctgcatgctagctgcagagaggaggcacgaccgcacgagaggatcctctcttcagttcatgcgtttggttctgatctgtttgcacgtggtggggttcaactgctcattatgtttgacgtttctggatcatcattttcttctgttcatgtgctcattttcttccttcgaattccagaaaccatttctgcagcggggctctgtgcagcggcggaggccggcggggctcggcagcggcctcgtcgaggcggaggcagtggaggcttgaatgcttgaatttttttgatgcttgaatgcttgggggaatagaaatttttgactgtaaatttaaattgtgcttgtgtgaattgaattttttgactaatttttgcttgggtgaatggaaatttctgtggatttttgaatggtggagcgttgattttttttttaaacttggccaggattaacactggcggctgacacagtgttacccgccaacgaaaaaatattttcgctggcggccatcttaagccagccgccagtgaaaatggatctttgctggcggttgggcttaagacaaccgccagcgaaaatgaattatcgctggcggccaaaaaccgctagcgaagattgtgattttcactggcttttgctttgtggcggctcaaaattccaccagcgaaaatctaaaatggctgccacgaaagatggtttttttagtagggtacggacatcacacatccatcatatacggtgtgtcagttgctaagtttgtccattgcattagggtattgtccttcagaaacctgaacatgtatacttctttctttgctcccgagcacttatggggtagaccgtaccaaggtcaccgagaacccaggtcgatcacagttccatggtttcctttgtttgttggaacacagtacacgcttatgtaaacacgcgtacatcacatatataaacacacatcttataatacgaattcaatgcaaacaatcgagaggagaaacatgccacgtggcaactccagtttcgcataagaggctcgacgaaacgatgtcgcgtccgcgagtggaggcatcgatgaaacgctcttgtgcgcatgcagcaggcctccagaaatttctccgtaatcaggtcccaatgggccattgctcggtagcccatgcgaattatgccgtgtgatgattctagaaagaaccggcgccattactatgcatacatgtagtgcaaacacccggtgtatgctgattaatgaactgtaccggctgctgacgttgatttctcacattgcgccgtacgactggcaaagcccaggcaagcaggcagctattgcttcctttcaccaccaaatcttgaggatcaaaggagtaaggccctctttatttaggtttataagctaatttataagtcgaaaagtctaagcctaaacaaacaagcagcttttcgtttggcttttttaaagccataagccactctaacactattaagctaaaagctaggttggagaagcttttttggcttatgtgaggtagatgtatgactcaactactaaacttaggacattaaatccaccggcttataaatcatataagccaataagctgacttaaaaatctaggccaataagcctaagcctaaacaaagagggcctaataatactacctactttagttagggttaaaataggattagccggatgtaattaaatcatccactaaaaaaatcctcaaacatcagtctttttaaactttctatgtttttcatttatatgttttacacatgtatttatgcgttttatattccaaatgttttctttcatatatattgttttcctgagttccaaacatgtcttaggctatgtctgagaggagaggaaaaaaataagacacgtaaaaagaagtatgccattatcgcttcatcaggtgatttaggactgtttaaaaagccaaggactgtttcaaacatgaaaaatagaaatatgattattttaaaaagtaacttttctacatatagttttatgtaaaaacactctgacatacgggtgaaaaatgatggatgtttcctttgtttgtcctttgtcgaatgcagccttagaacaagtacaataaaaagcaataagctagctatagaacaacgaaggagagtgaagaaaaatggactagttagttgcagcacgagctccaatatagtatgtgagaagtaaccaccccttgtgaaaggggtaatctcttcacgaactccagtaaaggaatggtgtgaattggatgaaaattggagccagtatgttagagacaatttattacatatgctacatcttaattaattagttgatgatgtgaataaattggtggtctcaatcacctctactataaaacttactcataaaatttgctcttagagcaaaaataatagtggtctataaacttacgtatatgatagagattaaaatatatatatagagagagaggattggctttcgataaaatctagctctacacatgttttaaggtaaatacattaaattcttgtaagtaagataaagagaggaaaaagaaatatagagacaatcttatagccaacttataagctctaatataagtttagttatctctactattaatctggctcttctatatatgtgtattaatttgttacctattcactaggcctaatgagccaggctcactgtaccacacgtggcaaagccgcacgctttttctagtgtatacattaatcatatgagcatcttagtttatatttggttaaagggatatccctggataggagatgatccagttttttggtatgtttggttggtggacaaaggtggatagggtggtccaaagaggaaataactcacacatatgttggatgagcgtatctgaccaaattggtcggatgagaatatccacctttttgttaatcttaatcattagtaattgattaacaataattaatgtaatttattgataataattaataattaacttgtcaaaatcaagggtaattagacagaattagtctattttgtttttaattagtatagactatggctacattaatgataataacatattttagtattaattaatataacattgttttccttctcatccatccaaccaaacaagatccacccaaccaaataaaaaataggatcaccatcagtggcgaagccacgttgaagctagcgggtgcacatgaacccactaaatttagaatttctcacttgaaaacactaaaatgcacagtattacattgaaattttctagatcttcaatggtagtgtccccttgttttgatgctagcttcgcccctaatcaccatatccttacaaatatgaatgaccatatcatatctaacattctaaccttagaccacaagccaaacgcacccttaagaaaactagatcacattgacaaaatcctcacatatatctcaccattgatattgattaaccgcaccaaagttgtctttataaaatgtcatgtaactacgccattggaccataaatattttatgtttataataggttaaacttttatttttttattatcaattttagattaaaatgtgttcataaatttaatgagttcatcatgatgatatatagtacttttttaaaagcaaacacaccttttttttataaacacacataattgtcgttgtaacatgtaagagcacccgcaatgctaaagtaagatgctctctataaaatatgtacatctcagcaataaactagattaatagtaaaccacctcaatagtatgtttagagcacccgcaatggtaaagtaaggtgttatctataaaacatgtacatctcagcaatagactagattaatagtaaaccatctcaacagtatgtctacatgggtatctatagctctctaatacattgtctcgtttttctctatagactatctccaggttagtagatagctttgctctctctcttcatttaatctcttccaagtaggaaaatatgctgacatggatatcttatagagagcctatagataaccattgtgggtgcccttatatgggtatctataactctttaatccattgcctcgtttttctctatagactatctccatgttagtagatagctttgttctctctcttcatttaatctctttcaagtaggaaaatatgctgacatagatctcttatagagagactatagataaatatctatactaatataaaaaggaggagttgtcccccaccaatgcttcaggccaaatcatcccccaatcatctttgtcctcagccgtccgatctgttgatccaacggcgaaatcaccgattccgccatcccaccaccacacaaatccacgcccgcactactgccaccgcgctatctacgcccccacgctctccccgcgcgatgactccgccgccgcgcctcctcgcgctgctcagatgcgcgctgcgcctcccgacgcttcctcgctccaggccgccgtcgtcatcgcacggtcccgacccctccagtatcccccccatcccgcctcctcctccaccgcgtcgccgatggctccatgtcgtcgtcgtcgtcgcgcggtcccggctggctgtccaccgcgccatcacagatccagccatccctcataccggactcccccatcctgacggccccatcccagcggcgaggaggcgtcgtcgcgcgggagatgactggtggggagagtgaagagggagaggcggatggcaaccctccctctgtcacgctcgctctccaatcccccttcacagtcgagccctgcgtcgtcgccttcccccgccgatgccaccacatcaaggcacctcacgcatggagctctttccccgaagccggacgtaatggccggtccctcgctaaggcgcccagcagatccggccagttgcctcagcaacagagagtccacggacttctccactgctctgtaagaggatctggactcttctgccaacgaggccactgtctgatccaccatcgtaggggattctttccgttccctaaatgcaccacatatcttcccctccggaattttttttttcgaatgaaattgatagaataccaatggctgttgcaacaaggtaatttgccctcaacctttagcttttcaaattagaatcaatttaattacttctttgtttacgcacatcattttaccctaaagactgatgcttgcactgatgtaccatgttgtcatgggggatgatctagacgtgaggactggcaagccatctcttgatatgtttcttgctgagatgaggaggttcgaggtattgccatgtaagtgctcttacctataatgttctttatactaaacacaatattataattttacctggcacaagtgcattgcatgttgttcgggtcaatttggaaccagtatttcaagctccttcttctgtagcagcagttaaaaattgctggaatgtgacttcgctcctcctcgctcgctcgctcctcctcgctcctgtgtactgccaccgcgccgccgcatcctcgccggagccactatcttctccatccgccgccggagccgaggtccatcttacagtttaattcctcactgaatgttgactatccctgccaatcaatcacacgattccctctgaatgctaatccattcaattaatttcctggactggtaatatctctcccatagtggggaatcatgtgtcttttgtacaaattacacaggttattaaactggattctccatttcactttagaagttgattttcttgctttcttggctatatttcctgtcatcacatcttacatttacaagtaggaatgaaatgatggccgactaccttcttgatcactgcgatgtgccccttcgcttcaaggatatgcataaatccaaggtgattctcatcttccaaatctttatctcgatatttcccctaggaataaaagattccaaacccatattcacactatttacagtgagcattaggatcattttatagaaaaagatatcgaggtgatctagaagttattatacgttaggtctgctgcttcattataatagatcatatgtgtatttctgaatatatcttctttgtttggtttttcccagtccggcactctgctagtattctaggtaccggactgcaacctgtaatattattttgcggtgtactgattgggtggttagatttcaaaagcaatttcaaattatctgtcctgtccaactattgccagattacccaggtgccatgtacaatactatttttttttaaaaaaaaagtggcactcaggaagtttgagaaccagtatgtactcctaccaatgaatatcacatcatggtgtttcaggttttgtttaagtttggaaagaaaatatacataatttgtggcaaataatgttcagatttgcagattaacatgctaccaaggtcaaaactgtatgtaatacatgcaagtgtcagattttttttgttcccctactttactaaaactgtaaattaggtttacaacgtgtttctgatatataacaataagagaaatcatgatatcgaaaagtatctgttaatgctataaggcatctgaatatattggcttacttctattgtttataatacaggttgacattgtggccaactggagattttggtaaaatcctatcatgtttcaccatggcatttcactgtttggcgcacggtatttaggagctatttgtatagtaaatgctggaatattgaagtaaattatatgttcagcttattaactgcattgcgataagctttgatctagatccggtttcaattttcatttgtgtggtcgcatcctttaatttatatagcttcataagagtatactccgaagtacatgccgttttatgtatttttatgccttcatattctgattgtctaatggctctaaaacaacagacgtaaactacgatgtctgaagttttccatgttttcttccttatgaaaatgatatggagctgtggcaagctgctttggcaatccctgttgctgtccagagtaaagattttcatgtggcttgcgctaaagggcagatgcctcatggctgacaatctacagaaaagaggtggcctcatcaggcgaattgttccctatgcaacctgacatttcaagatgacacccaacctttttgttcaatgtgctttcacaaacaggatttggagattgctcaggagctaggtgaatgttggctttccgcttcccagtgacctcaatgtagacttggctgattggcggatggcttcaaggagaagcttcagagattatctcagaaaagttttcggtacactcttcttcagagattgtctcagcaagttgtatggttgtgcagctctttggtgacatcaaagaaatcacaatctggagggaggcaggcttcatggtaggcgaaaaacgattggcattattccttttgcagttttttctctcccactctttgtaaccggtttcgacaacttcgtgtggacgcttagtttgtaacaccatctcataatcttaatgaatttgcttagcctactcttgggccagtctggctaaaataaatgtaatcagagttatacttcatttgttggaaacataacttgtaaaataaaactaatcatttttatccttacaaaaggctgctcaatgctgcaataatttatgttgaaaaaggaagtggcaaaacagcatgtcttttgctactttgttctgtctgtttttcttgaagaattctctaattttattgtgattagtcttttgaaaagactatattaaagaaatttcttattttgttttggttatttctatatgcaaaaattaatagctctataaattcaatagttgaagagaagcaatgttcagaaaagttgaatatgcacttgatatatatgtgttaataaattacctttcaaagtatgtgtactttctaatttttaaatgtgactatatattttttatatatattatgacaaacgtgttttacatgtgcacgataactagcaatctctaaagtaaacgtatattgactaagaatctacgctgaatggctctattttgaaacgtggatatatgactatatgttacataggagttacaaggaaaacgaaagaaaaaaaaagacgcagcgttctagaaaagtgtcatcgagcccattggttttgtcgcaaaatcgtaaatgttattgccaaatgccaatcacatcgtggtccaaagcaaaacacacatttctgcgagtactttaatcggtgagcccttgagacgttaactacacgaaacacacatttctgccgcccgacacttgccatggaccagatgaccaaaaaaatgaagcggttagtgtggtgcaaacaaaacaagccgctttacatgtgtttcaagactaaaagaagaatagttttgtgcaagactgtttacgctttcaaataaagacagaagcagtgaaagtgctttgcttgcagagaattgaagaatgccctagcgcgaagcagcgcatgcggcatgcccccaccagaaaccggaggaagaagactagcaaagccggatcgagatcaactgcagtggtaatagcgactgcaactttaaccgttgttgcgtgactgtcagatcaaagaaaatggctcagattcggtcagggtacacagtcgtgtactgtaaagctgacagcctggttgtgtcgtggcgcagctctctatcgttcatcagcttaatttgatggttgtggatgatatgactgtttaacgtgcacccgacctggccgcgagcacacagctttcgctgcagtttccgtccgacctggccgagaccggccatcgaccgctcaggcttggataaaaaagggccggacttgagcatcagcggcggcagagcggcaaagcgcccacggaaacgatcagcccgtacgtgcaaattgtgcaaaatataaatcggtcatcgtccactcgtcctatcgagacggccggtccagggtggcgccctggcgggcggtcatgcctccatcaaataagcacagatgcctatcttgacagaccgtattagtatcgcgaaccatatgtgatcctcatactaccgcatatctgtatgcgtgcactggatcagtgagtggctctgtgtttataacttagggttgggaacccatctcatccgcacggaaaacggaacagttcattagggcgtgattaattaagcgttagtttttttaaaataaattaatttgatttttttgagcaacttttgtatataaattttttttaaaaaacatatcgtttagtagtttaaaaagagtgtgcacgaaaaacgagaaatttgagttaggagcaccgaacacacctagtaagttccacgccaaaaccggaggaacattcgtaccacgcgtatgatgctgaatcctcacgagataattttgccgtacgttttactcgcaagtgcagtgcttctagaacaaagtggtggctctcgtcttcccgacagcgacgcgcacagtgataggatcgtcaagcacacaatcaggcggccgcttgtactgaaaaccggacgctttgctgcgttagcatcgccattattcggaccccgcgcgccaaccatgtggtgtcgttcgatcaccggccactgtctccgcccacacggccggagagaatccctcgccgcttgaaaaaaatatctctattccccccggtattgatagctcgcgagccgcgactcgcaagtcgcaactgaccacaggaggagacaaacaagacgcagaccttatggaccttatgggtgatgatcttatctgattcgactagtcgactagtcgcactgattagactccccttctctggtcccatcgtcgcgttgtttggcggcatcagcagttacccgaaactaattattgcgaacacgacattattgtttttctaaaacaaaatcgagatcgcaagttcgcgacgaacgctgatagcttcagttcaggcgcgccggtgcaacgcgcaaggaaggataacccttgccgtcgcggtcgtgtgatcgtgtcgtgcgctgcactgcactgcactgatcaggtcgcgcagccgctgacgtttcgttgtgtcggctccacccgtttgggtggatcccttccgaattccgatcccattggtcattgaccaccgggctggttgc

SEQ ID NO: 21162 - DNA, 2959 bp, Oryza sativa
  unsure (1)..(2959): unsure at all n locations
ccagcagcgcgccacgacacgccgtcgcacgtccgcctggtgcggggcgcgggcggggaccgcgtctgcgcgctctccctctccgggctcgccgtgtccggggaccccctcgggaaggacgtgtgcgtcgcgctgaaggcccccggcgtgtggcgcgtcgacccggtgttcgccgcggtgggtgaccgcgtcgtcgccctcggcggcgcgtgccagttggcgctgggcgagggcgaggacgcctcggtggtggaggtacacgaaagcggcagctggacggcctgcggtccgatgccagccgagctgcgggagtccgcggcggcgacgtggctctcggtgccgcgacggatcagcgagtgtacctcacagacagatccaccgggtgggcaagctggttcgatccggcgaagcagcagtggggacccacctgccgcctccgccctgacgccaccgtctccacatggggcctcgcccccggccgcggcggcgccgagcggctcgtcctgttcggagcgaagcgctgcggtagagccgagcaagcgaagagcagagtcgtcatccaagcgtgggaagtggacggcgacggcctcgcgctgtcccgtggcgcggcgcacgacacgatgccgggggagatgtccgagaggctgttcccccgtgacgaggacggcgatgaggaggacgaagaggagatgtcgccgtcgatcggggtgtgcggcaacgccgccggagggtacgtgtacaatgcggccgacccgacaatcggagccgtgctctacgagctacgtgacggggtgggcagcgccgtggagcgatgggaatgggtgccgtgcgcgccctcggtcgaggccgagccgttgggacgcttcatcctcgcgtgttcgccggtggggctggacgagctcgcgcgtggtcaaccagccgcatgtacaaccgcacagtgaactcatgactgccgacgcccgtccaaagcaagttaacctcaaaggttgcttttgtaaataaagtcccgcgcagtagcacggctactcgctagcgtacataaaaaattatgttaaattttctttacacatgattttcttagaagttattaatagttatcccgttggcttataacattataaaaagtcaaatattggtttccaagtcaaaccagccaccatcttttactcttcttctcatgttacccttttatttactcgtgcgatttgtcacaacttttattgacttttcatgagaccattaaaaaccgtaccttataacttttaccgttcattgtatcgttaacgttaagttcccttttattgtttcgagaagtcccatcaaacgattacattatactcatttatggataacccgttatcttttttttattattatcattcagtttttaaaagttgaacatgttccttactttactttctagaagttctgctaaccatcatgaccctactatttatgtcatatctatctcattttttcttaatatcattgggataaaaaaaaataggcctaactatcttttttttttggagggggggtttatagtttttatatttccattattcgtcacgatactacttttacggcttgcccgctatcctctcccttactgacattttcccaccgttgtgttatatagatgaactactttgaatgttccttgttttcctttatttctacatgtatttctactttgaactctgaatttttttttctatttctagtttaggaatttattttttttatttaaaattttggttaatcatgtgttgtgttctatatggtatttttttcattatttattatttttatttcgaaattcagttatttgtaaattataattatacttgatgcttaattttattttttaaattttgaatttatcttattttctatttgaaattttaattaatcntgtgtcgtttctagatgatctctccttttaatgttccctttttttatttctcattttagttatttataaagtgtatttttacttgaactcttattttttatttttctaatttcataatgtattttttttctgttttttaaattttagttaatctcgtgttgtgttctaaatggaatgttttttttcaatatttcttatttttatttataatttcagttatttttacattgcattcctatttaaactcttcctttttttccctaattttggaatttatttaatttttaattaatctcctattgggttttgtatgaattgttatttcaatatttcttatatttagattcgaatttcagttatttctgatttgtggttgtattggaacactctttttttctaaatttggattttattttatttttattttgaattttaattaaagttgtcgtgtgttcttgatggacagttctttcaatagtcctttttttttatttcaaattgtatcttacttgaactctcttcttttttttaaatttcagaatttattttattttttatttcaaatttaattaatcttatattggttctatatgtactctttttccaatatcacttatttctaattctaaattttagttttttctaattatatttctacttaaacactcttttttctgcaattaatgtgataatttatagcgttcatggtgaacatggtgaaaatgtattttaataatataatagatgtcgttccattgtgaaaatgtattgctttgctgaaagttgctgcagtgttttgcatagtttcctcgaactcgaacctctctgccatttttttcctctcgttttttttttcatgttgaacattcgtatagtgacaaaggtgagggtgttcctttctgtaactttatttaagcagaggtaaagcagtgaagtgacatatgcattatcttacacattattgctttcatgtgttgggcactaaaatctcggcttcaaagttaaagtcttggcaatagtgactaggggggaaacaatataatg

SEQ ID NO: 21163 - DNA, 15466 bp, Oryza sativa
caaatcagccggttttcgcttgcgtagcatttgacatggcattcccacgatgataatggtctctgcaacaacgatgacttatgccatgtgggattggtgattttgggtttttttttcccatgaatgtggatttaggattttggggagattttgcaaatgaaaatacaaatttgggtgatgaaaatccttatcatatgcggtcaccttaatcaccctgctagtgaatttttttcattggtggacgtcataagctagccgcatgtgaagaatatatttcccaggcacagaggcatccgtcagcgagaagtttgtatttttcattgacctttggttatcggcggcaccgcggtcgctaacgaaaactcattttggacgtcagtgtaaacacattttgtagtagtgggaggcagaagaagaggtgtttgtcaccgatatatgggcctgtgattattatttttatttcttgactaggcagttacatcagctcacgtaggcaaaaatcggtgaaaaccgttttgagggtaaagtaaatggcattaaaagtttaggatgtcaaataaccggtttcaaagtttaggagagtaaaataccctatcgaaaaagaaattgcaatagccattgaaccggtatcaattccacatgtggtgctcgatgtccatgcaaagtgaaggctgttttatcgcgaatattagtgaatgacctaatatcacataattagaaggggtgaggcttcgaacccaggtcgtctagcccaccaccttgtggagctagccggaagacccctgtgcgtttctctaaaggttgttttatcattctcctgagtacctgtgtaacaaccacttacctgtagtgtttaattatttacagacttcacagcgcgtgttgtactgcacactggactctaaatttctcgcgcgcgcacagacagtatatataggatattcatatgggactccatggtgcccgggctccaaggtataaaacacacaaattctctcaaatttttaaaaattttcatatatatatatatatatatataatatgtgaactatcacactatcacactatgtgaactatcaatatgcctgcacattatcttattcgaatgtgtgtgtatatacactacgactaatggtaaataatactccgtatgcgactagctagagttggcgaaacaaaagatatattagaagcaagttactaccaactatctgacgagaaaagactgttggaacagacaacacaccatccttattctaaagagcaaaaattaagccaagcggttgctaacgattgactaatcggtcattatatctgcgacagtgccaccaggtcgtggcgtggaataagttcattacaggtcccttgacttgaaagcaagttcgattttcgtcttcgaaccataataccgaatacaacagatctttcatttgcaaagattggtgcaatattggtctcaaagagacggtttatatggcggtttcaactaacctagcgcccacgcaaacaatttaacttggtctttatctgatgtggcacatgaagcaaaatttaacaattcaaacattaaaacaaaaattgtaggcccatgtgccagtcaaacaataagattaaaaattaatattacccacatattagtgggcccatttcctccacctaatcccttcctcgacatgtatggccacgcctctgcgctccccattacctgacgcctaccgcgatgccaagtcctccctctatgcctccgcctcccctggcgacaacttcaagcacatggaggccaacacctagggcgccgctgccgacaaccattgaaaggagtcgtccgactactgtaccgccgtaccgaacccttcccccacgtcgacgacttcctctcctccccttgtcgacgcaccattagcagcgggcgcttccaatgtgtcgaaggactcaactaagaaatggtatggacttgtggtcggtgtggtaatcgttgcatcgcagcagggtggcgatctaccgtgccatcacttagctcctcaccggtcaagaaaggaagcggatcgagcgcttcaggatcgagctctgcgttccagatccaggccctatcaaactacgctcctccacttgctcggcctccgcctggccgctgggaacgatatccacaccctcatcactgatatggatgctgacgacaacgggaccatcgagttcgatgagcttgcctcctcccgccgcgggcttgtgctacacccaccactgcaatcgccgccgccacctcactcccactggttatgttgccgccaccgcaacagtcgtagccgatgcgctgctccccatgccgccacgcatcgaccgcgccacacggcaccctagggcgccgcttccgtgtcgtgtgccggaagcacacaaggacgccatggctgcctcctccgtcgctttggaggaggaggggagaagtagaaggggtggatatagagaagagagaggattatggtgagggagtgggcccactgacatgtggtctcactattttttaatcttattgtttcactaacacatattgttaggtccacaatttttgttttaatgtttaaatttttaaattttacttcatgtaccacgtcagatgaatgaagaccaagtcaaattagtcacatggacgacacgttagctgaaatcgcttgggacaaatatttcatttgttttgacggttaaaggacccgttgtatctgatattatggttctaggatgaaaattgaactccttgtcaagttaagagacctgaaacgaacttattccttatggcgctgccattgtgggtaataggcccagactaagccctttgtgtagtggggtgtgggccagtgcggcccattaacgttgaggacagggcccagcaaaagcaacttgcatttccttctttttttcaggcaagttgccgagttgggcgctgcccagggccaacctgcggacctgcttggaaccctagcgccgcaatgcaaagagcaaccgttgcctcagcctccctatataagcagagcacaagccgggggtcttcaccacatcccctctgcttggtcattttcagctatgggtggtagcattcatcttggtatcgtcctgcagttcttagtgagaaacaggtcaaagctctagatttgtggctcctggcttctattttacttgagtttgctctcctttcttgtggctcttctgttttgtttttcttttgatttttattaagctagatttatcatgatttttgctgtttcacggtgagatcttgttgtgcttgtgtattctggtgcaaaatcttccaatccggctgcgacaaatctcctttgggcagcccggccaccttttgcacagaaggatgggctacgtgtgttaaaacattagtggcaagtgctttgcctcatttccatcgtggaggattggagttcatctgtttccagtcctcccaatggagcaagcgcacatcttgtcttgcatcccttcaatttctgtctttcataggagtatcacttctgagatctgatgaaaaaagaaacctttctgccatcttttgagttttccctgcttttctcgtgaaggatggtttatctctactccttccgtccaaaaaaaaaaagtacttatctttatatctgaaattcagtcagaggtcaggaaaactggatctgaggtaatgttcgtacatcagtggaagtaaaactgtggcacagtgcagctttgacaaatgacatggtccctcgtctggaactattcaatcattcaaatactagtactaataaaaaaggaacatgtaattttgcgtgatactactaacttgctaataacatgtagcaagggtttgatgaccaaacttcataaggaaaaaaatttcatacgcttgcaaggagatattgatttgcataaactgctgttccgcagttgtcaatagggaagccagcatagcagccacatatttccaaatcgctttataagttacatacaactaatgaaaatcttgcttgcgtctaggctaattagatctatacaaagggtaccaaatccccgagtcccagagcaatagagcatattcgcgcagaatatgccttttcaatctctgtcccaagatccaaatcttcaatgaacctcccccactcgataaactaaaaacgtttgactctgtcagaataagcaaattgtgacaaaaaggcggctgcaccttggccgtgtttacatttaaattttcttcaaactttcaacttttccatcacatcgaatatttgaatacatacgtggagcattaaatatgaaaaaaaaattgcacagtttacatgtaaatcgcgagacgaatcttttgagcctaattacgtcatgatttgacaatgcaatgttacaataaatatttgctaatgacagattaattaggcttaatagattcgtctcgcagtttacaggcggaatctgtaatttattttgttattagtctacgtttaatacttcaaaaatatgtgtccatgtaattaaaaaaaattgacgcacgcaactaaacacagccgtaatcgagggctgtaaagtttacataaacaggaagttctccaaagagaaaggacagcaggaaaaggctacaacatgctgactgagcctatacttttctatttgcaccatttgctctgcacgtcctttggtggagcataaatgcattttcacaaaccaggccctatttagggcgtgtttagtttgggaaaagaaaatttttaaatgtcacatcagacgtttgaccggatgttggaagggattttcggacacgaataaaagaactaattttcagaactcgccggaaaactgcgagacgattcttttgagcctaattatgccatcattagcacatgtgggttactttagcacttatggctaatcatggactaattaggctcaaaagattcgtctcgctatttcctccataactatgcaattagtttttctttttatttatatttaatactcgatgcatgtgtctaaagattcgatgtgatgtttttgggaaaaacttattgggaactaaacgggcccttagattctaactttttttcttcaaatttctaacttttccaccacatccaactttcctacaaacacaaacttacaacttttccatcatatcgttctaatttcttcaaacttctaattttgacgtagaagtatacacagcctcaatctagtactcaaggtttaccaactggcttgtggaatcccagaatttgatccacaagaacacgttaacacgctagccctacgcccctacttgtacagtgcgggcagttcatctctcttgcagtttagtttcactgtagttcctaccagttagtttcactgtagttccccaaatgacgatgcacacggtttaatccctagaccaacagtaaactttgcagacattatcaactgggcaactggctccaggtaaattgatttacaatatggagactgtacacataattttaagtgctacctcagctgatagaagttaagggtctggaatgtctgaagagggaagaaacctcattaggaaactcgatagagaccatacgcagataaccccaagaatctggaggacagtcaataatgctcctaaggagttcatgatagccaaggtttggtttgttgcctctgttcctctaacagaaaaggtgagtgctgtcaccagctgagctgccctgttcagttggtgaagcctgtagatctgcaaagacgaggaaaagagtaaatgacatatgcttagaaatggagcagttcacgagacaaataacatcaacagatatctaattgttcattatctgcttttactgtgcctcttaagcgattcactcaggcatcttcaagacgctcgtgagacaaacaatatcaactgatatttaattaaccgtatagtgagcttcgttccagaaataatcacaaaaaatttctttaaaaattgtgaagcaacctcctggttcgtttgaatgaacaagagcaaaatagatggtctgcaactctgcatctggagatacaatggacaaaaaataaagctgatacaaataaaagagtgtcaattgtaacgtgtaaaaagatctgatgcctgcttctatatatgcctatgtaatcggattttttgtgatttaacacactgcaacatatagtttgggcagactgaaatcacaccagtgcacacttgattataaggaaagcacaatggattaagcttttgtttcaggatccaatagcaccaggataaatataagcaccaggttaccttaaagatgatagggataactggccaagaaggtgatttccgatgccgtgcatactgctcgaatgcgaattgtacaacaagaccaaccagataaggggcaagagtagctgaagctgctggtccagtccagggccagaccattcccatggtcaaaagcggtatcatcaagctcaaaaccatcgttgttactgaagaaatacggaaaaatctggattttgaccagatataactcttaggagctacttgctgcaaaggcctccagactttatcaatcaacaggacaaaaattgcgactcctccataaaatagagcctcggtaaagaatagtataagaaaatctgtaagcaattatgaaaaaccatcaggttatgctgccatgcttaggcttcatccaaatgtggaatgggaatcagggacatctagtgtcttaagatttaagagtattagtatatacataaaaatctttaactaaagaatgctgcacatagggttcagtttaaacaaaaaatggaactgttatgagatatgtttgaatagaaaaatataaatttaatgtagaataacctattgtcaatcaagcactaattagtcatattccttctctagagtagtgcaaatacagacacatgggatatgctagtgctaaccaacacaattatcttgtttccgtcaactattgaagtatcaaagaaagcatacctgtcaacaaggaatcctcaaacacagctgagagtactttgcgcaagtaaagcgatggaagaaccaagaaggccacaaggatagttggaccaacaaaccaaactaatctagacgcttccttgccaggatgtggcacactctccacacttttcatctgataactactgccttgaaatgagatgaaccctgattttccattacccctctcagtaaaataggaggagctaccagacgcaggggaatcctcagtgctattatcggtctcttctaccggcaacgcatctgtggtaggtgaagtaattgactcctgtttgtccatagcagcgaaggaagtaattcgcttgatatgaaaccttccatcgtggttgccgtatcttcttaaagcatgccctgtttagcatgtagaaaaactaagcacaaacacagcagctcaaattcaatagagttttatggaaagtagatggtccaaggggggaaaaccttttagggcgtccaagtgctgcattctacccccatttactctctgaattggcaatgaccttgcaaactgagagataatccgtgttactgctatgttactaaagctacatcagacaattcaccatctcttagtggtcacagcatacagaatagcagacgtatatggagtgatagtgatctttcaaaaccaaaagtatatggagtaggcactagttactgtgaccattcttagcaatttcaagtgcagtactgcagtatccctgaaattatctgccattaatgtattatgtatcccctctgtgggcgactcggatgacacagcctcactgcatgatgccaccacacgcagggtagatttttattatgcctttcttttcgaccgggatatacacaaccactcacgggaaattctaccggcggccaattaaaaccctgcctaatccccaacccaacccaggcaagcaagacaaccaccgcgtgaaattctataaattggctaggggacctacttgccttggaatacgagtaagcggaggagctgaggcggcagcgaggaggcgacggcgcggcggtccgggggcggggcctgagccggagggcggggctcgcgacggcggccatgggcgcgggctgtctctcccggcgtggcgttatctgtagcagcgcccagtggccgggcgggcgggcggctggtgtggggagtcggggagggaggggaggccgggagggcagcgatggtggcctggggaggcggacgggcgcaacgcaacgcaggcacgggacaagtgcggtgtggccggttggtgcgcgaacgtcgtcgcggactcgactcgcggtttgctcgcctcgcttcgcttcccacacttgcgctcaccgcctcacacgcacacggcaggcacggcacacgcgcacggtggcatcgtgctcggtgtttctgggccaagtttgcaccgcgcgatggggtaggccgtgtggaacgcaaatggtggctgcgctacacttgggctgctattccatggtttggtgggctctgattatcggtctttcgcgtgtgtatgggccgtatggcagcttagaagagaccttcgtctctctctcaaaaatgagagagtgtgcgtactggagttttacaaattactccgtactgtactacaatagactgaaatacaaagaagaaaaataattgagtattggttgacggacatactatcctactaatctactattcccttgcacgttcatgtgaggtctatttgcacacgggtttgttttgataatgctcatattttgaaactggcacagatccgtagattctaaactttgtgtatatattcaaactttaccatggatttcatagatattcaaattttgtacgcggttttttgagcgacaacagttgcagggtgttgactgactactgagtagggcatgctatgtacgtcgagtgtgaggagggggattgtccgtcgccaaaatatcacctcaactatgccgcgagaatgaagtcgcgctagttattttatactactcaactaaatcaaatgcctctctaatggtcatttagatgacgttttgtccaatactttaatttggtataatgatagtcctattttgaccgaacaaaagctgaagcttgacactgttcttcagacttcgaaagaatctgcagctcataaagccggagcactttcacatttcgagccactgttcccagcgaatcaacgactttagcaatagaaacactgataccaacatatcacatcaaaaagttttgactgtttgagtatgagtatgattaccatcacaaaaaccacagggagcaaaccaccaacaagcgccgatccacagaagtaaatcaaacccgtatatatctggagtactagcgtatagtgcccccccaatcccaaggccaccgaggtgaccgcgcgcgccacgacacacgtacacccctcactgtactccactaagcccacgaggccacgacccacactgtgcgcgcgcgcggtcaaacgacacgtaccatcaatttgtacagttgtactacaaccgcgaccttattgtccgtggcattcttcacaccccggccggcgacgcgtcgacggggacggtgtgcctgggctgtccgccattcgccgacgacctcccgccctcgcgcacgctgttctccgcgaaccgcacgctggccgcgttgaaacccttctcgcgctcgtgatccgaccactcccggctgtagtactcctccgccgtggcccccttcctcgggcctacgagcatgccgccccactgcgggaagtagatgagcatgacgggcagcgtgcacgcgatgatcatgagccccatgtacttgatcccggtctccgtcttgtactttgtgccgtggaagaagatgtactgcgtcagcacggcgcccacgttgcccccgccgccggtcatcccggagatgagccccagcgacctccgcgacacgaacggcacgatgccgaaggtgagcccgcacgcggcctggacgaagaaggagaagagcaccatcacggcgacggacgcggcgaaggagaagtcgacgattccgagcaccacgcagaggacgccgccgatggtctgcacagtccacagcccccacagcctgccgcgcatgccgtaccggctggagagccagtcggagagtagcccgccgccggggcgggagatgatgttggccatcccgaagctggcggcgatgagcccggcggtctggaggttgacgtcgaagcggtcgtagaagtactggtgcacgacgttgtcgatggtgagctcgacgccgaagctgtagccgtaggtgagcgccaggatccagccgcggtagttggtgagggcgtggcgcagcacgttgccgaagctgtccttgtgcatgtcgccagtcttgtggagcttcccgtagttgccgccgggcatgtcctgcccgaacgccagcacggcgatggccgagaacgtctgcatcaggcccgggatgaagaaggcgatgcgccacgccgtgaacggcgtgctaccgatcttgtggatggcctcgtacacgagcggcatgagcagctggacggcgccgccgccgaggttgccccagccgccggccacgccgttggccagccccactttgggggccgagaacatggagctcatccagaactgcgccgacacgaacgacgccagcgagatgcccgtgaagaagcgcacgaggaggtaccccgacggggactggatgatggaggagcagtacaccgccggtgtggtgaggaggatcagagacgcggaggccagcctgggcccgaccaggtcgcacgccgtgcccatggccagacgcgcgaacacggcgcccgacacggacgcgatcccggcgttgccgatgtccgtggccgtgagcccgagggtgtcgcggatgagcggcagcagcggcggcgcggcgaacgtggacacgaagcagcagaagaaggagaaccacgccatgtggaaggaggccatgtgtggcctcgcgaaggagaagagccagaactccgtcgccttgaggtcggagtccaccggcatcctgaaccgcggcttgccccccgccgcctcgaccccctccacctccatcgccaccggcttagcctccatctccaacacgtggtagcaaggctagcagcttagctagtgactgtgtgtacgtacatccgctgtgccctgcgcgtcagctcttatagcatagcggaaagcgcggctccggcagcgcggcgcggcgtggcgcgatggttgggtgcggcgagagggcaaccggtggagagaaaatgaataaagatttcgggcgtgatcttacgcgaccggtgggaggccggcgctgccgtctccgcgctcgcgtcgcgggtttttgttggcgagcgggtgacttggcggcgcagtagggtcaccaagccgcaagggtggtgggccatggctggaacgaagggagattccgacctctgactttggaggtcacgtaagttccttggcctgtggaactgcctccctcctcggcacacacgaatactgtattggcggagaggaattcgtcgcggatttggattgggttcccccggaatgccaccaagtctccaactattatggcaagttttatggcagagatgactatcacatctaatattgtccatatcatcaactaatttattaaggacagctcatataatagtctcaatgcaacataaatatttattttattcactctcatccaatcaacctcactcttttctccttcctccttaaagtttgtaaagaggttgtcccttgtatgagggatggctcatcctctctctcatctactctcttctccacatcatcatttaaaattagatggcatctaggagattgtgcttaaataactatagtacttgccgttagctcttctccttctccagtctagttgacaatagtgctacgacatgataacctctgattggcgagtactgtacggataactaaactatgcaacactaacatgttggtgactttgtggtcattttaattttggaacggtgagatcagctcacgtttaacacaattatactttgagacgagctgttttatgtgttcttgtatgcctagtgcagtgaacggcctgtatcttttcatatctatattaacagtatgcctagttgcctacttcctccatcccataaaaagaacactcctaacatctcaagataatttgagtgagaagtaaaaataatcaaaatccttattattattgaaaaagtagtaacggtgataagtaagtaaaaggtatttaagaaataaaacttctcgttttatgtgttgagagtaggtgggatggtagaagttggtttttttttacaaaatttaaactgcaaaagttgattttttttacatagggagtactgctcagtatttttttttataaaaaataggatacagtgtactacttgtccttgtttttctgaatgtcaaccagttatagccgctggtttgctagaaaacagctttgcgcatgcataggacatgttaaaaaagggatcagttgtgcaagtggaaggagaaggacatcacgatcgcaaacgatttgcatgccaatatattactgcatttgaaagcatcaaatctcacggtatatttgcaaacgaaaaataatttgtagataaaatttttacatatgtgtttttaatgatctaaaagtaaagactgaaaaataaacttcgatgaaaaaactccaaatcaactttaaatttaaagttgaaaattttaattttggcttataaatataagtataagcgaaaagatgaggctgaaagtgtggcatcatgcacatacctcagctaggattgcgcagccaaaggacacaatcatatgatttggaagagagaacagaataactaatattcctcaggaatttgttccacgcgaaaaatattcctctgtaatggctggagatcctgctttagtacggataggaaacaacgtttgtggttggaagaaacggccaacaactagaaacattcagaatttagctttcaaaactacttatgattatgctagtaggtaccaaggtgcaaccagacaagtaggtgatgaaaataaccagaaattgaacgctgcatttgtacacttgcgaaatgtttttcccctaccttaaccatggcttctcatgctctgaaaagggcaagattaatttcatcagagttgatgacaaattgaagatacatatgcatatttattttgagacaaattcatttttgaataagtatgaacatttcaatttggacgaaaagtttccttgagctggccggccggcctggccccaagcaattcctggcaacagagcgacacgataacatgtcaaaacttgtgcactctataaaatggtgaagatatagacacgaagcataagatgtatagtaagtagctagcaagaggatcgaaatgtaagagctaaccccagctagtgttttctttttctttttcttttttggaacccttgctcaatcactgttaattagtggacatctaccaaaaagcccaaacttaaattccgggttaccaagttaaccaaaattcttgtgacggcctataaagtttgcattctctggatgtggatggcattgacttgagcaatggagtttgctctggatatatgtgtgacgtctcagcttgaaagctgaattactgtaataaactttggtcggaagctcttgagctaaaggctgggaaacaagttgatcccacaaaacacgatatcatgtggctcttttaatcttctgtacgtgtagcaactaacaataaccaccattataatatacagatgcttgtgcaacccctccgcggactgcggctgttccgcagatcgttgcaagattcttcctctgactttggtatctcgcgtcatctcctcggctttttgctgctaccaaaagtctctgcatagttaaatgtgagatacatttggggtacttatatatttagagcacatccggatccatggtttgtacggaacacagacgatgcaagggattttctgaaatttgaaaacctgacaattagatcattcatgaagatgaaggacatggatgtcaggggcgatcgattcaatatccgggccagtatatgcatcttgtactagtagactactagtttcaacatttcacgctgatatgattaggatttgtgcaagaattgcagataagacggatatcccttcagttacgtttcgtgactagtatacattggactgaaattattggttccggccggacatttcctgcagctcgtatgaacttgctaagcaagatgccaacttgctatcccccaaattgtcaacctcgccgtaggttggcatccaattggcagttactttattgacctgatagggatggccgtgtccttcaactccagcttagcggtgaccccagcaggtgaatgtggcaactcggatatcccagccgcagctagagctcctctcaccaatcactagctctctgttgcatcatcattaagtcatggtgattagttaagataaaaatgacgtattgtgattagtttagcctgcgatctcatgctgtcccagcttgctctgaccaacaaagattcaagataccgtttctgcactattgaactaccagccatcggttgagacgacttagatttgatattattgattcatggcttggcttgagtttacttgggtatccaatgggcgcctctggcttgctggttcctgtaacttcgatatcttaaatatatataggtggctgtttacttacttaagtagcacatgtacgcctgtaatctcctcatcaaactttgaatgcgcagtgatagtcaggatcaattttgagctaaacaaaagtttgcattgccttggttaaattggtcgatggttaattggattgagtttggatgtagtggggacatacttctcgcaaatgtctgcgctacagtgctacctgttcattctccggtagccatttgtccgtagcacataaataaacaagataataccgaaattaattagggacataacttttttaggagaaaactgtaatgcttagcacaccactaaacacgccgaggccattttaaggccgtagagatccctacgatcatggctagccatccacgaccaaaccgcaaaaatttacgccatttttggatcgacggccgtcaagtcccgtacgtcttcttttaccaccaccatttgatctgtttccttctcagacaccaaaggaacttgttttttgtatttttcttttcggtagctactttctacatctctcttatttggatcacgtattatcctttttcattccacgaccgacgaccaatgttccgacacctcgccgccctgatcctgtccgccgtcgtcttggcggcgtccacaagctccggcgtcgtcgatgcccgtcctgtccacaccggcccgtaccacgtcgtcatcagaaccgccgccaagcccagccgtcgcctgatcgggctcggcggcaatgccgcccatatgccaagaggtatagc

SEQ ID NO: 21164 - DNA, 1338 bp, Oryza sativa
  unsure (1)..(1338): unsure at all n locations
aaggcgctgtgcggcacgctgacgacgctgccgggggtgatgacgccgcagcagtgctgnacgcggcgttgcgggtggcggagtccaaggccatgatggcggagaagcggctggccgacgtgatgaagtcgcgcgcggtgaaggccgaaggcacgagcatgtcgtcgacgctcgacacgtgcaagggcgcctactcgtcgctggccgacgcgctgcagaaggcgcgcgacacgatcaagagcggcggcagccacgacgacctgatgaccgagctgtcgtccgcctccaccttctccaccgactgcggggaagccttcgacgagttcccggacctcacgtcgcccatacccggggcgcagcgccacgtcaaccgcctcgtcagcaactgcctcgacctggctgccaccatcaaagaaaactgatcgatggcgtggacgcacacgtgccgcgccggccggccgcgctaggtttgtaggctgcttctggctgcaggcgagcgtgcaaggctacaacgacacgtactgcatgtactgcgcacactctgccttttcatgtacgtatacgtgtgtactagcgtacatggtgtctgtatgtacactggtcatggggagaatggggagagcatgcagtgcgtatgtttttatcaatatttctcgcagcggcatatataggcgtcttggtcttggagattagcaaaaagaaagaaaaagtgttgtagttgagtccgggatatatttgtgcatcagtgcatgggaggttgatcgcccagaaaggtatatataatgtacttccttattaaatacaagttactacatacaaatgtttttttttcttcatcgacatttgtacttgcaatgagctctgagcttctctctctgatggagttaattattgaacctgatgatataccataatgggccgcacttctgtcaccatcatgttccggcccaataaaaacaggctgtacagtcatcgatacggaccacaccgacggcctagcataaaagaataagttcagtccaggtctcgtctttacgcggagtttgaatcacgaccataaaccacaatactaaatataacatgtctcccaactatcaaaaccagtataaaaataattctcataggatttgaatggcaatttttgctgacgtgacgcctacatgactagtttgaattagttgttgtctaatatgccttgacgagtcactagaaggaagactaaaaaaaaaaagttgaaccaaaatatttaagctcacgtgtccggaataaataaaaataaaaaagtagtaggacccacatgtcagtgggttctactctcctttctatctgggctgcagg

SEQ ID NO: 21165 - DNA, 2477 bp, Oryza sativa
cccatcagtacatcaagtatcaatatcataataaacaaaataaacaccgctaaggtaaagaaaagaattccgaaacaccaaacgagtcttcttttttaacggggttaattaacaaaacagggaaatatttttgaccgatgaattgaagctgccggggtgcgattctacctgggtcggtcttgaaacgaccccaatcaaggtacttcaatctttcaacctactggaacctcaataatgtatatgattacctcaataaagtaaagaaaaccaatctctgaatcaccaccatcagctatccatccttttgcttgctgaccatcttaatgaacaggaaaaaaattactccaaattcattaactaagaataataactccttgcactttccaggctcattcagcgcttatgttgctagactaccaatatgctgatcaagctgcatctgttcaagcaatgctccaataacagcagcttggtcatgcccatccagcggggcattcagactaggaccttcaccgttgcttacactgggaggcatcagtggtgaaggtccaacaaagtttatggattcagcagtagtgacttgcttctctggtggagattccttaaccagtgtgtgtacccaagagagatctggatcatcaccaccagatctcagctcaaacgatgatgaccggcgaagcttgcccaattcttcaccattaacaccccagtcaggtgtccctgaaggtgatccccactttgaccatgatgagcttagaggggagccaacaacacctgatgctcttgcagcactcggcccaagatcacgagaactgagacttctcattgtctgctgttgcttctcacgctgagcaagagcagcgcaaagatgagagttcataggggacccagattcaacacatcgaggagacatgcggccaggggaggatataccaagtgatgcttgcaacagagatgagtgtgaaggcaactgctggttgtccacagacttcggggagaagactgtgttgattggtgaaagaagtgcctgctgctgttgctggaactgattaaggaaagcagccttgtgagatggtgaaaacataccaccctgatcagcattactatacctcggggaagagaccatctcagcagagaagagatcatccaagtttgacggatttagggacttggtccgagacgtgtggtttcctgttgatgaaccaatacggaatagcacaaatcatttataagctgtgaatcaatatcctgcatcagggagtaatcatcagcaggcatatcccttgcactaagtgaggtacggagccggctcgactgaggctgctgcctggaaggtgtagtgtcggaacatttggctgctgccagcccaatgaagggggcatcccattgcctgaaggggacattggtggtgtaaatggggacatgactgctgaaactgatgatggagaaccaggcatcaagcccattgctgcagccatctccattgtagctgttgccgaggctcttggggatggtactgcagatccagtggaaacatataatgggcggagctcatcagttgtatgcgcaaagaaacagacacggcgattacagcttgtgccatccttgcaaaggcgagtacggtactgtgctggatggagccaacactcgaacacgccatgagcatattcacacatgtcaccacgccggcaaactccctttctaaagtcggggcatggcacacagctgtagtgatacttgcgagggtcccgacgccgtgcgttctcccctgggtgaacaaacgggcactcagtccaatcatgtgagtacgcccgcgagcatggcctgatcttaaatgagtacatgcggaactcatcggaagcatagatgctgttcttgatatcgggaagggacggatccactggatattctttcttttccgatgtcacaacccttggaagatctgcaaactttgtcgtcatcatcacagcagctgatggagatcgtgcatcttctgctgtaggggatgatacaggtgacaacatagagtttgcggcccttgtcaccacccggagaacgccatgcccagcctttgggcatccaagaagatcttggagggcaatcttggcgtcaaacatctttggaggaacagagatcacatcagctggacgatatccggaagcatccgtggcatcagcatcagccccagcagcaagcagcagcttgacggcctccacacaagacggcgagccaccagacgccgcacagtggagggcggtggtgccgtcggagccacagcggcgattgacatcgacggacgggagggacagcagcaggcgaagcaccgcgaggctgccataggtggccgcgaccatcagcggcgtgcggtgctcgaggaccttgcggcggccgtaccagaggcccgcctcgtccgcggcggcgggcggggcgcgctccagcgcgcggcgcaggccctccgcgtcgtcgtccgcggcgag

SEQ ID NO: 21166 - DNA, 6013 bp, Oryza sativa
aagcatggggcgcggaagcgagagagagcgagagggggtgggggaagaaggggggcagtaaaaaaaggggaaagtgatgagagagaaagcgagtggtgggtgtggagactttcggagttcccgcagtacgcactctctttctccctctatctctatccgcagcaattataaccggcgggtgtgggactgtggttaaacagggagtgaaaaaacaaaaaacgggttaacagtgctaggcacatagaatatccttaattaattaattaattagttagttaccaaagtttttctagtatgagtactagaaatatgaagaaagtttggtagtagtactacattttgtaggaagaggttattatcacctattcgctttttaaaggggttgggtacaaccttgtcgtttacagcaattgaacgtattattgcacagtgttgatagccattttaatttgggatatgaagaatgctatatgtattatttttttttcttacaaaactcttattaaacacagatgttgcctgtggatatgttgtatgagttgactagacgagaagagtaaagatttggttaaaaacttaaaagtgtattattaattcttatggtatcgattaagtgaacaccaaaactaaaagtctatttttcatacagaaacttcccgtttatatttaatatcaaagataaatttgattcatatatatactattatagaaattaaagatgcttttaccagtattttggtacgtcatccgcatttgagttggtttttaagttcgttcacttttgaaaatacatgtatgtgtttgagttggattttatgctcgtttgtttttggaaatacaaaaggagtcgtataacaaatcattttttttaaaaaaaaactcatgctaactttagatgaaatacggactactaattgcagctcacgatttcctaaaaaaatattcaagcgaattctcactgtgaattttacctaactaaaccttataacaattataaaattaaaatagcatttatccgttgcaacgcacggatattttttctaggaactataaatttactgtattagaaaaatatcactactattcgctaaacatgttgtgtgccagtgaaaactcctaaaatttgaattatcgttgtcacgtttccaggcatcttctcctccaaactatagagaggaaaaaaaaaacatcaatggtgctgcgacgagcttgccaccgttcggagacctcgttagcacattgatgagctcaacggcaccggtaaatatgcttgtgctgtggtaaaaaccgttgccggacttgccatctccgagatttggccaccgccatgtcgagctcgctgtcgttgcacatcctcccccttctacgtcggccgccactgttgcatgctcgttgtactatcgatattgagcagcagttgtatcctcctccttcccgctacagttttcgttaatagtaatgatttttttttctagtaggacggattttgtaatgatatggattaattttacgctatatcaaagggaacacaaatctttgaaaaaggcagtttctatatttgaagttaggcatgggaaaccgaatcattcctcaaaaaagttgagagtcagttgattcatttgcgcattaatttccatgacagcagaaattaggcacagatctttgatgtccttcacaaaggatgtttaagcagatctgaccatttttctcaaagaaaatgtcaaataaacctcttttccagcagaaaatgtaccggcaggcgtgttgtcaaatcaagtacactcctcgagccaccatagttttctcttctttctcagacaaacagtagcatctcatctactccggtgaagctcgtgccgcttgagttgagaagctgtcaaaaggaagtacttccagctagaccacccatatacacacacacataacaaaatatccataaatctctcactaataaagtaccatatcagtttaccaaaccttacccaagcttagtagttttacatggcaaaaggttaaccactccggcacaaagaagcgtatcgcgcgaacgatctacgctagtggggaaaatctgatagcgaccccgtccaggcatcgcaccagtgcccggtcggcgaccacgacgacgactactggagtacgtaaaaaaccgtagcaacaaaccggcccacacaagcccccccaccgccgcttcccgaggcgactccacgactcgaccacggcctctgccgccgcgtgcagatcggtccgagccaagccaaagccgccggcgcaacaccacgagaccgatcgctcctaccacccatgacatgagatgatgagaggagacgccatgagtgcgcgtccctttcgcggcggggtctcgtccgctctcgctctcgctcgacttctcgaaatttccgacgcggacgcatctgtcgcgtgtccgcatccgcgtccccggtgttttttcaccgcaagggggaagggggtggcgccacggttggtttggcgcgagccggggtgtgtgtgtgtttgtgtcggcgtggggcgcgcgtacggcgcacgtaaaaacgcgcgtggtccagcgggggatttgggcgcgatcggcaaactcctgtagcgtgggcgtggacaggcgccccgcgcgcccggcaggcggtggccgtgtggtgtggtgtggcggttcatccatcctggcgcgcggtgcgaaattccgtcgcgcgcgcgatggcggccgaggatatcacggtctccgggggtccgcgagctgctgctgctgcgtttggggttggcacgcacacatgcagcgattggtgccgagcaaaagccgaacctgctcgaaattcggttggcaattgattggggagtttgcctgctcggtttgctttgcttcgctttactatttgcttgtgcgagtgcgacactggcctaccacgagagcgtggcccggccgctggcctgcctatcccagggaagagcggagctgccgtgcgtggcaggcaggcagggccggccgtgctacttgaggagttgaggtcatcatgtcctgcccgcacccagacagcggcactgtgttgacacaaaactctcacaaactgcgggctactgctggctggagtaggagagtactaatattcttcttgatcaggtgcgccagatagccagtggtgttgtatgctgcgaacagtctctctgcctttctgttagattagattagttagagattagcggaagagatgctgatagcgtaggattgagacaataacccaagacccatggcagcgcacgtgtttccgcaacggtatagctaagccagccacaacggggtcatgtgcgcaggctagagatttcggttatcctgagcgaccggtgacacggataattttgtttataatcacagggcaatttgctattgcaactcggctactaatcctagttggatggactaggtagcaaggtgaaaaacaaccccccaccaatgctgctctccaatcagtttctctggcaggtctcttttaatcatcaacatttcagaaacatgcatgccctaccaatgcaagcaaagaccccaagctagtaccatatgaatcatagcctcagggatcttctagcagctacatcttcttccaaaatcaaaagttttctcaattagcctagttttccgtctatatccacaaaataaactaaaacctaaaatctaggaaattcagctattttagattcttagaagttgtctaccaactatcaactcctcggaattttaagctactcaaatagagtgtttctttagagagagataggtattggagttaggcaccacaatcagaagagcaaccaacttggttgtgtggagtaaacatcatatgcccggcaagttcggcaaggacatggtggtcttgcccctcatcgaatcctttccgcttctgacgtgatgtagtacatataactatcattccctagcgcatcatgctgattccagggatttgggctggattggtggcggcccagatcagcttatctgttgtagctaaaagttgaaatttaaaaaatattttataaataattttatcataatttattggtctttaagtcactaaggttgtgttcgttcacgcagatcaactgaccttttaaatagtgcggaaaccagagcaattaattaacttatgattaattaattattataagcttaaaatagatttatttgaacttttaaaaaactttcatataaaaggtttttaaaaagggttaattgtattcataccactgcaaatatgccaacttaaaaaataccactactattcagcatatcggttatgtgccactggaatatgggaaaattggaaccatgccactcccgtccagttttctatcacctccgtcatctctttcccacttcattcgcttctccgccatggacgccggcgagccctccacctcggactcgctggtccttgccactgccaccaacgatcgagcatcttgtgtcggactcgtaggtgcacttctcctttgtttccgatcgagcttcttgtgtctcatctcatgccttgttttcttcctgctcgcaggttgagttgctctctgaaaaccctgctgcgcttgccaggtaccctgtgggcactgagtacgattgggaaggtatacaaagattgagagatgacgaacaaatgaactagatcctattaaaaccatgggtgccaccaatccccccgcggagggcgcgtggaggggaacacgacgtgatgccaccctgcgccgcagccgccaccgcgatggcgcagtcgccacgcagcctccacacgctaaccagcttcggccgcggcgccgatgacgtcgagatgaggtcacgcccgcgtccgacgtcggtgacgcggagggtgccgggtccgacttcgacctcgacttcgcgttcgcgccgccggtatcagcggccaagttggtgccggccgacgacatcttcgcgcacggccgcatcgtgcctgcgtacccggtgttcgaccgcaacttcctcgacctctcacctggcgatgtggcagagcctgcctccacggcagcgccctccaccgacacctactgcgcgtggacgccgcgctcggcgccgagctcgcccagcctcgacatcgcagcgagatcaacgagggggaattgcaactccgagacgacggcgaagggtgttcctgctgcatctacagtggtggagagagaggggaaggggaaagagaagagaggggaggaaggtggggcccatgtgcggttggggctaattgggatttttgacggaaaatgtgatggagtggcatggttctaatttctcccgttttgagtggcacatagccaatatgctaaatagtactggcatttttttaattggcatatttgcagtggtatggatccaattaaccattttaaaaacacacaccgttttaacattttaacgctaaaaaaatagaaagctatagtttagaacgagagaacacttcaagaacaacataagatgcaatctaaatattatgaatagctaattaagcgtaaaagaatggttgcgatttaagtggtagatctaatcaaccgataaatcaatacaccaactattagaggttgtgttgaaataattctccgtcacaagatttaatgacggttctataaataatgtgctaagagcctgcagaagtctctatgatgaatgaaaagtaaccaggaagtttattgtgagatgtaaaaaacaataaaaaacaaaatagcaaatgttccaggatcagttcataatatatgcacgcttaatatattagtctgtttgggccgaacacacatactaaaacatacacactcaacagtttcgttttccttctgctttatttgatcaatactcgtgcacttatactgtttgcatggcgatgaacatgcttgcttgtagtatcatcgataagtttccctttaattttcttctttacatctgtttaatttgttcaattttattttattacagctaatattttaagcgtaatggaatcattctttgttcgatgga

SEQ ID NO: 21167 - DNA, 933 bp, Oryza sativa
gatacagattttggttccaacacctgaaggatgtaacgctcgtataatgtagagagattcttgagaagcagaattttatttagtcattagggcctgagatacattccaggattacaacagcttttagggggctactacaggcatcactggttacatgcatatacagacggtaacacccaataataacctgaactcctgaaggaagatgataggatattaggtcatctaggacaacaattacgctggggttgctctgaatggaagcaaatccccgggtaactaagaccaacaaacacttgggttatttacatggattacatggataaggcttgagcatgtcgagttgtgcttcatacgtcgtccacgtcgcttcccccaacatgagcatcatgtgtaacaaagtagtggctgccatcaggaccagacaccttatacctgcttagcgaaaaaaggggatatggttttgaattccagagtaatacaagggcaagcggcttgatgcataactctttaatgttaaattgtagagcttgttgaaacacagcaaagcaatatatgaggttaagaggattacctctctaaaataaatttcccttccttgtacctctggctcttctcatgtgcagcttcctagagtaggggcaccataaaacttagatgctacgcatacaacatatatgacaacataaaataatcacaaatcttacatatttccatccaacaatggatccgcagccaacacagaagatatcagacacagtatgcattcgggtgatcatcatgcgatccttttttactccagaagtcacattgacacggcccacaaccaacatgacttaatcaaaagagtataatacatgggcggtccgtaaacttggaccagagtatcatctatgtctgtaaacttgtaaaatgcacatctagattgatccc

SEQ ID NO: 21168 - DNA, 629 bp, Oryza sativa
ttcctgcagccccttggctgtaaccttcatcgctgcatactttgcatatgcaggcaaaagaaacgaagagaagtaaagaaaggaagagaagctgagagaaagaaagagaagagacaggataagactgtgggacccacgaaaataataaaatatttatgttgagtaaacataaaatttcttcatggtacatatggactataatgtctactccctccgtcccagaaaggagaccttctgctcctaaccatttgtcccataattcttgacgctggcagcctggcagcctggcaggcactaacaaactcctagacaagcacacataaaaaaaagggtaaataaaaaaaaaaagtggggccatctaaaacagtactagcgaactctttcttctccaaacgatttttgctctgaagcgctaccttatcctctcctctggtattctcttcttacccatcgctcgactctcgttttcttctccttccacaccgcgtcttccacaccagcaccccgcttctccttaccatcagcacaccgcaccaattgccatccatgccccctcccccacccccagacgagcaagccatatccggtgtgcgacaacatgctcaacggccgcggcaacactgagagcg

SEQ ID NO: 21169 - DNA, 2787 bp, Oryza sativa
gtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcgactggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggccaatgtggtagcagatgccttgagcaggaagagttactgcaacgtcgcatgggtagaggaactatgctgtgaggttcaacatgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcatattccagaatggaagtgggaagaaatcggaatggatttcatcaccggtttgcccaggacgtcatcggggcatgattctatttgggtagtcactgaccgactcaccaaagtggcccacttcattccggtgcacaccacctactcagggaagaaattagcagaactctatctggcaagaattatgtgtttacatggtgtacctaagaagatcgtgtctgatcggggaagccaattcactggaaagttctggcagaaattacaagaagaattgggaacccggttgaatttcagcaccgcttaccatccacaaacagatggccagaccgagcgagtcaatcaaatactagaggatatgttgagagcctgtgcgcttgattttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatatcgggttttggaacgtagaggtgaagttgcttaccagctcgagcttccctccaacatgctgggcatccataatgtgttccacgtctcccagttgaagaaatgtttgagagttcctgaggaacaggcaagtccggatcaaatcgaaatccaggaagacttgacgtatgtggagaagccaactcgtatccctcgaaaccagcgagagaaagaccagaaacaaagtaataagattctgcaaggttcagtggagccaccactcagaggaagaggccacttgggaaagagaagatgagttgaaggccacccacccgcacctgttcgccagctcttccgaatctcggggtcgagattccgtttaaggggggtaggtttgtcacgccctgaagttttccccctttttgcttgctttaaaaatttggctaaataaatcgtccgaagaaattatcttaattaacctagagctaattccctaattaataaatgcaa

SEQ ID NO: 21170 - DNA, 1313 bp, Oryza sativa
ggttttgcgggtcgcccccatggcagtaaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagttttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaatttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatccgtatgtcaacaattgtcgtttgtgtaccctggctggtcctggacagggattcaatgcacattcagcttagaaattctggttcgagaatttctgggcgtgacatgtgccgtctacgtacttcttgttgttagtccaaaatacgaactcataattagtcaggtgcatagtggcatcctatcatgttatatattatgtggttctgtttggtgacatcttttggaatatatggttattcaacatcttattgaaatgtcatgcatctctatgaaatactagtgcttgtttttttattgtgcatatggacaatcaacttgttaatagaacctaggataaaacattcaaacaagcaaacatattatatatttagtttccacaattacatagacgacacatgtacatagatgacaa

SEQ ID NO: 21171 - DNA, 1023 bp, Oryza sativa
cgagtcaacattaacttgtactccatgtgcgatgcaaagctttgctctcttccaaatacgctggactgtacggatgctgacattgaacacttgagcaactgcacgtgtggtgtctttttctagttttccatccttactttttgcaagcaacaattcataaattctttgcctttgtgtgtttgtcaattctctagaactgttttcctcatttccatttgcatctggatttggatttgcatttgcatcttcttcttcttctgagtctgacaactcctctctatcaaagacaacattgacagtatctgtatacacgccatagtcccgaagatcatcctccaaggcttccagctcatgttgcaattcattgtcattgtctacaaaaaaatttacatggtaagttaatgtgtgttaatcagattgtgtagatttattcagtcctaaaatcaagaatgtaaacatgtttgtaactgatcaaagagtaatgaacttttacccagttgaatttcttgttcctcatttccatttgcatgcatatccaggtcatgctccatgtcttgctgataattgtctaaaaaaaactacttgctggtcagtgccgcacaaagaatattgaatatgtttaggatttgcaatgtcatgactcataactgtagtttacaatagtactaactcttccatatttccatatcaagatccatgacttattcatacatctgttcgtaaggtagcattgatttgttgtcatgctaattcagttatgtatttaattctacctctagctctatttaagttctaagtgttgacaagtaatttttttcaggtacttaattcagttcttgcttattttcagtagcaggtcaacaggaatattgtgtctgggactgggagctggagttaaggatgtttcacaattcaaatttcacaagtatgtgaccatctaagcatgattcaatatttcgcatcataaacacgtgatttgttgatgaatattaaatacttaaatttggcaagacgtgtgggttc

SEQ ID NO: 21172 - DNA, 702 bp, Oryza sativa
agatgtggcatgtgtatttttttgtgagaaaatgagaatatgattgttttcttaagatcctaggtggaaacaatgcatattgcagcttatatttgttggataggtcagttattgcatttgtttattacgcttatatgattttttttacttgaacgtaggatggagaaggccacaattgattcttcttgatcatggtctttacaaagaacttgattatgccactaggataagctatgcttctctttggaaggtgacaaattgacaatgttatcgcagttttttctatgatcacaactgagtagtcattactaactttatgaaatttggtgatgcaggcacttgtttttgctgatgaaaaatcaattaaagagaacagtgtcaaactaggtgctggggaggatcttcatgcactttttgctggtgttctcacaatgaggccatggaaaagtgtgattgacccggctgtcgatcatcttggtctagatggcagtagtaatgatcgttctgaacttcaggtgatttatattatgcattattaatgttctccatgactccatgaacactgacagtatatgtaactgtgcaacttcagtaataaccaatagtaccagtaactctagggtaatccatgtatcacctcctacttgaaatggaattcaatcatttctcacttttttattttgttcattgttgctcaaagta

SEQ ID NO: 21173 - DNA, 2760 bp, Oryza sativa
tcattccctctttatccgtgttcttctctgtagaaggtcaatgcagcatcgtataaggggcactctagcaagttgtacaaaaattcgagaattaattataggtccttttttggctctgtttacacgtatgatgctttgtcaggttggaggttcttcaatggaatcatttgtaatcattggacgaatctcttctgaggctgttttggaagctaaaaggatgagtagtagatcaattctgaataaactaatgatatggctagaggaaattttactggaagctcgattctttagtttgaagttgctgttgtgttttatgcagcttaagaagttattggcctgttaagcagcagatcagcataccaactattcttggactagtgtaaaatattagaagctgtcattttagtttttctttttgagagagaaaagtggcatttagttgaaaaattctttttctctttttggtatacaccattctttttggttaaccattttgctaccaggcttttcattttgattagccacttccaaacagaagatgatgccactatgacatcgtatgtttattctaatagatggatagaattgtagaaaatcccatcactgcacagtgtatatatataactctagttccatggatccagcaaatgttggcccgatgaatatgctgtgccaattgcgttatacaagatgtaagagtaaaattgctactggaaagagagtcactctgacatttgccagagcaaatttcgtttggtcaaatttgtgttcatcgtgatgtcgatctccattttctttaccccctacttttctgctagcattttatcgttgtgctgatgttctgcacttctggttcatccttttgagttccgctcctactgtcacgttgacacgttctatactttgtcctagaacatatcatagaccactagaaatataaagcacttaaatctgaaatacaatatggcttgtagtagttaaccacttaacgatgcagtgtgtaactaacacggtatttttcttgaaaaaaatgtttattttgaaattcagtagctcaaaaaactgccacagattgccgcagattccccaagcatttgttgcaaaatctgccacatctttgtttccgcatatttctgaagaatttggaggtaattggattatggagatcatctacgatcggaacgtatgcatcggtgacagttttactgagccgagtgaaacccagcgattgccaccgctctatgcaagcaaacatcgtcgccgatcagccgaacagtttgggctcccccgtccgccaccgttgcagttgcaggcccctcgccgccgttggccgccggtcgcgtccgccggtgcttgatcatgtgcccgccaagcgcctgccccgtgaggcacaccttgccgcactcgtcgcacttgtgctgcacgatcttcatcttgcccacgtcgctatcgccgtcgtggcttgatgcaacgacgacgccggcgatcttgtcgttctcctcgccgtcaccatgggcgaccttgttgttgcccgcgtccccgccggcatcaatggcagaggccgactcggccttaccgtgaccgcggctttcgtcgacgtccgcgtcatggcatgctgcaacgtcgtcaacgacgacggggctcttctcctcgtcgtcgtcgtagcggctgccctcggcgccatcgcatccacgctcgtcttgtccgttgatgtcggcggcgaagaagctttgcctttggcttgctggagccacggcctccgtgaccgccgtcgtcgtggcgtcgcgcgctgcggcggcaatggcggcgttcttggctttcttcttgtggccgaggacatgcccgccaagcgcctggtggctgccgaagcacctcccgcatatgctgcagacgaagcgcttggaagctctctccgccgcctctgccgccgccgccgccgccgccgccgaagccgtttgcaaaccctcgctcgcctcgaggtcagggcctctgcttctcttgccgcgcaccggcggctgcggctgcggctcctgctcctcgccaccgtcgacgaacctgcggcgcttcctgttcttcgcctgcaccaccaccgcgatcttcttgggacacacgccgcgcggaggtggcggcgccgccttatccgaaccatccagctcggccggcaacaatggcgatctgatcaggtcgacgagtcgagccttcttgcgtgataccttcccgaccccgcggccgcggccgccgcctcctgcctccccacgcggcgccattgcgtcatcatcatcagagctcccctcggcgtcctcctcctcctccgccgcttggccgccgctgccatccagcaacgccggctggcgcggcgagaaaccgtcatcatggtcgtcgtcgtcgacgacgcgcctcttccgtttgcaacaacccgttccttccgccccggcgtcggcttcggcatcgtcgcggtccaccggcggcgcgggctggcgtgcaaggaacacgtagcggtcgacgtcgtcgtcgtcgtcggaatccgagtcagagcagtaggggtagtcctcgccgacgacggccacaccctcctcgtcgtcgtctccgtggtgcccgcgcgcgcgcgcgcgatcgccggagttgacggccatctctctgcacgtgctctccggctgcgccgcgcggctgttgctaacgccgaaacgtgccagtaggtagcgtgcgtgcgtgcgtgcgagccctaataccgtgggtccgtggctgcagtgcacacacgag

SEQ ID NO: 21174 - DNA, 9757 bp, Oryza sativa
tacaagaccagtgccttttcatttcgccacatcggtacaaattaataatatagatgaagatgacatatgcaaggtttctagtgatctactacccccgtccataatataagagattttaagtttttgcttacattgtttgaccactcgtcttattcaaaaaatttgtgcaaatataaagaacgaaaagttgtgcttaaagtactttggataataaagtaatttaaaaaaaataaataataattccaaaattttttgaataagacgagtgatcaaacagtgcaagtaaaaactcaaaatctcttatattataggacggagggagtagtagatatattgttcgactccatgactcatgactgcgtataggtattacagagaatactcctgtgttagtactactccagtctaatcttgttagcagcacgggaattcaagaactctgcacactcgacatcccaactggcatcaaaacagacgcaatcctcctcacatatatccacagcatcatgaagatactcgcaacgagagataacatcttcagttgtcgtgccacttgatttatcgcgagccatttccagaaagtcagtgcggccattgtacttctctagatctggatggacaatcttagccccttcacactcacaatgataacaacgaccttttaacaaaaataaacaagggaaaaaatggcaatcagttatcgtaatagaggaagaaaaaaaaatactatatcatagcttgcagaagataaggatacatcagtgacagcagcatttagcaaagcagtaaaggtatacacatgtaaagataaggataaatgttttgaatgtggatgaagctaactaactttgttattagaggaaatgatcaatggaaattgtgctgtatttcacaatgttttttatatgacaatgatgttaaggagacaaggactgagtatgaattagttagtgccatcgttggaaactgtcaaggcgatacagtcatggagttgctcatcatggtcaatctgtagttctgtactgacaccattgttagcactaaatgatcaagcaaattgatttatatcacctcagacaatgtctgagattaaacatagattcacgttttagttgttactaacattttggagcaaacagcagaattctacttccaaaaacattgcttggtttgaacaattctaggcatgaccccaccaaacaatcttggaagtttgattgaattaatttctgtggcatctcttttaattaaaaaaaagaaaccatgcaaatcaacacatgtatgtcctttttgttcttttcaagtcaagttctgcagcgtaatgaaaatcttttcagtcgatttcacaacgccatggtgaaactcaacacatagaataaagaaacatctgtaacacgctaacatcatatgatgtagcaatactcaaatggaaggagagtgtaccaggatgccccatgactggacagcaggtcagttcatcgatcacgccttccttgttgcagcactcagcaaaaaaaagtatggggactgtctgagaagaatgcaaatctcttgggctcgccaaaaagttgacgtgagaatactgagatttggatcgatgccggctatatccaggtccataatgtcggccaaacatagtataattaactatgtgtgaattcaagccacagataacatgtagctcatactcaagtccctatgattcagaagtttatacaagtgaattagataatcttgatattgacatttttggtaatggtcgaaaactgaaggggtgaacggacataccctagtcctctggttgtatttcttcagtgcatcattaaccttcccacaaataaaactttgctcagccttgaactcttcctgaatgcacgacaaagtcatggaggccctctcagagagtacaggaactgtctgaactgaaccacaggaagaggggcagaatcgcatcagattgtgcacgaggagctgcacatttaaaatcccaccagtttgaaacataaatggatctgtctgcaggggaaggggcttcatggaaaaggttgacatgaaaaacttcactagtgcatcaggatcaggatgatgtgctgcggtggctgcaaccatgcaagcaaggtctaggcccaacatgtttctctcagcatggcattcttgccttgccatttcaaccgctccccaaagattggcgcccgtcaagaacaggtaacgcatagcctgctgttcagagattgtgcaaaagcaagcgcggaggtatgcaacaagagcattgagggagcggcacgcgacacgaacaaggcttcttgagcatgtcatctgcactgaaacctcctcttgtggtggaaacatggtctcataccaaactgtgttgaggacaatgttgtgcacagggttctcaaaggggccatagcagtggccggccttgaggagccccctgtggtagcgcattcgcaagccatccatcggcaggcaggcaataacatcaaggtacaatccatagatcttgtcaagcaggatgctcttcaatgatttcatccgcacaaacggcggctgcttctccttaatctcaagtgaccgaggaagaaaggtagctccaacaaggtccactggttcttgttgctggtgcttcaccaatctgctgatgttcttgacggctctgcacgagaggcaaccttccatgcttaggagattggaagcctccccaatctgagaagcgatggaatacaacctctcgacaagggatttggggtttgggtgccacccagcaatggcggcgcaagtgagggctgtctcggtggtcagcgaggcgaagctgaaggcgtcagagctgcggtcctgctcgatgagccgcacggcgacggagaggtcggcgtcggccagccggagatactccagcgcctcacaggtgtggaggtaggggaagtagttggtgaggaaggcgacgagcgcctggagcgaccgcgcggcgacgcccatgtcgcggaggaggcggtggctcggaccgcagccgccgacgttgctggtgtcggcgacgatccgggagagcgccttccgccgccgccgccgcgtcgggatcgccgccgacttgccgtcgggatcgccgccggcgaccaccgggacgcgcttcttgtaggtgatggtgttgacgacgatgttggagacggggtccaggaagccgacgcagaggccggccttgaggaggcgcgggagcagcgccggcatcgcctccacgggaagccggtccagcgccgccgcgtagaagccattgatggcgcccagtagcttcgatcggtttcgtctcatgcggcccggtccgtcgcattcgaggagagaatttttttcattttttagatttttttaatatttaccgaaataatctatcggcaaaaaatttttgcaaaaatagaccctgccgccccagtggtgggcggcaagctgacgtggcagacggcggatcgaccgcgccgtctaccgccgtcggccaaaattgcaattatccccaatgggcggcaatgggctaattgcaatttttgccgcccataaagaggttgtgctcgtactttttgcatttgggcccaagggacccagatgcaaaaagtacggccaaacgatttttctatgttatgttaataataaataaagaagtatttattggtaaaagttgttaatattgttataaaaatgtattgaagttggttgtttcgcaatttcatatgttaagtaaggtattattttgtaacttattcgacgtattagtactcggataataattaataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaaccgctacgtgaggatccctctcctctctcaaaacgcgctttagtaaccctgtattgctctggtagttcaagctgcacgacacggctaggtggagttagaatccttctggtgtctatccattctttgtattgacatctccttggtggttcctaagaggaaagaatagatgtaaagcgagcaaagttagtaaatgttgtgagaaaataaggattcatgtaatcaaaatattcttaccatgaaatcgtcgtcaagaatatttggacaaacaaagaacgttcgacccaatgttgtaggctttatggaacgaagaacctgataacgatcaccacacctgcatcttggacgggcttcccatggagggagtgccgtagttagcacccgccagtcgctctgttgttcacgacattgtcgttcataagccgcttttctccgtaagtattgctcagtactttcggatgcgaaataccagcgaccttcttgtaaacaagtggttaggtcgagaacgggattttctgtatcgacccactcgatgtatgcgcaagctgtagtgcgggtctgccgaatagagtagtgttacgaagaataaagcgattgcccatacggaatgaataagcatatacatataataaaatacctcatggtcatagttagggcacctaaaaaagcgccttcctcgaatatcaggattcctcgaagccattagttggcatcgatcaccgcataggcagagaggacgctggcaccaaggtggtagtaggtatacacaagtatcgctacgccagttcggatcctcaacacctcggcgtgaacgtggcggggcatagtgggtacgcctaattgcgccgaaagttacatgcctgatcggcgccgaatgttacattggtcgtatgcggcaaatggcgggcaaatacttgtatcgcacgcgaataaaggaggctgcatcggtgcggcagaaagtagtcgtgcatgcgctgaaaggtatcgtgcatgcgccgaaaggtatcgtgcacatataacaacaacgtagtcattatacaagcatacaatactggaaagtgaagcaaataaacaaagagaagactgctctactggccctgccctacgccgcgaccacgcttggtcctccgggcctgtgctcgcacgtggtcctgggagtaggtgaaacgatccggtggcacagcacgggtagcacgagtgtctggcggcggagtggcctgcgcctggtcctgtgtctgcaccagcggtgcgcctcccagctgtgaggggccgatgacatcctctgtcgagcctgaagcgaagtcgaagtcagtgatgtcgaagagcaaggtggaaggcagcaagcggtccgacgaggtcccagcatggtccagtggtggaccctgactcgacgtgccggctgcctatgacgaagtcccggtgtactgccagaactgcgctgagtgcgaggtcgacgcagctgcctgagacgctgaccctgcagcctgggagaagtgggcggcctgcgtcatagcgaactgggcgaaacctacacatcgacaacgggacccttgtaagctaagacataaaatgcatataaattgattgtcgaagtaatgttgttatttttaggtacctatggggggcacaacagaaggcctagccgaggaaggcagggtgctgaacggtgcacgaaaccctgaagcaatcggcaagtgaaacggctcacatatatgtgcgaggcatgtatagaaaaatccttaaaaatacttacctccgtgcggagggggagtcggcctaggaacgtgcgcagttggacggggaccagtcggtacgggtggccgctgtacagctgcgtctgcccgagtaacgttgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaatgacgacccggttgatgtcgtcgacctgcatggttaattttttcgtacatattcgtaaaatttgacgaagagaaagatatgaaaacataaaggaatggtgcgatgcatggtactcacagcacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgagcaaccagtcctcaacaaaagtcgctaacttggcgggccagtcgccagctgactgctgacccttgcgtgagtaactgcgaattaatgtgtcatattagtgtgaatcgacagatgttgcaaattattgcggacaggtagattttaatgcaacaactgaaagcgtagtgaaagatcttaccggtgaacagcagctgggacggtcgtcggaaacggtactggaaagggctgacggaagccgaactgccgcatcacgcggaaaggtgcgtgaggctcaacgcagatgtcgtagaccatcggaaccgtagtcatccagtacgcctggtccctggtgcagagtgtggacagacccaacggcgcctggggctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgagaagatcgatgcaacgtatccgacgatggcaccacagagtacccatcgtagggtagtcgacctctggtcgctccgcgtacagtgacacctcatacgcgtgctggtccacctcagggcggccgatcgcaatcgtctcagctgcccagatagaaagaaagagagggcacccaccaaaggtcgcgctgggatccgtcttcgtgcaagcctcacaaaggccacggtacagagccgccaacaacgcggaaccccagctccactgaggcacctcgcctaccgcggcgtcggcgatgctcctggcgtagtgcacgagtcccttatcgaccgcgtgcccgtgaccgccacagaacatcacccagccaaaaagccagagcaagtacgcctccaaacagcggctgtaggagtactcgtcggcctccgcctgtagctgctcaatctgcaagtgttcgataaaatgttaggcaccttaactgtggacaaaatatgtagtacgcttgtcatttcggtacaaaaacactcacggagaactgaagcagccacctcttcataggtccggtgttgcggtggtgtgccaacggctcgagcgggagatgcggtgcgcgctgtactagtgcgaaacgtgctgtcagatcgtcctgccagtccacacccgtggtcactggcccaacatcgtctcccgcgagtggtagccccaacaagtacgatacgtcctgtaggataggggctacctcaccgcacggcaagtgaaaagtgtgcgtctctggtctccatcggtcgaccaaagctgctaggagggaccggtccacagtccatcgtctggccgggtccgcatcgccggcggcagcctccaccagccgacacatcggtaggaggccggcctcacgcagcctgcaataacaaattaatatgtcaatataaaaattattacaacgcaactaatttatagtaatacacttttcgtacctctcgacaaaggagtcgtgaaccataagtagctcaccgcacgtccgtgcccggaacgtcccaagctgagccccctgcaccgcagtaaggtgagactggtgtcggtgatctatcgccgggtccaacaattgaggtgtatcctgacgtgccatctctgaaaaatataatgtttcgtgttagaacaattcaaaaagtagtaatgtcaaacaaaagataacttgtaaaattataaaatagtaataaaatcatgagaataattatggaggctatttaaatatagcaaacgttactaagggtacataacgatgacgtgcaatttaacatatatgtagagttcgataatataacataacataacatagcatgacgtgtcgaagtccgacattacatcagcatacctaaagacactaggtgccttagtctaacgttacatcacgagacctaaagacatgacatgtcgaagtctgacattacacgacgaaacataaacacatcgataagttcgaaacaaattacaagcaaagccacatgccaacatagaacataagaactacaccacgtagctagacgtggcacgacgatgcctaggacgttgtcgagtggaggtagtgccttcacccgtagggcgagctccatctgctgctgatcctaatagtcctgcctctgccacacttggtttctccttgtctttaggacaatgcttgtaggtgtgcccacgttcatcgcatttgctgcaatgcttcaccctgccagcctccgactcgtccatatcgttgcggatgcgacgagtcttcctccttccagccttgcctcggagcttcgatgggtcagaaatattgagtacttcatcgttagtctctatgaactccccagctatgccgaacccataaatctcgcggcccggggacctttttccccccccatgtatgatatattgcttgctactgaagtactgtgaaacatatactgcatctggtatgccacactccgctgcggcagcaatgacatgggtgcatggcctgtggagcagcttcggctttgcataagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggccttttacgcaactcctctagctttttctgcatgaaagttccaaacaaaatgctgttgttcggcatagagggaagaactgcctggaaccgatccctaaaatacctgcatgtcccatgtaaaataaactccactatgccaactagtggcagtccatggacaccgcgccatcacccagttgtaaacttctgccaaattggtggcattatttcttatctagaaccacctgtgtcatacgccttggcccatttctcttttggttcatgcagaatccactgagaaaatttccgaatctccaatccagttcttctaaccaatgttggactatccgttgggagaggtccaagagcttgaggagggtcagcatcggtggtcgatggagccgctgcacgctgatcactgcatttggctatcaactcatctaatcttttccaaagctcattgaattttttctcctggttctgattgcatagcctcttaaacatgttcatgagctccttgttcttgaattgcttgaagaaattagctcccatatgacgcatgcaccacctgctctgtacatcttcccactcaccagggtatcctcgttccatactcccaaactgcaactcttctatcgctcgcagaatgccagcgtgcctatgatgtatcaggcacacatttggcctcataccaacaacttttgttttaaccaatttcaggaaccagtaccagctgtcggtattctcactctcaacaaaagcaaatgccaagggcaatacctgat

SEQ ID NO: 21175 - DNA, 1805 bp, Oryza sativa
gcatgtagagctaagaacgccctttgcagcacactctggcaaggatgttcaattgaggggaatttcttcactttgtaagagctcccagggtttctttcctcgataacaccaagcaggcggggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccggttggacttggcaacccaaaactctctatgaagtgacactgcaaaatgttttaccgcctccttcatatcttctgctctactataaatcgctccctgaataatctcattttctttgtactcccatctcacactatcctcttcagagacgaccagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacacccccgtcctctcgtgcgttgacctcctccacagaagtctcatttacttcagcacttggtccctcgccatcatccatgttcatctgtacacatggatccttcgggtgaacaaacggaaccatagctagaggccacccacgttgcaatgcattttccacataccatctccatactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatttgacagatctaccccagttggcccgtaacggacgtttcctgggccatggtaaacttggaatatttgtttgtttgacatatctgtcaacgaaataactagatcatattactctttcatgcaataaacatctacaacgcaatatcttcttgtgtatgccaatgcaacggtaaagtattaattccaaactagcagatctacgtagttaccgatatctacaatacgcacttctagattagtacaactaaaaccctaaaaatataatgtatttattcaaacaaagttttaaaaaatacacactatttaactcaatagtcacatataggatctatgaatattacctgaaatcggcgtctgaatccggcagggcttcgccccttcttctcttctcctcccctttcttctttttttttcactggatttgagggggaggaatgagggctgggggctgggcagcaggccttttataggcagcgaggcctgccgcccggccagagggcggcaaggggccgctgcaaaatggccggccccgactggcttttttgcattcgggcccctggcggcaagggctttactgcaaaaaaccctccctccgtcaccgcccgtccctcccccgtttgccacgtcagcttgctgccccacaggtgggcgggagggtctatttttgca

SEQ ID NO: 21176 - DNA, 15038 bp, Oryza sativa
ttaatgacttggattattcacttcatctctcaaatataatggaaggtccggagagcctatggagagcctatgacaatagcgccgtccacggcgatcttgggctttcggttcggcgcaatcgccctgcgccggcaccgaagggcttgtgcggaatcagaaccagcctcgaaggggatggtgtggtaaaaccacctcgccatccaatggcggtcccacttcgacatggcggcgttcaccggctagagatcggaccgctcggggcgaacattaaagtttacgctcccgaacactgtcttcttcgttccaactggggtaatcaccgtcttcgaattcacggtggcgaagaatatggcgccgaagagttcgtcgcttggctcaaacccggaagtccggcacgcccagtcgaagatagcgatccggaccagcgccgacgggctcaactgcgggagctccacctggaaaaggcgaagaatctccggcaacgagttgcacggaaaccggagccccgcctcaaaaaacacggcgaagaccactgtccggttgtcgacgggcttcggtacaacggctttccccggggcgaaagcctgtccctcgactaacgccctagagctgaccaactttgccagctcactatcgtttatgagagaaattcctaaataggcggtggtgtcatcgtcaatccggccggggtcgggccccttcgccgaagaggggttaggcttgcggggagccatgacgaaggacgtatgaagtggcgaagtgtgtgtgcagtggcgaacaaggggagtgagtgagaaatctaaagggccaaggggtgccgtgagagcaagaacggagaaagagagtgcgagcggtgaaaatggcaagtctggcggtgaaaagataacggggaagcatatatagcccaacaaggcgacgattcgcctacccaccagtaataaagcgccacgtgtcgtgagggtaggcgaaacggtaaattcccatcgaccgagctacacagtaaaaagcccacaaagggaaggcccattactgttcctttcggtccggtaaaaataaaaaatatatatcaccgtccgcaggaggcgaagagcggcaagtcaataccagccgcacagacaacaaactttatttgcaggaacaatgtaggtttcggcaggagcatcggttgaaagggggcgccacataccataccacataccacatgggttgcatggtctcggccgaagctccaatctcacccttgcccatgaggggcttgttggcggtatggcatgaggcccttcgaccaaaatctgccgaaggttatgcgaggggtggggatccaagcccgaaacgtcaaagttagtcggggcgaagccccccccccccatggcggaaactatggaacaaggacggtgagaggcgaaggatcgtgcgggtactctactaagccggaggcctcttgggcgaaggatgtagggcgaagagtatatgtcaaagggagccgacttcgccaaagcaagcttgcccccgcgagggccgaagaagcctttcccggcccatcaagcctaggggccattgggccgacgatcgcctaacggcccatcaggagtccatgaacctctattacactatgtacccatgtaaatgtccctttcataagggtaaccatgtaaattcccctgtataaccaaaaccctagtagtaagaacctgtaataggggctataaatagtctcatagggccatgtaatagggggatccaagaaaaattctctaatcaatacactttactttcaaccactgttgagtaaccacgtctttcgacgtatgcagttgtcgtttcgaccacaagctgggccggccattgggaatttcgagcgaaacccatgaaaagcgaatgccctgaaaaaagttgtaaaaggagaaggttcaaaggcgaaagaaaagcgacgctggggcgaatatggccgctgaagagggagcagagccttgggcgcctgtcgccgaagatggaggagcaccatctacttccgcacctgcgccatcactaccgccttcggcccctgctacctctgtgcaggtgccgaacgcggctgacatggcgaaggcggctgcggcggcgagggcactccagaccagggcggagatcctttcgacaagtcaactgctggtgccccaagccgctccgtcgcagccggcagcggcccaaactgcgcttgccgctatgcaagcccaagtcaaccctgaccccgagacacaaaccgaagccgacatggaagccatgcgacagaacatgacacgactccaagacatgcttcgccaaatgcaagaacagcagcaagcgtacgaggcggcaaggcggtctaaggtcgcttcggcaccaatcctccagtattcggcaggctatgtcccaccccaagtctatccacaagtgccgacccagccccttccgccacaagtcacgcaagcgccaatgtacttcgtcgggcagccattgaccgcagcagcgcatccagcccctcatgtgcaactgcaagctcaaccggtcgctacccaagtacatcctcaaccgcctggccaagtgccacaaacaatggtagaaggggcttcggctctgcaggcgcagctccaagctttccttcagcagctcagccaacctcacaacatttcaagtacagccccttcggcctgcccggaggggaatacaagtcaaggtgcgcctagttagttgccttcgaatcagccaggtctgggggcttcgccgtggagtcaaggaccacagttcgactctatcaatgctgctcaggcgccaaccgttcggccgcaagcaccaacgccaggcttcggagcaaaccaagcaccaaaccagatcgccatgacatggtcacagccaactttcgacccattcatggcggctcatcaagcatcaccaatcggggccgggcagccgaatgccatggcccaacctcatgcgcaagccgtgatttcgcccttcgccacgccgtacccgcagcaaggtgccatgaacagggcagggggcgaaaaggggctaccgctgagtgggggaatcaagacccgtccaatcccaccccagttcaagttcccacccgtcccacgctactcaggcgaaactgacccaaaggaattcctctccatttatgaatccgcaatcgaagcggctcatggcgacgaaaataccaaggcaaaggtaatacatctcaccctagacggtatcgcccgctcttgttatttcaatttgacagccaatagcatttactcatgggagcaattgcacgatgtctttgtccttaactttcgaggaacctatgaggagccgaagacgcagcagcatctactcggcattcgctagaggccgggggagtcgataagggagtacatgcgtcgcttctcgcaagcccggtgccaagttcaagacataactgaggcatcagtcataaacgccgcttcggccggtttactcgagggcgaactcacaagaaaaattgccaacaaggagccgcagacgcttgaacacctacttcgcatcattgacgggttcacaaggggcgaagatgattccaagcgacggcaagcaatacaagctgagtacgataaggcttccgtcaccgctgcttaagcccaacaacaagttcaagttgccgaaccacctcctctcgttgttcgccagccccagccggcgatccaagcacaaccgccaaggcaaggtcaagcccccatgacctggagaaagttcagaaccgaccgtgcaggcaaggctgtgatggctgtcgaagaagtgcaagccctccgcaaggagttcgacgcttagcaagcaagcaaccatcagcagcctttccacaagaaggtccgaaaagacctctactgcgccttccacggacgctcttcgcacaccacggagcaatgccgaaacattcggcaacgtggcaacgcgcaagatccaaggacgcagcagggagcagcggccgaagcaactcgtgaagtagctcaagaacaagcaccccccggccgaacagcgccaagatgcgcaatgccagagtgatccaagtgattacaatggccgacccgccgatccaactgtcgaagcgacagaagaagatgcagctgtgaacggtccacaatatcacttcggcaggcgaaggggctccgcaatatctgaaccagcaaatcttttttgggccagaagatgccgaaggagtaatgttctcgcatcaagatcctctggtgatctcagccgagatagctggttttgaggtccggtgaatcctggtcgacggaggaagttcggccgatgtcatctttgccgaagcgtatgccaagatggggttgactacccaagcccttaccctagcaccgacatcgctccgaggattcggcggagaagcagttcaagttcttggccaagcacagttgatagtagccttcggcacgggggaaaacagacgcgaagagcaagtattgtttgacgttgtcgacatcccacacaactacaatgccatcttcggccatgcaaccttgaataagttcgaagccatttcccatcacaattatctcaagttcaagatgctcggcccggcaggagtgatcgtggtcaaggggcttcagccttcggctgtttcaaaaggcgatttggccataatcaacagagcagtgcacaatgttgaggccgaaccgcatgaccgggcgaagcacgcgccaaagcccgcccctcacggcaagatagtcaagatgcagattgatgatgccgaccccacaaagctcgtatcactaggggcgacatgggcgaagaagaagctaagaacatcctagaggtactaaaaaagaacattgatatctttgcctggggccctgatgaagtgggaggtgtttcggcagatctcatcatgcatcacctggcagtcaagccagatgccaagccaaggaaacagaagctacacaagatgtccgctaatcgccaggaggcagcaaaagccgaagtcaaaaaattgctcaaggcaggggtcattcaagagatcgatcatcctgagtggctggcgaatccagtgctggtgcgtaagtcaaatggcaaatggcgcatgtgtgtcgatttcacagacttaaacaaagcatgtccgaaggatgatttccccttgccacggatcgaccagctcgtggattcgacagtcggctgcgaactcatgagcttcttagatgcatattccggctatcatcagattcgcatgaacccggccgacatccccaagacagcattcatcacaccgttcggcaccttttgtcacctcaggatgcctttcggtctgaagaatgccggagcaaccttcgccaggctggtgtacaaggtcctttacaagcaattggggcgaaacgtggaagcttatgtcgatgacatcgtcgtaaaaagccgcaaggctttcgaccacgcgtccgacctacaggagacttttgacaacttgtgcgcagcgggtatgaaactgaatcctgagaagtgtgttttcggcgttcgcacaggcaagctgttgggtttccttgtttctgaaagaggcatcgaggcgaatcccgagaaaatcgatgccattcagcaaatgaagcctccgtcgagcgtacgtgaagtacaaaagctcacgggccgaattgcggtactcagtcgattcctctcaaaggcagccgaaagaggtttgcccttcttcaaaaccctccggggcgcgggaaaattcaactggactcccgaatgccaagcagtgtttgacgagctaaagcaatacctgcaaagcccgccagctctgatcagcccagcatcaggaagcgaactgctactatacctggcagcttcgccagtggcagtcagtgctgctctcgtccaagaaacggattcaggccaaaaaccggtctatttcgtctccgaagcattgcaaggagcgaagacaagatacattgaaatggaaaagctcgcttacgccctggtgatggcttcactcaagcttaagcattactttcaggcccacaaagtcatagtgccatcacagtaccctttgggcgaaatactccggggtaaagaagttactggccggcttagcaagtgggcagcagagctatcccctttcgacttacattttgttgcccgcactgctgtcaagtcctaagtgctagccgactttgtggccgaatggacaccggcattcgcccctgaacccgagcccattgaacagccctgggtgatgtactccgacggttcgtggtcgcacaagggggcgggcgttgcggcagtactcacttcgccaaatggtgtgccaatttggtatgctgcaaggttacagttcgacacaaccaacaatgcggcagaatacgaagccattattttgggcctaagaaaggcgaaagcattggggattcggcgcctgctaatccgaaccgactccaagctggtggtgggccatgtcgacaagtcttttgaggcaaaagaagaagggatgaaaaggtatttggatgccgttcggtctatagaaaagtgcttcagcggcataacggtcgaacatttacctagaggccagaacgaggaagcaaatgccctggcgaaatctgccgcttgtggtggtccacattcgcctggcatcctttttgaggtcctgtatgcaccaagcgtgcccatggacagcttggaggtcctggcaatcgaccaggtcaaattggtcgaagacccatacgactagtgaaccccgtttgtgaagcaccttgaaactggctggcttccgatagacgaagcagaggcaaagcgcttgcaattcagagccacgaagtataagatggtctcgggccagttctatcgctccgggatacttcaacccttgcttcgctgtatttctttcgccgaaggcgaggaaatggcgaaggaaatacagcaggggctatgtggcgcgcaccaagccgcaagaatagttgccttcaaagtatttagacaaggagtttactggcccactgtgttaaaagtatgtgttgagcaaatcaagaagtgcgaaagttgccagcatcatggccgaagccaaaccacgccccagtatgagttgcagcccatcacaccaatctggcccttcgccagatggggactggacattattaggccgttcctggcggcgcgaaacgggcacaagttcgcaattgtggccgttgaatacttctctcgatggattgaggccgaaccccttggtgtgatcacttcggcaacagtacagaagtttgtatggaaaagcattgttagtcgtttcggagtgccaaaagagttcatcactgacaacggcaagtagtttgactctgacaagttcagagaaatgtgcgaagggcttaacctggaaatcaggttcacatcggtcacgcacccgcactcaaacggagcggccgaatgtataaatggtaaaattctagaagcactaaagaaaaggcttgagggggcagcgaagggcgaatggccagaggaaatgctatctgttctctgggtccttcggacgacccccacaagaccaaccaagttcagcccgttcatgcttctctatggcgatgaggcaatgaccccaacagagctaggggctaactcaccaagggtgacgttctttaggggcgaagaggggcgcgagttgttgctcgaactcttggagggggtaagagtcgaagcactcgagcacatgcaaaagtatgccacaggcacttcggcaacttacaacaaaaaagttcgaccgacggagttgttgcctggtcatcttgtcctaaggaaaaaggcgaaccctatagccgttggcaagcttgaatcgaagtgggaaggaccgtacctcatcaagcacaaatccaggacgggatcctttcgactggcgacactggaaggctaagatttcgaccattcctggaacgctgcctctctcaagcgtttctatgtctagaacgggtggcacccaaatcgccaacttgtaaaaatgtatatatcgttatgtaagcccttcggcactatgtaagcctttcggcaagaaaaaaaagagaaaaaaaagaggaaaaaaaagggaaaaaaagaggaaaatggaaaaagacaaaaaaactagatgtagggctattatccaccacggaggcccgaacgagtataaaatctttgtgtcctctgccttctttttatttgtttgtgcgattgataatttgcggaaaaaccccaaggcaaatgcctgatcagtgaaaaaggccagggggcgaaacgaatcggccgaagcatcgctcgccgaacgattgaaaccgcaacagcttgtttcggagaacaattagccgaacaccgttacactcgatcgaaaggaaagcacgagtgcttcctataacgtagaacaaaacggatcgaaaacggaagccgaaagctgaaaagtcaaaacctatttcgctaatatatgcaaaggggccgacacgttccgacccaacaaaaagcacgtgaagtgacaatgcaaaaatagcgaaaaggaaataagacgcacctttatggattttaaataaaaatgtatcgaagaatacatcacaatggtacaaatgaagagaaaggagcaatggcgttacagcccggcttacagataaattacatcttcgccctcacgatctctctctctctaaggagtgatcgaacgaactaggttcgtcatcactactaatatcatacacaaccctaagaggagaagggggtgaaatacagactagactgtaacgacgttgagagatcgcctcctgccgatcagtcttctgatggtttcgccaaaagcgagccatgtcctccaaacgtcttgaatgaacaagatcgtagtcttctaaggttcgcccagggtgcgcccgaagccacccggcaaccttaaaaaccttatagctgcgtccgtttatcaccatttcacgataaacaggccgaaatgggcatcacacctttggcaaatcctttaatgccacaaatttcttgttttggtttcgccaactcccagaagggggccgaatgcacaactttcggcgaacaccctggtagacaatgcaaaaagggcaaaaggcgaattgcatagtaagaataggcgaaaaaagaaaaaaatattgcataatgtgaaatgggcgtaatcataaatacgccaaagacatcgaccatcaaaaagtggctaagagtgagtcatatatattcaaaatatccaagggcccctttttcggctacaataagaagggttagcggcagcccgccgaatacacatcgtttgccactcctggcgaacacaaaaagaagaaggaaaactacaaaaatctaaggaaagggcggagggcctcacacctgtgggtaatcctgggcatcgcctcgacccccttcagccgtcgcgtcctcttcttcgcaaaggtctgccgcctctgccttcgctagttgctccaaaaggcgctccttggcggtggaccggccgtccttctgccagaactgtttccgccacgcacgaagtgcgggcgaaatgtcctgcgcgctaatctcccagtcccccttcgcatagttagggaactcggcgacgtgctcgcagccgaactgttgcaggagacccatagtaaaggccgctgatacacgcgcacaacaatcgccgtacgcagttgggcagtccgaaaccgaaccaccagctttctgggtccactcggagaagtcgaaggccgaggcatcttcggcagggacccctcgcacttttgcacccatgtcagtaagggtgaggcgaagcgtttggcacgccgttcttgcagattcggtagttttcgccatctcccgcgaaaaccgctgcgactcctccgcggcgctcgcttcggccttgctgacctctaggtgaagagcctccatcttcggctcagtaaggttataataatccatcagcacggcggaatgggccttttctttccttaattcggcctggaggcgatcaacctcagctatggcttctctcgctttctccagatcagccttgaggcgatcgacctcggccctagcctctctttctttctccaacttggattggagccgcttgttttcggctttcgcctctttcagggtgttggcgagggcctccatctccaagttcttgcggcctatttcgtcatcttggcccgaagacggttcttaaacccgtcaagacgagcccgcacggttcgctctgtcgaacagtgagctgcaagaatctggatgcaaaataggaacggcgaagatagcaaatgttaattatgggacatgtaaaaaagaagaggaaaactaggaatagataaaaagcatacccgaaccgtcaagcttttaatagcagaacacccctcatcgaactcattcagttcggtgaacaggctcggggtgctggcatgtaagacaagattgcttactccctccacaaagggaataaggtctgcccgggtctcgaaatcgccatgggcgaaatgaggcgccacaagggaatactccgaagcagatgtttcgacggccgcacccttccccttcgccttgactagcggcgaaacaaccggctgacgcagagggctaccgaagaccctcgccccagctgtcaggacccgttccgcggaggctgaagccccggcggcggcgctacctcctgctccatcagcaccaagtaaaagaacgggggcagtcgaaaggtccaggctgcggccagcgggtgaagtcagagtctcgtcagaagactcgtcgtcgctgaagacgcgagcgacatcgacgagtcctttcttcttggatatctttttgaccggacctcccttcgccgccttgcctgccgaaaacgcaattagcgccttcgccccatccaactcctttcgacgaaggggggagctgtttgattccaccccggtctcattgtgacccgggccatggaggtgacgaccatcgccatctccgtttgagtcaaggtcacctctatctttttcgcgtttccatctctccacacaatgccgaaccacttctctgttgaccacctcccgttttgtgcatcacagccaccggaacgtgaccacgccaacgacgccctggagcacgcaccggagcgccgccgcttcaaccatcgtcatcgtccgaccattctcgtccacctcggagcaagccgctgcgccatcatcatcgcctcaacctcctcttcaatacgcctcaagaaccccagccggagatgtgaaggacttggagaacgcaacttttcttcaccggcaccgatctagaatcgcctccgccgtcatcatcgattactgctgcctcggtgagccattgttcgattcctcgcgcatacaccatctccttgacctcacaaccctcgtgcatgcttgcttgtagcagctcatcgtcccatttgagccgtcgtcgttcacccaaggaggagcgccgtcgccgagccgttccacaagtcatcgctgccgccaagacctcgacaaccttaactcgacccacggtaagcatcctgaaggctagaagaccacatgcatgcatccttttcgttcggaatcgacttccatgcacacatgcactttcaccccatgaaccaccgccgctcacaccactgtcacgattgtttccgacaacctctgaccttgagttaaccatgggtagatgcgcgaggagcttaggaatgttttctcttttggtggcaccgcaagaacggccgctgtccattgccggcaccgacgagaagctcgtcgagtcgccgctgctctgctgctgcccttgccctcttgctgagagcctgagacactgaccagcggaccccacatcattaggcgctgagaattccgcttagagagagtttaaatcttgcaaggtctaaattgtaaaatatgttagaatgacatgtggaaccaaggactaattagtaatgaatgaaaagaatctgaggactcttaatgattttggttcatcacatactttggactgcgggttgattcctagaaatctcaagggcctttctgcatattggtccctcactgacacgtggaccccatccttaaaaaatctgaagaataattaataaaatgcccaaacaaatatatgtttagcagaaaaatgcacaaagttgtaaaatccatataaaatcaaatgaaactcattttgagatgattccagttgctgtagattcttaaagttatgaactctattttagaaatataaaacttgacactcactgtacaaataatgtctctaaaatttatctaagataggtcatacataaaacatgtacaagcttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagttttagataagctaaactttagaaattcatgtagaacacaatttagcttcaatttgagtaaacttaagttctgtaggatcaccaaaacatgtatttccatgttatgatataagattatatacttactgtgtagtaaaagtctctaaatattcatataaggatttactaacatagagcagccattaatttgtaaaacttgtagaaaattcatttttaatccaaatgaaatgaacaaagtttctatagaaccagcaaatagttatcttcaacatagtaaaataaaatttggcaccttttgtagagaacatagatcaaaaccttaacttagtgaaataagaatttaaacacatagtgttgtttaagtaatacataaacatgtatcagtatatatacactttaggtctaattaaacctaaataaaaacttgattgaccagtgaagccatagttccatcctcatccactaaaacttagaagaacttagctcatatacaatttctaggttaatataatatattgctagtctagattagagcatatctagtttataaaatatgaaccatagtagtaaagatcataaacatgtgaactaaaaatgttttagttaaccaaattattccttttattcaacttaaacatgaagtagcaagttctgaacctacaacttgagagtcatgcacatataaaacactatatgcctaaaacacgttgtaacttgtaaaatctataagaaaatcattataactccaaaaattgtgaaaccaaatgtattagtcttagaaaacacacctctacacctctgtgaagtctaatataataaaaatcactttacaaaagtatttcataacactacctaagactatactactataaaccgataaaacttctaaaattcataactcccaaatccaaatggaataagataaaataggaattatttcactaaattcattttagaccagtacctaatcactgtgcataaatcatgcattttagagcattttggatttttagctctttcggtgtttaattgcatatcgtgtcctttatctagataattgcataattggtgaagaagtggattaggtgctaacatttctctgatcaaggcaagttttctcctcccatcctttgaacacatttaatcccataatttgaggaatgaaaatatttgtttgcaaagttgcatgtgaatttagactatatcggtatttaaaattgggttaaggtagttatgacctatttgctgcataccccaccttgaataattgatcctcttactgtttgaacccttagaaatggttagagtacactctttgtgctcaaatgggtttatatatgctctatgtgcaactacttgcttagccatgcttagaaatatgcaaatgctcattccatctgtaattaaaatgtgaattttgatacatgaacccttgctggaataaaattaatatgatgggtatttggaactaaaatgtataaaatgtgattttatacttgggcggcaagtggtgcgcatatggtgctagttgcataccgatagggggagtgtttgcccaagtccataaggaccgaacttgtgtcacccatttaaagtattcggtatatccccatggctaagtatggaatggcctaagctaattaatgtatttaggaccagccttccattctagtagcccggtgtgtatgagttagtcgaaaattctaaggaattagtcgataattcagagaaactttctatttgccccaacgtggtagtttaggtgactaagtctatccaatacaacggtattgtgccacgtgggtgggttcccgttgtgtccgccaccacggcgttaagtttaaggcgtgggcccgccacttaacggttctaggcatattccaagtatgcctaggatggaggaacacgtatcgtgttggtgcaaggctaggttctaagttgtgtaaaggcttcgttatgacctctagatcacattcgacatgaagagtgtgatggagtcttgcaaactcaaaacaaactagagagttcatatcatgtgggtaaagctgtacaaactctgcagagttctttaaactaatcgattagccgtactcacggtcatgaacgctttggtgatgtgtcatgagtatagactttatgttttaaaatgtgatcatgtgacattggtttgaaattgataaatgtgttgagttgtgtgtgtgaggtgatatattatgatttgttgtcaaaggatgacaaccagagattgattacgatggaattatgatgaacttaatattgtaacttaaaattttgttttgttaattgaagcatcaactcctttacaaaagaattgcgaaacaaaacttgctttatgctgaaattgaactacatattgccttcctttgaatatttgccttcctttgaatatatgccttacatgtagtatggtaggattgacttgtgcttgccagtacattaacttgtttaatgtacggactcttgctgttgatataaccttttgtctgcaggtttagatttagtctttgagtgatgcgggttccgattgctgttgatataacccctagtcggtgtgcttgtgatcgggtatcaagcttctgctgttctctgataagtttatttggccggtcagcctatgtaattattaag

SEQ ID NO: 21177 - DNA, 414 bp, Oryza sativa
tgcagccctagccatttgtgtggtgtgaattttgctggaatactctctttaatagttgatgcagctgaactttgaaaaccatacataactttactttgtacatttgtgaattctgtttatctataccattctgcacacttgtctcctttgttccacaaagatgcactttgcttgtgtgagcaacgttcttcactctttggtgctctatgaattgcaagcaggtgaccgatataaaacgtttcaacaacatgatgagcgaccatgggatctacttgagggagaggcttctgataccgatcagcaatcctgaaattcttcagggtagcacatgctacattgagatggattataacgctaaaagagaggtcgcagtcttttatccccagggacgccctagggaaaaagcagaatcct

SEQ ID NO: 21178 - DNA, 485 bp, Oryza sativa
tttggtgtgatggaatttttggtgtggggccctcgcccgctctttgcccggtggccggtggcgcgggacatcgtcagttttttcgtcacttgaaaaacaacacgcgccgctgctgtcacgacctcggccgtttcacacgcgtcggcacgaacgcgggcgcgtgcatataccagggagaggaggactctttagttgcctgattttgccaaacagacggggaactgggtggcggatgagaaaagagaatgtgattctcacatcgacatttgaagatcttttttttttctttaattgcctgtcatccacttgccgtagagcaactgtaatgtggccgttcggaacatacgagaagcttattagctggatacctctgttgattaaaggggcatttataaatttgttacttttttaaaaaaaattcaacaattacattccaatggtagttctttttctaataatggtacaataacgaattccaatgtcgg

SEQ ID NO: 21179 - DNA, 529 bp, Oryza sativa
ttgaaaactgcaaataccggtttgtaattaagctattagcgagaagcaattaaacggaaaccccagccagagaaaacccggctgtttttcctgttcaggaaacgaatcaaccaaccaaccaatcacgccgaggcaaaagctttggagcggaaacacgcacacaccaaaaaaaaaaaaacacgaaacgaaacgcacgcacgatgagcgttttgctttggccggcgagcggcggcggcggcggcggtgcttacttgggtcgcgggcggtggcgctgacgaggcggaaggcgacgccctccttgtggccgaggatgttgtggacgccgtcgaggagggaggcgtggaagtcgccgaggccgagcacgtccttcttcaccagcaccgccgtcccacggatcctcccttccttccacgcctccttgttcctccccgtcaacctgtcaaagaacccctgcacctgcatcctcgcagatcacaagtcacaatcccctcctcctcctcctcctcctcctctctctctctctctctct

SEQ ID NO: 21180 - DNA, 954 bp, Oryza sativa
acacgccgccggtcgccagtctccccaatgatgacctggcgccgccatcggtaccgtccgcccaagtaacgatgccagcagcgtggctgcaaccggtgaccgactacaccttcgccaccggcgtcctggcgcttctatccccttcgccgcaaccacctgtcccagtgtcaccgcgaccagccgccgacctcacctccaccgttgatgacatatttccctggacaaaaaaaataccatgtacaatgagttaggggcaaataggtctttttagagaggtaacagatgttaactggactgtgatggcacacagtagatgttaaagaaaactcgatggtatataattgaacttgataaagtcagtggtacattatagaagtgcgataaactcagtggcactgagtggattctcttaaaattaaagggtagtgggtcctttgtggtggagtggagttgtggacagcacaacccagctctaccccctagtatattttttaggaataactctgctaactacactcccaaaaacagaggatctgaattgtttggcacaactccgattctaattaagttgaagttgggagctataactgtgtcaaatagaaccaaacttggccttgaacaccttcttcgtactttaaatacgaatctaacaacataaatatcacaaaatcatatgcatttgtcaaaggttcatatcctaacgaaacaaaataagttttatattttttatggagggagtgacaaagtttaactaaaaccaaaggttccttggtactagtatgatactccctctgtttcaaaatgtttgacaccgttgactttttagtacgtgtttgaccattccgtcttattcaaaaaatttaagtaattatttattctttttatatcatctgatttattgttaaatatacctttcatgtacatatatagttttacatattccacaaatttttt

SEQ ID NO: 21181 - DNA, 1719 bp, Oryza sativa
  unsure (1)..(1719): unsure at all n locations
tgtatatagaaaattacagtggtggttagtctgctcttagtagtaagcttctattaaagtctatccaggacagctggtgtacattaccagagatcttgactggctgttcaatagtccaaatctaacttcaagaaaagcaagttttcaatattgaataagagttcaataataggaaagggaatggatgcttttccatatgtggataatgtgcccatctatcattcctttttccaataatgaacttaggcatcagattggtggtgaagcaattagggaagttgtcacatacctttactcattaataaatagaatcataactacagaagttccacatacaattattcttagtactgtgttgtatgcaagtagctttagctgcaagggatgcagttcgatatcaacttcacacatgccaaactttgacttataacgcaacttcttctaataggggttgtattattgcataggagatcaatttcaagcatattgagcgtcattctatgcaagtaagtggtgtaactttagctattaacaaagcgcaggcaagggataggtcttgtgtccatccatccagcatctctaacatagcgcatatccaccactcctcgaaaagagtagaataacaagagagtaaattatcacaaatccttgtctattggactctttactttttttccaaagagaattcgggtttctgttttggccattgcctatttattgggcaccgtaatatacgcccagcgatctcctgtgcacaatccagtgcaattacaatttagaggattccctgtctgcttggtttaccatcttccttatcctaatagcggtttcaagttacttgtactaccaaagaaggcagtcaaatcttaaaacagattcgtaattctcaaatttttcattgtgttaggaaggaattggctaggctacccgcgtctgaacccaaacaaggtgtggncgcagtacaaatcgctttcaatctcgccttgtaaaacgtataattagtggcctgacgaaccaggactcaagaaaaaaaagcacagtgcatttcccattntcccccaaatccacacatatctcccggcgtacgctacctaaagtttgacgagcgaacaaaaattcgagggcaagatgaggcccgggaaggagaggccacttacaccttattgaagaggtacgccttcccgtgcttgcaatggaaggactgcaagaaatggaaagcagcaaccatgaaacaatcgctcccacatccgccgtgctcgccgaatcaaacaaagctagccaacaacaacaacaacaacgagaagaagaagaaaggagggggctgaagaggcgaaccttggagatgatgtcggaggagaggccgaggtgcgtgtggcagtgcttgcagctgtacaccttcccttccaggtgcatcacgaacagccgccccatcgcctccgtctcctcctccctccccctcgattccacaccccgatcccccagagcgccgccgcgatcggtgtccacccgactccaatcgcgatcgccgctagtccccctccctcgccgccgctcgttcgcctcgaatccgagattaggattgcttttgtttgtggggggagcagtctacgcgaggaagggggtggcttgtctgcagcactgaccgggtgaccgaagcaaaagcagcaactggggttggggatggggattgggttgatatggggggtggaggccgcgtgc

SEQ ID NO: 21182 - DNA, 2427 bp, Oryza sativa
aatcgtaggaatgggaaaacggaggaataggaaaaatggaggattctgactggaatacaagtgtaaaacagaagattgcaaaacacagaaaaaacacaggagtttccgtttgattgtaccacagaaaaaacgcaggaattagagaaaagatgaagactcataggaaagtttccatgaggtagaacctcatgctagatttcttccaaaacttacatggcattagacattacatagaaattttataggattttatagaatttatttcttcgattcaaagggctgtatagaaaaaatttaaaatccttgagaattcctgtgaatcaaggggcctaaaagggatcgcgggggatgcgatgcggtgcggtgctgtgtccgattgcgtgggatggcctgggttgcacacgacggcacgagctaatttgtgcggggggaacaagtacaactgctgccgtgctggatctggtctgcccacctgtggattttcgttcctggatgcagcaacctcctctcgtttttcctttttccacgtaaactcattaaggctgtgttcgttactagttggttggaaactcatctcctcgcacagaaaacagagcagtctattagcgcttgattaattaagtattagttaattttttatttaaaaatagattaatttgatttttttaagcaacttttgtatagaaactttttttttaaaaaaatgcaccgtttaatagtttgaaaagcgtgggcgcggaaaatgaaagagtaaggatgggaaccgaaagttccgaacacagcctaaaggaaggaaagaaaatgtagtactcgaggagtgtttagttctgccaaacttttcaatttgccctctcttttaagataagaaccactccttccgcccctaaatacaaagaattattagtggatgtgatatatcctaaaattataaatctggacagggagtatatctagattcatactcgtagaatacggagtagtatcttttatcgaaactatcaactctatacgaaataaatcaaaggccatattacgtatgatatattagagcacgcgataaataattcaccattctatatgcaccaaaactaaagttaagcttatgcatatagagtaataaaaaaaaattagacatataattaataggcaaatcggatttatgccattttaaatgtgtggtggagagacaaccgaagagtgtcatttcttataaaaggccatgattatgacttcctttcataatctacttcctctatgttatcaagtggagtatttgctttaaacatatatatcctcctttctaaagaacattataatacataccctatacaacgagtaattctacatcgctacatcctatataaagccaactaatatagcataaacaaacgcctttagactctcgaatggaaaaataatattttgattttcaactctcgttgtctaaaattattttagccattacatacttaaaaaactatcatatcctatacatttgaactgaacttttctatggtaaaaacaagtataaatgtcttggaaatatactcattactcccactgtgacatagatccatcctcataaaaaagtagagtgctaagaacgagctagccatcaatggtttttaataaaagtagatgaattttaactcgaccaatggcagagctactaacgtatacaaacctacacaataaagaacattttgttaattgtcatcaacttgtatgtccatcctcaaactccaccattccaagagttaactctgttataaatccagcataaaaattagctgtgaagaattgaatacgggttaaagcaataagtctttgcctcacatgagcataaagttctcaaataagatgaaaaaaatgtactagtccaatttgatgaactaatgaacattagtccaagcgttttcttcagaaatggaggataaaaagtatttaatgtctctgttactcaattatttttggaaaaataaccttgacaaaggatagtggagtacaaaattatagggccactctggcaaatgtgtttgaaaaatgatatccacccaccaaaggatatatcccaatactatctattcattttcatattctaatcccacttttcataacctatagtattcgccagacatgtcctacaggtaaaaacaatattatagcctggtaataaaggagttaccatgtgttcttgctagccaaagttcaagttcccccaaggcctcaaccgttactttttgctcaaaatgttttctctcttatcattaatgctaagtttctccttaatatcccacttttccttttctaaaaaaaatgctaagtttctccatagtatccccaattttcctttttttttttaaaaaaaagcatgtcccccagttcaaactaataaacgacgtttgacaactcttatagaaaaaaaga

SEQ ID NO: 21183 - DNA, 1037 bp, Oryza sativa
atccttgtccataagtctatacacaaacatgtatgactaaatttgatctacaattaaagaaacaaaaataataaaatcagacagtgaatagtatccgtactccctttaaaactggacagatcaagaaactgtgcccttttgaaacaggacagagagagtatcacctatgtcatctatgaagcatcctgcataagtaatctatcacacgttagcatctatttaccatagacagatctaatataatctttctattggacagattttagcagcattcttttttcttttctgggcatcacatcactatttttgcttaacctttggtcctctgctatgtcggtgagttttcaactagagatatatactgatatgaaattgattacgatagcatagacaaatctacttggaagggaaatattgagatggatattgaaaggtttttcgatcgtaaggtcaagaccagagcataccagtatctcgatgcggcgaaaccacagggatgcaccaagactcctcatgaacgctatagttgctacattcagcaaagaagagcgttgcaggatcattggcagattgggggtcatcgcaaatcgccagaaagttgatatgagagtgattatatttgtaaatcctccatgggctattgcttctgaccgggccgtactccaggccagatacgcactcattgacaccacagataaaatgaagcctatatttgtgcaccttcaactaaagacacaatcgaagagagttaattggacatttgaggctaagcatatacaacaaaaatagaggggggtcaacttgaagaaaccaaaccttgtcaaggttgaatgtggccaatgcaacttccacgttcttgcagactaggtcatgatgtagccaaaacttgaaacgccggtgacaaagcgcaatgtaggcatcattgcataaccttttaggctctggctgctgttgatgtcgcaactcgaagtgacgcttgcgaaacaacaaggaaatcaaggtgacatcgtcagagcagagcctgtcaccgtgctgca

SEQ ID NO: 21184 - DNA, 1581 bp, Oryza sativa
ggcgagctcccaggattgcttcagatggagaatttcatcatctttcactgtggcgtggttcatcatggtgttgtctagtagcgccttgactcgagatttgttgggcgtgatgagcattttcaggtcaccggcgagacgagcttccaccctaacacgagcagtcgagggtcggggttgttagagataatgcaatctcctgtaatctctgtatgcgcaagatgaggaggccggtagtttgttaacctgataaggttgttagagcatgtataggagatccggttcctcccatctatggcgcatatatatctgtaaatgatcgcacgattcagtgctgaattaacacgaaccgtcgcatcgacgacattacctctagattgagttttctttcaggggtggcgggcggcgacggcggcgcaccggagggctatctcggcggtgatcacggtggcgccggagtcgaccacgaacgactgctccattccgcgccggttgacgatgagtcgggcggcgacgagggcgtccgccccggcggcgtcgaggtagcgaagtgcctccacctcggggaggtaggggaagaggcaggtcatgaaggcgacgagcccatccagcgaccgctggaacatgtccggggcatgctcttctccgccgccgccgccgacttccggacgccgggaagaggacctgatgacgctgttgacgacgatgttggaggtgggagaggaggccgaagcagaagccgccgctggagatgaactcctcctcgagacacttcaaccgacagtggtcgtagcacctcgcgatcttggcaagaaccggcacactctcggctttcgtgtcgcctctggagtattcgtccttgaagtttcttggcccgtagatgcggggaaggtggcggcggccgcctgggacgctccggtgtgacatctatagtcgatggtttggaggatcgggtggtggaggcggcgatgtcgtcgaggatttggagatcgggagggggtggcggcgctgcacctctcctcctctctttagtcgatcaggaggcgaaacgccggcgccggccaaaacgcgcggtgctgcttgcctgcttcctttcggtttttttttttttgtgtgtgtgtgtgtgtgtgtttcactgtttggactgtgccgtggattgattcgtttccttactataaacatcgccgtattttctccggctgggtttccggctaattgcgcgcgcgttctctctctctcacatcttaatatttcgcaaaaaaaaaggatcttaaggaaaatcagttggctgaaaagacttttgaaattgagagaaatttatcgacagatgtttagcgatatcgttcgttttttagatgggccgtgacggaccggcacggcctgctcgccgtgccttgccggcacgcgtgggtcaggtgcgtggcccaagcatggcccaatgaaaaaagggcctctccgtgatgaaccagcactgcacaggcacggcccaggtcaaaccatcggaagaaaggtgacttgaactaaccgagttcttcctcgatagttatttttccatccaagcaggtgtacagaaattggggtgca

SEQ ID NO: 21185 - DNA, 586 bp, Oryza sativa
gaatatttgaagcatccaattaatgctgggtgctactactagtatcaacactacagattggtgttatacacctaattcgagtgatatggcgccaaaacataagggcttaaaagaatccaaccggtctaatcaaattcaaaaactccatggatggtgctttgccacccaagggtaccctccataatcctcaagcagcgaggcagttacaagccttttatcacttcatccatcatcctacaaaccaactccacacccacccatcacaatggctatagatctaaacatattagcagaagaagaggaagatggaggggctttacctgacctcaatgaagcacaagccaatctagaagaagaagttcctggaaggtatgttatccaggtagatgaccttgctcgagttgcttgccatggaaatgatcaagttgtacattcttttgatctcaacttgggagcttttgatctcaacttggaagcaacagaagaacaagaacaactgcatccaggttttttacttcatctaatctttctcaatgcataaaatgggttctttctcagtgcatgttgattgcattagtaaatctgg

SEQ ID NO: 21186 - DNA, 870 bp, Oryza sativa
caaatgatgggtgccatggcatctaggcgtacaaaatccttggcatttaggtgttattttcactttaatttgttatttttgttgcaacttatagaagttgaatttggtcttgcatgtttgtggagtgatatatttcgtattaatctatgttgtcaatttttttaattttttaataactatttagatgacatgcaaataacgagggaatgtcccctcaagggatgaaaatccacgtccgatttctgttctcaatatggagtgtgcaaatgtgacagaaggaattctactcgcgttaataatcaattgtcactaccatactattattagtttataacgtgttgtcatttttgtatgtatggcagaattagtccgttgcatttactgtgagagcaaggggactaggattgtgcatcctggtgagaagagcttccatggacgtgacacggaatttgagaaggtgatgcgtggagaacgactctttcctggattacagagaggatcctacagcaacattcggctcgctgaaagaaccgatgcagattgggtggataatctggaggaagattgcatctacatcactgcctgcgcagcggataatgatagaagagtgaacccgctcaattacccgcctatgtatcgagagcgtgtgctaccgtgctgcgaagcagcaagtgatcgttcctagttatcagttttttttttcatatatttttcttcacaacattataaggtggcacactgattcggtatccacacaacgctaatctctctacatgctcccgtgctgaaggatcaattattcgtaatcgtaggtacatattcagattaagatcgggagctcagatttcagatcgagatgctgttggggat

SEQ ID NO: 21187 - DNA, 3201 bp, Oryza sativa
aaaaaattcacacgattttgcactaaatttgtacattcttcccactgatgccttacaaaaatcaatggagatgtgtaatactactaccttttgatgagatcggcggggaggccctgctcggtgaagttccagttcttgtacaccatggacgacatccagagcgcgtacttgccgggaagacggtcatctcgaagatgccgccggcgttgatgagcgtctgccgcgccagggcgttgatggtcatcgtgtcgcggtagtgcgggctcagcagcttgtgcaccgggtgcgtcacgctgagctgccggttcgtcgcgatcacgaacggctccatcacagcgtgcgtgttcagcctgatcaaccaacaacaacaaccgatgagtacaaatctccgtcgatgaagcgatcgattgctctggttttgaacgtaccagtggctgatcagttggtgccagccggagtcgttgacggcgacgtaggccttggcgagctgccacacccaggcctcgacgccggtggacgccggcgtgtacacggtgctcttggcggcggtgacgtcgccctggatcataggctcgctcagctcgatggcgagcggcgccagcgtgccgtcccctcgcaggaagaagagcgtcctggtcgcgtagatgaagttgccctccaggccgttgacgtcgatcaggaacggcatgaaccggtcgtggtggtccagaatgtacagccggttgctgtccagcgcctgcaaatcgcgacacagtaaatttccacacactattgccatttgccagcaacaattcaggtttgcaagtcacgattgatagcaaaatctgcacgtacgaaaccaacctgctgcacggtgaggccctcgaggttgctcccgatgtgcgccgccgtgatcatgctggtgtggtcgccgaacttgctaggatcgagactacttttcgagggaattcctgcgggatcaacatcgagttaaatttgccacatttcacgttgcagcagccgtgttcactatcaatttggcatgaacgcatcactgatcactcaccgtgagacgcgtgatcatcatcgggttcacgccggcgagcacctcccgcgcgaactcctcgtctgtcctccacgcctccttgtcctctgcatacatagccaaacattacatcgatcgtcagttttcacctaaagattctgatgaaaagtctctacgatgacaggttgcgctcacgtttgataatctgaggcatggggagcttgaggatatagtcgccggcggcagggaggaggtccttgacgagctggagcgggaatcgcttgcggagctcctccagcgcggggacatcggggagcttgaggccaccctcgtacaggtcgaggatgtcctggaacgagtcgaactcgccgggggtggtgtccacgtacgtgcggatcgccggcacgatcccctccgcgatcgccttgatcgagtagcccaggaagtccgccatcttcaggtgcccgaaccgctcgtcccggggcacgtagatctgctccaccagcgacagcctactctccgagtccggatctgcacgcacgcatacgtgtacaaaaaacatcagtcaaagtcaaagtcaacggtcaaccacacaaaccgggcccaccgtcagtgagacattgcagctgaacatggaccagttctggtgtttcactatgacaggtgggcctaactgggaggtatgtgagtgaaggtgccacattctagtgtaaaaatgtataaaaaactttttagaccttaaaatgtttttttaagaatcgtaaaatttttggttgggggatgcgtaccgggtggtggtgggtttgcggccggtgcggccgcggcgagggtagggggtgtcgggggagccgccgaggatggggcgagggttgccggagtcgggggagccgaggtcgttgtagacatcgtagcggtagacgcggtcgtgctcctcgtaggggccctgctggtcgtcgccgcgcaggttgcggagctcgtcgtcgcggtacggcttcagcgccgccggcatctggctcggcaggtaggcctgcgcgtcgccgcagaaaatatatcacaaagttaattatagcacgtactcgtattaatacgcatcgctaattactcctacttaattggttagttgattgcccaaatcagtcccttgatacggcaccggccttggacacctggctgcacgctgaacaagaggcaggcaactatctgttcactttaaaacttttaccgtgtcatgtgttcgcaaagtaaaatcgagtgctgtgtcgttgatcttgttgaaaaagcttctcggggccatgaaacaatgccgtctaaatgggtgtgaactgtgaactgtggcaactatgatgagttgatgactcacgtgaactcacatgccttcctgagtccaaggactattccaatttctagtactatagccacttttatgttgttatcatcaggaagcatatccattgtagagctgcttcttttttttgaacagtgctactaaatccacttcacctaccacataaacaacttacataaagtccattcacttctcacctaaccaaatatcttccctatggacgcctaccaaacgacgtgaatcaagcaacttactacataaagcatctacgaactggccaaacaaagaagaacggcaaatggttactgtaatagtgtaatttacatgcagggtagcataatacagtatgcagcagagaagaactcacatcgttggcgaagaagacgcggtcgtaacggtacttgtcggcggggtagacccaggagttggcgaggaagaccacggcgccggcgcggccggggacgtcgtcgagggtgatggtcttgaggaagaactcgttgctgtggtggttcttgacgatgatggcccccggcacgccgagcttgtcgacgtcccagtcgaacgtcacgccgaaccgcgactcccccgtcgtcagcgacggcaggctgctcgtcagccactgctccaggctcgcctccgcccccaccttcccccggttgccgttgtctgcacgccgatgagaggatcatgcccaatccgtcccgttaattagtccaaaccaacgactaatcatgccccagctgttaattatactacgtgtcaccacctcgcgacaccagctatagtttcaggcatctagttcaaatgaggtactacttcttctttttttttt

SEQ ID NO: 21188 - DNA, 492 bp, Oryza sativa
cttcaccagcggcctggtttaaactaatccctggcttgtgcggcactggagactggaagattaccacctctccttttgcattggtcaacttgatggtgcggctggcgcaatcaatcactcctctgtgccttgccaaccaatccattccaagtatgacatctaggaccttggattccataaaaatgagggtggctggaaaaatcaacccttgaatttcaactgtcacagatgggcagtagtgagttgtggtcatgccacctccaggagtatgaactctcattggtatcttaagcttcactaaagataacccatgtgcaccaccaaaacgcttggaaataaaggaatgggttgcaccaaaatcaaacaatattactgccggtgtcgagttgacggggaatgtgcccaatataacctttggtgctgactgcgcctcctctgcagatgcatgattaacacgggcctgaacgaacttgggtccggcacgtcttggct

SEQ ID NO: 21189 - DNA, 5082 bp, Oryza sativa
ttttagtcccggtttttaatggaaccgggactattgtggatttgggtcgaccgaccaaagatggtttctctaccagtgggacgcaggcgatgatggcggccatggcagctgtggcagacgaggcggacgcacgcgacggcgagtcggcaactgctgtggtggatgacggcgaacgcatgcgacagcgacgaatgcagtggaccatagtggcggccatggcggatgatgatggataggcgacagccacgacgatggctgcggaggacggggcgatggtcacagcggacgccgccgccgccgacggtcgcagcgaatgaggcggacgccggtgatgacgccaaccttggcggaggaggcggacgcacacaacggttacaacggcagtggacgacgacgatgggcacggtggcgattgcgacgaacttagacacggatgatcggtacaaggggccccagaaccttgggcggagcgtgcagctgggcgacaaattagtcgcccgctcgcgctcgcgcttgacccctctctcctccacgtaatcgcaaaatccgagctggcgttcttatcgtcgattattgtacccgctctaacaggtgggaccatatattaatattatagtaagcaactattgtataaattgactattagattagctataaataaattggagctagtagtggactatattattaaacttcagttctgatctcttgctgcatacttgatcatgtggttaattagcgttgccgagatgcgtagcccggttggcctaataaacgtaaaagcctatatttaaattttcaaaattttcaaaattgaaattgcagatggttttaagatattttcaatatacttttttttagtattgacttctaagtcgatacgaacaaatatataaaagttgtacctataaattaactctttattttatgtttaagcttattaggaaatatggacaaccaatgaggctccaaatgatgttcggaagggtaactttaccatccttaaaaaagtatatcgggagataccatactttctagtgtaaaaatttagtatctccggatacttagtacttcgatgtaccaaaaactaaaaactttagtgtaaaatttatatacctcgaggtactttttaaagtaacataaaatttctcttttcggaagctttcccggccgttacccgacggggttagtatgatttcaaaattcaaatcaaaccatggctaatgacggtatataacatttaagttcttgtagagtataatgacggtcaataacatttaaccatagcgaaagtttttctatgttactagttataggtccacgcgatcatcattttctttattcactttagtggaggatttggatctgatggattgatggtttttaaaatgataggttttcttgacaagtgaaagtcagttctatttttttttaggagtggacgggttttatggaagaataatctggtgcgcatagtacatacttcctccggtcccataaaaaatcagcatagtaatgtaccacatcctagcactgcaaatttagatatacgtatgttcaaattcgatgtattagaacgtatcacatcgattttttttacgaagcgagtactccatatatcaacatatgctaaatatgcgcatggaggagtcggattatagcaggtacaatagcaggctataaaccaactgcaaacatattttaaggagataaataagaagagagaagagcagtggactataaatttgtagtcagctgtagcacgaactttaagacgtagtgtgtgtaacaggtaggagcaggtattaatagtgtagtatgtaactattgtatggatgagctattagaatggctataaatgaattggagctagtagttagctatactgttaaacttgctcttagctccgatttttgcgacccttgtcacaatcacagttgatcgagtaccaaactttccattcgtggattccgttggtggcgttttttccgagggtagttggattcatccacaggatgatgcagacgtgtcagctgctactatcgtattggcaggcagtacaatcaacacttatccagacattgtagcacacaagtactcctgctcttaccacaacaaaaaaaaaattaaacaaatatttatccagattcatcctcagaagttaattttttatgggacggtatgtatattttacaccttcaataaaaatcattttttatttataaacctttatcttataaacatgaaaaataccatatcaaaatcatagctagaattgattttataagatcataactatcacaggttggaatgacaagcacatcaatgtagaatcaaatgctggctctagacacgtactcccactgtcaaaaaaaaaaaccaaatcccaagtgttgtggaagacggaatacggatgtcggacggggagagtccccccaaacgattaatcggaatacggatgattagtcggaatatgacggaaatttaacgttttgcaaatataagtacatagttaataatagtttgtccttttagaggtaattaaatccatatgaacacattctagtttcctagtatatatatttaaatagaacaaccataacatgacattaacttaacatacacgtactaaagttaataatgcaaaaaatatcataatgcatatttatgcattaactagtggtaggttcagtttataatgcctgccattgctgctataacaaattatatataataataccatgataatttgcattacacgttattgaaatcttatactagtattagtgcatttgaaaaatatttggtcttcaaagagattaatatagtagtacatgcatgctgtacaggagtacgagagaagacaactaacaggataggctattgtgcgtgggctgggcccagtgaatttgatcatgcccgattatatactgccaatacggccgattagtcggaaaaacgctggattaatcggtaataacaggaattacgcgtttttggacgactaatgaggaccgttttgccaaaatgtgacggactgcttaccgtcaccgttttaacgggcgtcatagcggccgtatcaaccgtcttccacgacactgcccaatcctgagtttaaaactggacaccgttttttttcgagacggaggaagtatgccttaggctgtattcttaattcaaagttcccacccttagtttctcatttctcacatgcaaatttcccgaattattaaccgatatattcttttaaaaaaatgtataaaaagttgctataaaaagccatattaaattatttttaaaatttctttagctaatacttcatttatcatattttaactatcgttccattaggttaggcgctcctaaccccttcggaatttctttagctaatacttcttccgtttcacaatgtaagactttctagtattgctcatattcatatatatgctaatgaatttagttacatatgaaacggatgaagtacttcatttatcatattttaattatcgttccattaggttaggcgctcctaagggcaagtactataagcctctacatgttgcccctaaatttgccacataaaattaggtgatgagttggaggagagaagttaggagagagagaatgagccacctctcatgaaaggggcaacctccacataatctctaagaaaaatataagatgatgtgagagtaaactaatattggggtttgtgtactagaggtggcatgttgtacttgttacctcttaattaatgagaatatgacatgatttaaattagatctggtactcacctccattataaaacttaccctaaccccttcggaagaacgcgacctttaataagctcaaggaaacaaacccaggcaattcggccgttcagttcttaaaggcccatccactatacgtgccaggctatgtaggccgtaatccgggctttcgacgcgttgaagtcactagttagcccataagtatacgggccttgggtcaccctaaccttggcaacccagccggacgaggatacagacccagcgtacgtaagacgtacctaaacaattcttacaaacttgtatgaaccgtttgatttagttaactaaattttttaaaaaaaacaagatttaatcacatcatgatacgtcaggatttgtaaaatgtttgtacaagaaagtttgcatatatcttttccctgccgtggaaattactactccatgaaaagagctaggctaggaccaaactatttttttttctgctttctacttaaaagctcagctggtttctatagactagctatactgtgggtgacatgtcttcactgtcatgcatatctatatccaaaagtcagaatgaaacttatatatagacgtaatttaagacggtaaaatcccgcttatatatagaccagcttaaagaaataatagcggatgctctgaccgtctatatgtgataaaataagcagacaaacaaaggccatctagaagagagacatactttttcgaactgaaaaacccttttcaaaagatcatggaagtaaaccggcaatgcagacaaaataaggcgtgtttacgagcgtagaggaattaggcctcgttctttttctaattaagatgagattctatctcaatttgtgttagcacgcctttaaaatggttgaacggtacaacgttactttaaaatatcaaataaatctatttattaataagttgtaataattaaaatttagttaatcacgcgcgctgatgacttttttgcatgtcccttatttaatcttaattttaatcttactctaaacacaagtgatacttgttctttgcgtctcagcttattacaagagttacatatgaaaagataaaactgctttcgtaacatgaaaataatctaggactattatagcatattctcgtaccctgcggctccgactagctggccagcggcctagcgttgtactctatccatcagctgtactaaaaaaaaactatttttacgtgcgattaaaattaatttttcacatatagctgccagtaacgtaaacaatcatcgttccaccgtcatcgaatataactcagataacacaaaatcaacaaa

SEQ ID NO: 21190 - DNA, 2418 bp, Oryza sativa
gctgtcctccgccgtggagcgggcggcaggcgcaggtgccttgcagcaagtgcgaccaggggtgcaagaagtcgtgcaagggctacggccgcgactcgtcgtgcagcctcccctgcggcgacccatccaacaaggccggctgcgagagctgcctggacgcctactacctgaagtgcctcaactactgtggccagtcgtgccgtgtgaccggcaccagcgggtgaaaaaaaccgttcacgcttcaattggtctctgagctcacggcgccggccgccgtcgtgaagccttttgatgtgtcacgtaaatgtatgtactgtctcgatcatatgtagttctgttactttctccgtttcatgcatattgcaagttatttttgttttgtcctatttcagagtactccttcgtcccaaaaaaactcaattaggaggggtcacatcccgacccctcctaggatgataggatgatgaatctggataaagggtagtctagattcatagtcctaggaggagatattgagttttttttttagaacggatggagtagtttgtcactactagtactctagtagttcaaataagctagcgtgtggtgatgcacgcagcaacgcgctggctcggctcgagctcaactacagagcttgatttttaagtaaaacaatatatatttcaaagataatcttttaaaaataattaatttctagttcatcatattaatagaagaggaaaaaaagaataaaataaatatatgatgtcaatataagacatacaaataatatatttgatctcctaatttattaaataacaacaaaaaatcatatattattaggctcgttggaagctcgagctcggctcgataaagctcgcgagcttagggagaggctcgggctcggctcgtttggagctcgagccgagcttgaatcgagtctagaacgagccaagctcgagcagctccagttttcgagttttttgacagccctacggccgggtcggctgcaagatgtgttgggggcggtaagcgatgtatcaatggcttaatgctttgtttcgttaattgaaactcttatcgacgtcttcgattttctcactgctgcgtaagcgaaactggctacattctttggtgagctcgattctccgattatccttgtaaaatttaattaatcacacttcgagcgctatttatatgggggaagttttaccgtgcttagtgctgaccgtttatcacatccgatcaatccaatattggctaatatttacctttgcctttttaaagtgggtcaattggatctatattattacaaatatgtcattctagagaaatatcattactattcgtctattcgtatcctatcattcgaacacgaacaaaattaaaaccatgctatcgccatcacattttctatcacatatccttttctttccttctcattttcttttcttctcctccccgccagcaagattcgagaggctgattcaagcgtccatgggatggggtcaacgacaacgacggctcttcctccttctttcccctccaccacaaccaccgctgctccaagtatagatgcgctgccggctagggggagggaccaccaaccatgggcgctagcgtcgactcggactctaggaggggcactatggccttgctatcgaggacgaacttagccttggaagagacgttggcagtgttgaatgcttggggaagataccgaggtcgatggaggttaagcatgagctacccatgaaggaagacgggtacggtgctagaagcggctcagatcctcaccggcgagctccgcctcccctctcgtccatgaccctccgcttctcaccggcgagctccttcgaggcgcggggtaggagtagcaagcgggaatggcttctccaagtctccgagaggcgaggggtgggcttagggttgggggaggccggagccggtgaagtccgcccaggcatttcatgtggatttggctgccggcgacccaggattggtggaagggtggatagtgggggagagagagtaaggaggatctggcgatgttgtggatcgacggtggagggtgatagcaacgacgatggagttgcagcgcaatggccctgatgcggtgacaatgatggtgcggaggattcaacggtgagggaggcgataggggaggcaacagccaaggctgcctttgcccggtcgctcctccctgtgtccccacactttttttatcagaatgtccccacacttcattgtgggggcggcattggcatcgacatcgctgttgtggttggctagctgagaggggaagggaaagagaggaggagaagaataaattgggggaagaagatgaaaaatatgatagcgatgacatgccaacgtctctctgtgatgtgtgtaggcccatgcacatgtatgcgtctatgggtacatgctgccatc

SEQ ID NO: 21191 - DNA, 1269 bp, Oryza sativa
acgccatgtttgctttgcatctgcaatccagtgacaaaaacctgcaagttgaagtatcgcgtttactgcctataaatagcgctggtaatctgccacaaatccaacacatacgcatatctgcatcccctgttcttctctcctgtgacttgcttgatccacatcaaatccaacgacaacaccaacagaccaaataatggctgctgcttccggccgccgccgtgccgcggccttcgccgtcgtgatctgcgccgccctgctgctgctgtcctccgccgtggagcgggcggcggcgcaggtgccctgcagccagtgcgaccaggcgtgcaaggaatcgtgcaagggctacgggcgcgactcgtcgtcgtgcagcgccccctgcggcgacccctccaacaaggacggatgcgagagctgcctggaggcgtactactccaaatgcgtcaactactgtggcccgtcctgccatgtcacctgcaccagcggctgaaaagcccagccggccgtcgtcttgggccttgtttggatactccgtaataataattagccctcccaaattttactatttaagagtattaaatataaattactgataaaactcatttcataatctctggactaattttatattcgtcttgcaaattagcttggtggttataaaataagttttatcagtaatttatatttaatacttctaaatagcaagattttagagggctaattattagcccggaggatcctaaggccttgatgtgtgtcatgaggatgcaccgtgcatgtacacgtactgttagtattgtatactagcaatagttagtactgctatttcgaataagctagctggcgtggatgtacagtatatggctatatgccgaccggctctgtatttcatatattgtggtcaatgcttcctttcgttgttaccaaggtcttctaagacagtggtatggtcacgaagagaggtactctgtctggttttattttaattaacgtttcggataatggcactgtttacaaaatattaccttaattttctattataatatacataataaataaatgcatgtttatttttattatagtgttttgaaacacaaatctatatatctatatatgttattctagtttctttaaactttattaatggtcaaagttataaaagtttgatttgaccttgtccaaaacgttaattattatataaccggagggagtactcctaaaacctatcaacaaatatttaaaactgttttaagacaaatctaaccctatgag

SEQ ID NO: 21192 - DNA, 3262 bp, Oryza sativa
ccgccttgcgcccgtgagccaccgccgcgcctcccttgccgccgtcgcccagcgccacccctgagcagcccgccgccgccgcccctcaccatctcccccgtccctttgcctgcctctccctgtttggaaaagaagagctctttgagagcatagaagaacagataaaacgaaagtttggaacagaagagctcttttcagtatagaaaatataattgacacttgacactttatttatacaccacattttaaatatatcagttaaaaagatttccgttaaaatctaattgaaatattatcacgataaataagtagttcaaaaaatatatctcttaaaatacaaatgtaaggttagttggaagatattcttaaaatacaaatgtaaggttagttggaagatattactaaaatatagaatgatgggatatggatgagaaatattttttggatgatactttatacgggcatttggagaatcaaatatagatcatctactggggatgctataagtaacaagaccggtattcacgtggtagcaagcctagctaatatccatctcgtatcataccgttcggaatggagaattccgtttaatagcagtcaacattcatttgtccctgctcatagagcttgagctaggagtacaccctcctcaccctagtgcgtaggtcagtgtacctagagccggcgccttaggtcttgttgagttcgcggaaagaaatattttgtgtgtcacatcgaacgtttgaccggatatcggaaggggttttcgggcacaaatgaaaaaactaatttcataactcgtctggaaaccgcgagacgaatttattaagcataattaatctatcgttagcacatgtgggttactgtagcacttatggctaatcatggactaattagagcaagtttaatagtatagccaactgctagctccaatttatctatagccaatctaatatctcattcatataatagctacatactacactattaatacctggtcctacctggcatacatacactgcgttttggagttcgtgctacagctggctccaaatctgtagcccactcctcttctctctcgttatttatcttcttaaaatatatttgcagctggcttatagcctgctattgtacctgctcttaggctcaaaagattcgtctcacgattttcatgcaaaccatgcaattagtttttcattttatctatatttaatgttccatgcatgggtctaaaaatttgatgtgacgtttctgggaaaaaaatttagagaactaaacaagcccttattgtcgtcacgagtttgccgctatattgggatggggcgacctgattcaagttttggttgggtgtctttcttatatatgtagagtttctattttagataagctactaaagtattttttagaccgtgtaatatacggattagcgactagctagtaatattgctcaatagtcagtcctaagtcaaacctctaggatctagctccaaaagagttgggtagtcggccaatcaacacatgcatatcgatttaactaaatcagaagctctgactttataaagaaaataaaatggcgcaaggtcacgtttgaagtcaacacttaccatgccttatctgatgcatgacgtgcacatgcgttgagtataaatatatccatactgataactagaaacaatgttgcatttgccatatcccatatgcctataaatagaaatagagagatacagtaactctcggccaatcaattcatcagagctagttaattaagggcatgttcaatttgataccattttcaatcttatcaaattttggtaaagttataaaaaaaagctaaatttagtttgctgccaaattttggtaactatataagaaatcctgccaaaattttagcaactcgccgaaattttggcatagttgccaaaatttcaacaatgccaaaatttattaatgttttttttatatcaaagtgaacaggccctaactcaaactcacagttgcctcctcctctcctatggcctctggcgccgtcgccgtttgcatcgtacgtggtgctggtcctgctgcagtcctccgccgtggagcgggcggaggcgcaggcccccgggccgcaggcggcgccgatggcctgcagccagtgcgaccagatgtgcaactcctcttgcgagggcgccggcagcgagccgtgcagctacgcctgcggctcgtgccagggctgcatgcaggcctacttctacaggtgcctgccccgctgcggcgactactgccgttccaactgcgtttaattagcagctggatgccacaactggagagacgggcgcgcgcttgcttttgttgcatttgagtgttattatgttatttaattatcgctatcttggtcctcggtagttatatttatactccctccttccttaaatatttgacgtcgttgacttttttaaacatgtttgaccattcgtcttatttaaaaacttttgtgaaatgtgtaaaactatatgtatatataaaaatatatttaacaataaatcaaatgatagaaaaagaattaataattacttaaattttttgaataagacaagcagtcaaatattttaaaaaaaagtcaacggcgtcaaatattttgtgatggagggagtatttttagaagttgtgtttgatcgatttgtgactctttattaggagtatatttgtagaagccattgatcctttgggtctatgcatagcagccttgcacgtaggtagctttgttgacactgtttctatttggttagaaacaaaatcaatgaactcagaagcaaatatttttttaattatcttcttataactgagaaacaacaaagctaaaacgctactttctccgtttcatattataagactttttagcattgtccatatttatatagatgttaatgaatctagacacatatatgaagtaaaaaatactagaaagtcttataatataaaacggagggagtaaaagactagtttcgatcttctgctgcctaacgagccataccacacaaaaaatggaataagccaatctcgataggcagtccgaactcctacaaccctcattcatgtttcatccatctttgattggttcgtttgccaccttgtcttaaccattggctggatccaatggatccaaattcagcaactcatgaccccccccccccctgtgcctttgctcgccgaagtcatccaggcaagggatgcagaggagacaccccacgccacaatttagccttgcacgaacagatccgaa

SEQ ID NO: 21193 - DNA, 552 bp, Oryza sativa
tgaatgcttccagtgccttggggtctgatgtccactctggcgtgtcacgctgcccaagatagatctcatccgctgagtgctttgatagaatctcaatgagcgagacaccgagaatggtttggaattggctggtgatggtgcggatgaagaacttctctgggttctcgtccagctctgtgtactccttggaacccggctcgggcatcggccgccggcttatggtcggacggtttggaagatagcccgcgtatgggtactgcccgaaattgacggctgcgtggagtgctgatgcaatccagatgattgtggtgcaggccttggtgagctcaggcaagctctgcatcttgggccaccagtccgcgtccttgagatcaccatgcccgacttcccgcacctccttccaccatgcttgcagctccacatctccctggaggacaccatcgtttgggtagtagatggcacagtactcagtgacccactgctcgattgcttgccagatcgccaggccatctgttgcataagggtagtccttgatcagtagcttcaccttgg

SEQ ID NO: 21194 - DNA, 2163 bp, Oryza sativa
aaattattattttattgacatgtacatcctaaaaaagatagttgctagtgtacaccttgataacttttgataaagttatagatattacgtaacacataagtagaaaaataaagatacaagatatgaggagaacagagtgaaatggagacacaagatatggtgacagtaaaatagagactgaagataacccctctactatgtatagtagttcagaagattacgtgagtatagagtaaaatgaagacacaatatataagagagcagagtgaaagataaccctctactatgtatagtagttcgaaaggttatgtaggtatagagaaaaatgaagacacaatatataaagagaacagggtaaaacgaagacacgatgcataaaatagaatgaagacacaatatataaaggaggagaaagtaaaacgaaggagacaggttcgtattcaagttctttaacctcctataactattcaagtaagatgaggccctgttcttttcttttttctaaacaaaagttgaataaatttttggataaaaatagtacgtatttcaaattgtatacggtacgttctgtgcgaaaacaaactgctaaacggtacgtttcgtgcgaaaacttagatggtaataatcaaaactcaattaatcatacattattatcatcttgttttgcgtgaaacacaaactgttaaacggtacgcttcgcgcgaaaacttggtacgtttcgtgcgaaaacttagatgacttagatggtaataatcaaaacacaattaatcatatattattaccatctcgttttgcgtgaaacactttaggagattcaaacaccaatcttattctcacgcattaccatcttattatgcgtgaaacaccattaggagattaggagattcaaacaccaacttattccagttctttaacctcctaattgttttgggcgggcctttatgggacaaagcccaacttcctcaacaatagctagcctagaacggtcagcactcacgacggccgacaatcaggccgacgtggcctaaccaagacacatcactcgttgaaaatgtccacgtgacgagtaggcggccatgtgtcctaaacaaaatggctttacaatatgtcattagacagattcgtttgccttcgctgtgaaaaacgttcaactgctctcagagacaacatgtactaatctgggaagccattttggagataataaaacggcaatcagcagattgctaggctgtaatgtagcattcaagtactgacatttgagcaaagagacatgggttcattcaccaattcttttcttacagaggaacacggaatgcatacatatgttcatcatcaactcaaatcaagcacaaactccccagatcgcttgctccccccgacctcgcttattatcattcacaactctaaatcgaaaactacatcgatcttacctagtagcagtagtacgcagcagctggtacaacattagactttaggatcacacgacacgtaggcacggtcacgttcgggacacactcttgactcggtcggtcgggggcgagactactacgaagcgaagcgaaacccagcaggctaaacccagcccgtacgcgacgcgagccactcgcgcgcgcggcgcgtgcttacgaggatgtcttggtgccggcgccaccgccggcgccggcgccggtgccggcctggtcggccctgccctggatggcgtggccggcctgcgccgtcttgtggccggcgtgcgcggcggcctcggccatcctgcgccgcgcctgctcgacgtagtcgggcgtgcgctggaacgcctggcgcgccgtgttggcgaggaaggtgagcgacgacagcccgccgaggcccagcgcgccggaggtgaggaagccggcgacggcgagcccgatgagcagcgcggccgggacgagcaccgggctgaagatcaggaacaccggcgtggcgacggcgagccccaccacggacgccgccagcgccagcccggacagcacgagcagcagcccacccagcgggaacagcgtcgccaccgtcagcgcctgcgacgccgacggcgccttctccggcaggatccccttcaccgtctcccccacctgccctctctgctgctggtagtactgcccggcgcggtcgcgatccgccattgctaagctagctagcaagatg

SEQ ID NO: 21195 - DNA, 4146 bp, Oryza sativa
gggagagcctgaaccagttggcaattcaccatctgccatggggcaggctgctactcctacatctcttgaggtagtagttagctcatggctagcagaccggcttccagtgtttggtgcggttattctcttgcggatgaccgttggggaacttgtgtttgggaacacccttctctcagtattccatacgcgaacctgatagatacacatcataaagtgttgttatcagtggttttcttaaaaaaaatactgaatatcagcagctcccctttctacataccaaaacaggcatttaaattcgcttgcaacatgtaggtgtgtaatagaaaaagaaaaggatctcattctcataagattcatgaaagttgaatgaacaaaatttgcaaggttaatcacatactcaccttggaatcgtcagatgacgttgcgatcttcccgacctttgatgcacacctgaaaattgtgaaaaaatcgtactgaaatctgaacattggatggttgataagatttacacaaaaaaaaactacaattgtatgtagaacataccagtcaactgaagtagcttcaccttcatggccttccaaaattataggacctctttcaggctgatccacctatgtcagtgaaaaagtagtggcatgaatagaaagtaaaagagcagctaatgcgtgtgcgaaatgataacatgatccaacaactacctgccataagtacacgttgccatcactcgaaccaccaagaatgtgagttccatcagggctgatagcagactgcatttgaccaacatatcaggtgttataaaacatagcagataaaactacctaagaacaagcaggcatgcggtttgaaaaatggaaatcaactcagcttgttcactcactgaccttgacaaaaaaagattcaattttgctgccagtgtaagccttaattgggcctttatccatatgaagagcactgtacaaatagatcctgaaaggcttataaagtcaaaggcagccttcacaaatggcatattaagtctgaggcagtgtggttgattgcggttatacctgttatccatgcatgacgcagcaatataggcaccatacgagtcttgagacaagcaagagatcccatgtttcacaccctcctgcacaaatgatcggtaagtcttgaaattgggctacaaacatattgcgtagtgattgttagctgcttaccaaaggttgcattgctgcttgagagcttctgttggagagagacaatttgatatttcgcgtatcccatatcttcacaatgctggcagacattattgaaagtggaacattaatatttggacagagttacacaaaaatgaggtaaattgtattcaaagtgatcatgttcgtattcaaatgtaataccacagacaacacatcatgccttttgaactataagaatgaaatgaatggggaatgacatacttgtctgcagccccagaagtagcaatggagatatcatccttcaaataaagaacagatgtgatactcgtcgaagcagcctaaaaattaccagcgtcagcaagttgaccacagtaggatgtatgatcatacccagcaatagcaaatccatgcaaattcaatacctttgctctagaccttgttcgatttctttgtgtgggactgtgtgcttgtttgacaacaagggaagacctagcatgtgtcacattccaaacagagttataaatatagtaatttgttatttctgtatcactgtagttgaaaggggaaatttagattgcaacagccaaggcaacatacatgagacaagcttcacggtgaccattaggggtttttgggtcgattcttagatcccaaagagcaaaagaaccatcccttgatccagtaacaatgagctctgcagtgaataagttcttgaatacaagttcctggcaaattttacaggcacaaatatacgaagaattgattttttgtttcccaacataacaccaacctgggtttgaagaatggcatgacagcgacttcacactcccggtgtgccttgacagaacaccaaggcatttcttgttttccacagaccatattttcacctgatacagaacaaacaatcccaatgatcaaaaggcagtccaccatcacattaatatgaattgtaatgcagaacaaacaaacaattctattctacttctgaaaaatgatcttattgcgatacttacagtctgatcgcctgatgcagtcagtaattgggaaccgtcctaaataaacaacgccaaaaagaagatgatacaagtgagtgaggattggcttttataccactaactctaacatgtttcaatgattgagagtaacaggtgttaccttgatccagcacacatcaaagatggcattgttgtgggcaacccaatcggacatcttcgtttcagctgcgagaatgtcacggtttcagaccggaacgaatcgaacatgacacccagtgcgtggccccagacatccacgaactgaatcgaacagtgcgaaaactagatcaaagaggggggatccaatcgaacctgatttccccaatgacgatgagctggatgggaggcgccggcgggtgtcgtagatgccaacatacccgtcctcatcagctaccgccagaaggtgagagatctgctccgcctgaaatgaaaaaaaaatgcgacggttcatcgaacaatcagttcccatcaaatcttaaccctttcgatgtcggaatcgggaaaaaaaacgcatgaaaacgaaggggggacaaaagatcccaggctcgctcaccttgcagaaggagatggcgaaaggtatggcggggtcgccggcgtgctcgacggcgatgaccccgctcccgcggccgccggggtaggaggagaggtccgcgaggtaggggagccgcgccgcggaggcgcgtggcagtggcaccctgccgccgccgagctcgcgtgcccggaggccgccgaagaacgacggggaggaccgcggccgcgtcgccatcggagggggagaagagagagaggcggatgaggaggcgcgaagggaggggaggggaggggagagagaggtggggaatggcggggagagaggggtttatggaggagttttggtcggcgggcggtggcgccggcgggaagagctcttttcgtaatcgcgccgcgggaaaaaaacgaagacaaaagaaaaacaaagtgaagccgcgaaaaggttggcggcgcgcggtttcgttttgcttccttggatttttagttagctcgctggcaggtggggtcccggatgatgacgtcattagtcgtcgacgttttgtgtgttgtgcggtagtatagttcaggccgggtttgataaggccttgtccaacccaagagaaaccttttttcccccttcttttctttatcattttcaaaccttttaatattaccttcgtattgtattaccttgaatacaaatgtactactccctccgtttcaggttataagacattttaactttagaaaaagttaaactactttaaagttaattaagtttgtagaaaaaaagtaatagtaaaattttcaacacaagacaaatttattatgaaaatatatttaattattgatttgatgaaactaattagtatagctgggtttagtttcaaactttttctttaaacttccaacttttccatcatatcaaaacttttctacatacacaaacttccaacttttccatcacatcgttctaatttcaaccaaacttccaattttagcgtgaactaaacacacctatagtaaatattactattttgtctataaatttagttaaatttgaaacagtttgacttatgacctgaaaacagagggagtaaatagcatgtcaaaaagatgtaccttcttgagtagatagcatgtaaaaagatgtaccttcttcagtttttttatgacaccattttttttggtgtacatatgagattcgtattatggaaatatatattgcttttttttatcatcgatggtaaaaacgtttgtggtgacttggttaatctcaatatatgtcgtccaacgtttagaaggtgctcatacgagtgagtgggtgaatgtcgtgagtgctgcgttcataccatgtttctaaaaaaactgtgttatcgtttcttttttgggattattttgttattagatgtattgcgtattat

SEQ ID NO: 21196 - DNA, 1466 bp, Oryza sativa
tagccatctgttaccccataccacaaacaaagaatatgccgcggtttggctgcaaggcaacgctgtcctttgcacccgaatatgcccagtttatggttttttatggttaattattgatactagatcgtatataatatattactggtcggagcttgataactccgagtaaaaaagctataacatagaataaatccgaggttctttttctcacgtaatttcggagataacaaagcagtctattactcgaacaaggaggtgtttgtgtttgtttcttatggggttgttagttgctcgttacagagttgcccgcataatgtgactggttcattcgttgcaacaaacaagtagcaactggttaaagcagtgactatattatcgtaatttggtttctagttgttactagcggttcgagatagacaaaaatatgcatatatggttttaaaaagctcatgtaaggattacttcaagggcaaattcaagaaaacggcgatatggtattaaagtacactgatcttgttggtatatcacgtcaccttcatggtataaaagagttagatgaccgaaatctacaagcttagagaaaatgtacttctgaatgaccgaaaatctactccacgttacctgcaaaatagtgatacaaactcttactatctttgtcccacaaaaataaacttagaattagatctgccatattccagtacaatgaatatagacaaaggtatgcatatattcatactagaatactccatccgccccaaaatatagcaatctggacacatatgtgtccagattctatatgcttacattttgggacggaggtaggatgttacatatagttataggtttttttttttgagagtagctatatttatggcgccatatttttcatgaaaaaatagtcggtatgtgtttacattataagtccctaaaattgcatatgaaattttagtgtatttacaatgtaagtctcaaaattacatatgtaagtcctaaaattacatatgtaaattctaaaattatatatgtaagtggtgtgtaagtgggatgtaactactatgtaaatttgtataaatatatgagaagtgtctctttttttttcaagaaaagatgtttgctatgctgaactcccggccttagcatactattattttagcactaatcttaacgtcaattcaatgcaccacaaaccgatatatttttaagggaaaaactgtcgtaacttttttagcgtgtctgtttttttatagagacggagggagtacatctctctctaaaatcgactgaacaatccccttttacgagaagaatatgtactaagcgttaagcagacgctgacaggccggctcccacctcccaagtctccagtcttcacctcttctcagtgagcgccgcgccgggttccagcctttcagcccaacccaaggccccaaagccatccgccgcaatataaaccaaaaccctaaaaa

SEQ ID NO: 21197 - DNA, 2830 bp, Oryza sativa
tgatatgttgggtcattttggagctattaacgagtgtagttgtggctatttttattggttttgttggagctaacaaagctgtctgggaaattttacacattttacgctgaagctttaagctgtacactccattaagctaattaatttgttcgatacgcctattggccattaggattaccttcactattctctgcgttacgtatagcttttatactgcaagcgatgtaggattttttttttctgactgcttaaaattttgcaatccgttgcaggaagctatgcattctcaagggcgtctttccccgggatccaaagaagaaggtggaagggaaccacaagacctactaccacatgaaggatattgccttcctggcccatgatcccttgattgagaagtttaggtacttaagttttcttgaaaaggtctaccatctgtgtttttttttggcggctacagaagtattcagtattcactcactgagcatttgaattgcatgcctttttggttgattgcacatttctctgtgcaattaagggcatataatgtatcactatcacaaaatttagctgcagacatatttaatttttaatgagataacaatgctttcaattttcttatttgttattaggccactgagataggcaatatgaaaatatcttaattgtgctagtgatcggtttgtgttgtgttcttgttatttgatttgtttgctgcaattgtgcaatttgtttctgtcacagtttatgcagcggagaaaatggcaagcaagatagaaacttgtattttattactgaatacaattgaggaaataattataatgtaggttttcagagagccattagctaggccatgtgaattattctcctcggtgcttcatcaatgatattttgatggttggcagaatggcagatagactagttgctcacaattacttgatcgttgacaagggaatcataattcatgctttatatataatctagagtttcattagaactttagttgatacagtgtggtgcatgttgtctttgcattaaaaagtgtgagttataagaccatgctattcttggtttgtgatgtctccactcttaatgacatttcattgttgtttgacttcagagaaatcaaggtccacaggaagaaggtcaaaaaggcgtttgctaagaaaaataaagatcttgcagacagattattgaaccgaccaccaacttacaaacttgacaggcttattcttgaaaggtaccaggtttaaagtgatttgctgatgacatccataccgtatttgtttctataaatcatccccatatttttgctttacagatatccaacttttgttgatgctcttcgtgacttggatgattgcctaacaatggtgcatctttttgctgcgttgcctgctgttgaaggtgaacgtgtgcaagttcagcggattcataattgccgcaggtatgctctgttgtaaatgaatcccctccctcaaattcacacacaacactcccagccaaggggctcttgtagtttcctagttcatttgttcatcatgctacaagtctatgacatttgccccatctttattgctgctataatgaattgctgtacctgactttgtttggcgttgctaataccttttattaatttgggggacatgtttgtactttgtaggttgagccatgaatggcaagcatatatatctcgaactcattccctgcgaaagacatttatatccgtcaagggcatatattatcaagtaagcttgtgtagttatgtctacttgcagtccttgcctttaaaatcactgtaactgtgcatgctatagtatatatatttatataatataactactttttgcaggctgaagttcaaggtcaaaagatcacctggctaactccacatgtcttcagcaagttttaactgatgacgttgacttcaatgtgatgcttacctttttggaattctatgaggtgacaatgacgatgatctgtcctaatttcctaattactatgtatttcctgctttattcaccaatatagcaccacttctatccaaatagtactggaactgttacgaaaatttgatccacaataaaatgcgatggcacgcggtaaaataaaaggaaatatcatgggggtaaatgcaagcccatttctttaagtgcaccattctgggttctggggggttctgtcttgcaagaatttgcaggctacaatcttctatgattgctgctattgtttcaattgtaggtctgaagccatatatgcttgttttgttttggaatctctgtttaatatttaatattctgttgcatggaagatatgactattgtaaataaattatgttgcagtctggctataaccatgtacacctgacagacctatgatcatgctgaaaatgttcagatataatgttacgatacctagcaataacttttcaagattgatcacttagtatatataaaaaaaatgccgatctcaacagtgtttggtacaatggttctttcaattttttgactgttctatactacctgcagacacttctgggatttataaacttcaagctttaccattcgataaatgtaaattatcctcctgttctggatcctcgtttggaagctttagcttctggtaagtgttggtgcttattgtagttttgttggtgaacctacgttttatccttctcaaatagctaataatttccctttattttttaatttcttctttttcgggatctttttggttgacaacactgtttttctcctattctagctctatgcgttgtgcccgtacatgtcttctggaagagtccctggaaattcagaacctgctggactaattg

SEQ ID NO: 21198 - DNA, 912 bp, Oryza sativa
tttttgtcactggattgcagatgcaaagcaaacatggcgtgccacggatatgatgatatttgaacgtggacttcttaaaccgtgctccacttcccaatgtatatttgttgatgattttgtgttatatgaattctatttgataacagtggagcgattattgtttaattacggtggtgcagggttaattaggaggtgagaagtacagatgctataatactcccggattatcttcctgctatgattctataagcacttttatcttagagaaaatttcaaaaagaaaacccgtgttttggggattctgtaacacaaaacgcccagttttgcaatttgtttatttgtcttatatatttatctgtaagcacttttatcttagagaatgtatgagatactttttagtacatatataacattagttgctttttaacaagcgttgatcatttatgtgtatatttaacctattattatattataattaacatgtattatgttaatctttttcagcacaaaattgagaaaaaaaatgaagtagacgagaagaatatgtccttttagccaactaatgtgaattgatgtagaaaacaatcttatgtaataataaaatatgagtattttacatgaatatgaggtttcttaaaacatttggctcaaaacatggggcttcgtgaaacaaatcacagtaaccagggttttatgtaacggatactccaataactgtggttttgtgaaattcactctttatcttatatgtaattattatgttttcagtggtagacgatgtacccgtcgatagcgaggcgcctgtggtgacttcgtcaatctcaaaatttgccggctcagttatcgaagatgctcataagggtagggtttacgtacgtgcattcataaggtgagtatgcctgcattggagtg

SEQ ID NO: 21199 - DNA, 647 bp, Oryza sativa
ccgatatatgcttatctgtagtcgtatgttagctaggatggtcaaacaatcatcatgtacgaatctgattaaaccaggtctagatgctctgacttgcaatatattgagcatcgacttgccattgtaaactccttaattagtcaacattttaccacgatcggagcatacgcacgctacccccacatgcacgcatgctgatcatgcacagcacatctcggtacccggtggtcgcctgtactcgcgtactgcctataaataggcagccgatcgatcaagcagcttaatataaactcctcggtcacttgcaaatcttctctatcttataagttctgaacaatggcaggcggcgcctcttctcctagggtggtcgcctgcgtcgtggtggcgctgctcctcctgtccttcgccgtggagccgctgcaggcggtggccgcggcggcggcgccggcgacggcgacgaagccgatccggtgccggaagtgcgaccacgcgtgcaagaagtcgtgcaagggctacggccgcaactcggactgcagcgtcccctgcggcgacccatccaacaaggccggctgcaagagctgcctccaggcctactactcgaagtgcctcaactactgtggccaggcctgccgcgccgtctgcatcaa

SEQ ID NO: 21200 - DNA, 2228 bp, Oryza sativa
atcatccggaaggccctgttccgtgaagttccagttcttgtaaactgctgaagacattgccagagcatgtttgccaggaaagacagtttgttcgaaaatgccaccgccgttgatgagtgtctggcgtgccaatgcattgattgtcatcgtgtcgcgatagtgtggctggaggagcttgtacacagggtgtgtcacactgagctggcggtttgtagcgatcacgaagggctccatcacagcatgtgtgttgagcctacaagagtttacatcaatgatgaggttagcttactgctttcaggaaagaactacagtttgccactgccagtacgtaccagtggctgataagctggtgccaaccggagtcattaacagcaacataagccttggccagctgccacacccaagactcaatgccacttgatgcaggtgtatggaccttgctctttgcagatgttaggttgccctcgatgtgtggcaagctcagttcaattgctagtggcttcagggtatcatcatcacgtaagaacaacagggtccttgtggcataggtgaagataccatcaaggctgttaatgtcaatgaggaatggcatgaaatgatcatgatgatccagaatgtagagcctgttgctatccagtgcctgtgcagagccataattgacaacaaatcaactttggcagtttgtcaaatgactatcgattgcactgtaaatgaaatggatcactgcctaacctgttgcacgctgaggccttcgaggttcttctcaatgtgagctggggtgattgtgctagtctggtcaccgtacttgctaggatcaagagtactttttggtgggaattcctatgaacagagaattatacattagcatcagcttgttttgttcatgcttgctaggagcacaaaacatcaaagactatgtaatgttggatagttcaccgtgagacgcctgatgaccatgggattcagaccagcaagaatctctcgtgcaaattcctcatctgtcctccaagcaacctcgttctctgcaacaatgcatagtacaacagttcgctaattgtccactgctcatcgactatggcaattgacacaatggctaaatcatggtacctttgatgatatcaggtttggggaacttgagcaggtagctgcctccaaccggaagcaggtccttgataagttggacagggaagctcttgcgcagctcctctagtgctgggatgctgggaagcttcaggcctcccctgtagagcttcaagatgtcctcgaacgagtcaaattcaccaggtgtgagatcaacatatgtgcgaatggcaggcaagatgccctgaacaattgccttgatcgagtacccagcaaagtctgacatcttgaggtgcgcgaagcgctcatcgcttggcacgtaaatttgttccagcagtgataatctgctctccgagtttgggtctgcagccatggatattcacgcaaattagatcttactagtttatgaacttgtctgtcaagaagtgctctctagatgcacagaaccaagaggaacactgtaccttttttggtcggaattcggccagtacggccacgacgcgggtaggggtgcttctgcgagccacctaggacagggcgtgggttgtccctgtctggttcaccgaggtcattgtaaacatcgtaccggtagatgcggtcatgctcttgatacggcccttgcctgtcctcccctctgaggtacctcagctcgtcttcacggtatggcctcagtgcttctggcatttggctgggaaggtaagactgcatccaatggaagataaaactgtaggaattaatatccagattccagaactagagaagtcctcactttgcatcacagacttcattctcttaattattggcataatagatgcatctgatgcactcttgcagttgccacaaactttccatttgtgtctagtcattaattttggtgttcgtgatttcacagaaactgttgctccctattactacttcactttggatgttctgcatgtagtttaggagcttaattgcagaactttttactaagtatatgatcgatgattaattaaatataatatagtcattcactatcgtttaaactatgcacttacaagatgttaaattactcacgataaccttaaacaggataagaagatctgccaagaacagaaagggaggcgttgtggtatttagacttgctaatcactcctgacttacattgg

SEQ ID NO: 21201 - DNA, 1743 bp, Oryza sativa
ccctcattgtctgcacatagcatataagacaataggttagtcacttcatttgtgtcactggccgtttgcaccttgtttccgttcaatctgtgctgagtactgagtactgatccttgattctttctacatagcaaacatgtacaaactcatgcaaagtaagcgaggaagaaatggagaaagatcagtactttggtcggcaacagtggcgctgacaagctggcaggtgatgctgtttccaaagacctcatggacgttgtcaaggagcgaggcagtgaagtcccttggatccagtaattttcggctcatcagcacagccaagcctttgatcttatttccatttttccctgtcagcttgtccttgagccctcccagcattctgtgatactgtagtcagtgacaaaagaagctatgttggtggtggtgtgtgtatgttgccgttgcaatggatggggaagaacttagcaatgcagctgagtttttatagaagggggagagggaggttcgcgatgtcagtgtgcccatgagtattggctactaatgcgactatgcaagtggatactatgtcaagtggaagaccgaaccccaaggcatcaactagcccattcacttggacaacacactgtaagttgctttcttttagtcgagaattgtagagatatttctcctgttttgaaactttgaagagtatcacattttagcttgaaaattttttagggtgtaattcgaagtctaagagatcgagctggtcatccttgtctcacagccttgtcaaaatattaatacttattcccttgttgatagaaccaggcaagggttcgacatttttgagtcgtatgagctgggttcatattggcattgaaatgaaccatctgtatgtgaaccttaccaactcttggctcttgaggtgtgctgccaaaaatattcgaacagttttcatgggtgtgatacacattggcctcctgcctagtactagtatatttctacattatcctttttattatgaggtttcacccttagtgatcctatagaagttatggcattacattagtatcaactgtcatttacagtaaggtgttaattattccctattggcctcttggctttacttgctgacaggtccacttcagctgcacagtatactggataagcactgaacgaagactgtattaacttattagcagtttgaaacgtatttgatgcccgtgccaagcaactaaacaagaggccttcgaattgtcattgacgaagacctgagctacgggcctaaggtgtgtccatgttttactccagtttggatcatgtgaccggcatcttggatcttgccaattgcagtcccagaaattcaggtaggagcaaatgaaatgaggagcatatgcaaattgggactatctttaggacacgtttgcaggcaggattatttttgccgtttatatgggaaatcgagctgatttgaattagattcctgtatttggtttcatgtacttgagttgaatgcgcttaaatgcgtccgatttccataggcttcagtagagcgtgtttaatgttctttctacctccaattttagcaactctttgattctgtgcgcatgcagcatatttcttccaaggaagtacacctatcatgaaagattcgttgtaaaaatatgaactaaaatcgaaccttccaatcattaataggacttctccagatttgaccactaacatggcaacacataataagattaagtagaacggccatgtaac

SEQ ID NO: 21202 - DNA, 2557 bp, Oryza sativa
gttcttatggctacacattatcagcgtctcagtgactagtaacctttgttcatttcattccagatgacctcccttctcagcaaccactcagaatattctaagctccagtgtctccatctttggataaaaagacatgttactgttgtttaaaactatcggttgtcaaaattaagtgctgcttggatcttccacgggtaattaggggcaaatctatatgagaatcatacccttttgtgtataacaagaaggataactaggcgcaaatatgcatagagctagcgatagagccataatcgagcatcagacgggccgatggttagtacctggatggagtacttgagcgcgatgccggggacggtgtccccgcggcggacggtgtgcgagagcgcgaaccgggcgagggacgcggcgcgccagaaggccctcgtctccggctcgccgacgacgcggcgcaccccccagggcgacgcgaaggcggcctccagcacggcgcggtcggaggcgaccccgcgccacagccggcagacgcacgccgccctcgcgaggtcgggcggcggcagcctctgcaggaccgcgcgcaggaggtcccccgggaagtcgttgctccccccctccatcgcagccggggtacgatcggggcaaaggcaaagacggatcggagctcacctcgggcgagaggaggatggctgtggctgggggcgatcgtgcgcggcgccagctccgccgctaccgcggccggtggaggatcggaggagaggagggagatcgcgaggtgaggcggctcgcgtgcggtggcgcggccgtggcggagtctgggatgatatgtggtgtggtgttgacgagtggtgtgcgtgcacggcgcagcagccgccgcgtttgcttaacgatccaatttttatctgaaaaacaaaaaacataaatacgacggtagtagtattttaacggaatagctaacgcgggcctagaaaaccatgactaaatttagtccctctcacatgtttctgtgagagggactaaagtttagccctactttagtccctccaaccaaacaccacctaatagctaatcttataataacagtagtctacttataaataatttgttcgagaagtttaatattttgaaaagcagacggttgacaaatcagcttttgagaatttgaaaaactatgttttcctagctttggacttttagcttatttttaagattctaccattacaacttctcaaaatctaaattaaaggctgaactatttgagaagtttctaattctggaagaaattgaaactagaaatttctacaaaaagatcccgaatcttataactatgattaccacaagtagatcgtaaatcttatacctatgtattgtaccgatactaagggtctgtttagtcggtgaaatgaaaatttttggatgtcacatcagacgtttgaccagatatcggaaggggttttcggacacgaatgaaaaaactaatttcatactccctccgtttcacaatgtaagttattctagcatttctcacattcatattaatgctaatgaatctagacatatcccacattcatattaatgctaatgaatctagacatatatatctatctagattcattaacatcaatacgaatgtgggaaatgctagaatgacttacattgtgaaacggaggaagtaactcgcatggaaaccgcgagacgaatcttttgaacctaattaagccgtcattaacatatgtggattactgtaacacttatggctaatcatggattaattagcctcaaaaaatttgtctcgcgatttacatgcaaagtgtgcaattattttttggggcaattgtgtttcagtccttgatttacaattcaattgtgattttacccttactttttagggtttgtgattttgcccctgcttttatgaaatgaagcacccgtctgcctctggttttgacataagtttggtgggcctgaaatttccgaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcgcgcggcggagtcgggcgcgggcagggaggtgcggcggcggcagcgtcgcggctggcgcgcgcgcagggaggtgcggcgctcgcgcggctgcacgcgcagggacggcctttggaggcgccgcgacgaggatgacggcgaggaagaggacattgccgtcgacgagagggactcgctcgggctgccgttgccggtggtgagcaactgctcctcgtcggagtgtgagtacatggccgagtcagaggctgagctggcgaagacggaggagaagtgcgcgtcggcgtcgtcagcgtcggagtacgaaaagacgtcgcagtcgagcacggggagcgtcgccttccatggcgctgccgacgccggaggagacgggcataaggtgagtgttagtgctgcttctattattctgcgtt

SEQ ID NO: 21203 - DNA, 2048 bp, Oryza sativa
aaaagtttttaggaactaaacagggcctaatctggttcatgtctggtaccatagtaatagaactggtacctaccataccgtgctgaagttacgttaatgtaattccgttcaacggtacggcgttatgtggtatgaaaatgctcctcttcgaacgttcaatcaaatgaaaaacgtcggatgcctacgaccagctcagttcttacatgctaatttctcctttctttatgttgatgccagggaaatgctgcaaatcagcagtctggtggattggacgaacccttatcgtactgtaatatacatgcacatgcctagttgtttcttttcattctttcctcctctctttaaatattttttctcctaaattacttatccgatctatggaccgatcacaccgttgtattcgttgcaattaaatatttacaataagatattacatgattatattatgtcaaaagaaaaacatgtgtttcaaaccattaaaacaaaatgtttcatacgtgttagtgatatgtttcaatatgtgtcttgtttcacaaaattcctgaaactacctgctactactctctctccacctcatgcatgcatacatgcatatgttttagcaagcttcaaaatgatttttccctcaaattacctattcaatttatgatccgatcactacattgtatttgttgtaattaaatctttacaacaagatatcgcttgattatattttgataaaagaaaaacatgtgtttcaattcgttaatacttgttgtttcatatgtgacagcggcatgtttcaacgtgtatcttcaccatatttcataaaatatctaaatgttccaattgctgattttctttttcaccatatatatagcatcatgttttacttgttggttaactgcaatatttaaccgttcgatttttttttcaatttaaaaatgtttcacctaatatagtcatgatgtttcattctgtaatgatcaaatgttaccgtgaattgaaacattctttcgctattcgctgaaacattattttcatataagatgaaacagcatccgataaaacattttcgatctacttaatgaaacaattccgatatacttggcgcaacagcgtgcaacagtaaaataattcaataataagctaattttttttatcggattatattcatgtgtggacttgttttaaaattttaattgcaatgaatttaatggtgtaatcggatcatgttttggataaatattttaagagaaaaaatagtctaaaatttgtttaatccatgcatgatggatggctggcgcacctgtgcatggatcgaactgtcgcgcgagacgtccgatttttcgtttcgcgccgtacgtccgacgcgtagcattctccgagtactcgctaaaaaaatgatccaatttgggattcacactcgtgggtttgatgagccggaagggagcacgtcaaagtggggccagttaggacggcccattaggcccggaggagcgcctatctgaagtccaacacccgtccaggcaccggctctccgccgctcgaagcttctctcttctcaccggaatctcgagagcacagcgccgccccgacgacgagatccctcaccggcgccgccgccgccgcggccaggaggccgaggggccatgacgaccatccgccggttctgctgcgacgacctcctccgcttctcctccgtcaacctcgaccacctcaccgagaccgtgcgtccgccctaaaccctcgccgtctcctttttcttctcttgatttcgagcttacccgtcggtatgctcgtcgcagttcaacatgtccttctacatgacgtacatggctcgctggcccgactacttccacgccgccgtcagccccggggaccgcgtcatgggatacagtacgtgttcttgcccttgggggcggctgggtctgtgctagctgttgctagtgattctgcgtctttgtttgtcagattcgctgaaattgtagagtaaaccctgcatttcctctggaaaacatgagaatttagggatcttttggggttacagtgcccgattggaatgtggt

SEQ ID NO: 21204 - DNA, 3443 bp, Oryza sativa
acttgtatggtgatttgccaagtgtcttttgtctccagtagtatcatctagtgatcgtgctgttttcttttctgcatcctgataagattcaacataactctgaaggtgattctatcgttttggaatggaatgcagcacttagtaagtagtctatcttggaatgaggtgctatcttgtaaccataccgttattttcttgtatcgaggagttccacgtctgtatcattagcctccacacgattagaaaccagatgagaccttagtatagataaaatgtgaatgggccaagtctgatattctgcagatgtggagttttgaccttggtagcgggcgtaacgcgagatcacaacttcacatacgttagcactgcagagaggagtaagaaaattcatcaaacatttaatataaaattgccaaatttcttaagatttcttctcaaagttacatcaacccttggaatactgataaacatacgtgaagaacttgcactcgtgtttgtttgagctatgaacgtcgataggaaaaatcatcgatgtatgtaagtcgtcctctaattggccttaaatatgactgtagccggtagctcccatatccggctctcattttatcgtgctcaaaattccactaatatattgacaatagctagaaaaagaatatccattggacagcagcggggaccgtatttaatcttgttagggcaaaaaaagattttggaattcctacaccctccaggcctttatacagtccaatcaaccagtgtctttcttattagggaataacaaaattggtattgccctaaacaacgaatttgataggatacgtgcttcctgaagtccccctatttgtatatgagagcatcacgccctggtcctacgccgatgtaatggactgggataccaaccagctcttctatcctctccacgtacaaacgagcagtctctgggagatcgctgtagtttcgtacagaggaaatgtcgtcctcccacccaggtagaacctcatatttgacctataccaacagagagaacataagaattttcatcaattaccaagagtcacattgagtgatttagtgctctcatatgctgcctgtaaaattatggcatggaatatgagtaaatggaacaggatcaactgctcttcctcaccttaattttctccagaagatcaaggtctgcagggaatgattcaatttctttaccatcttcagtacaatatgcaattcccagctttacttccttgaggccagttaacacgtcgagtttggtcagatttaaagatgagaaaccgtttatttggcagcagtacttgagtgcaactatatcaagccagccacagcgcctcggtcgacctgtcgttgtcccaaacttcattccaaaagcgcggagcaaatcaccagtcttacccaacagctctgttgggaatgggcccaaacctaccctgggtgtgtaagcttttacctgcacatggaaatattaagttttgtagggagaggaaaagtatggattgttaagaagtttaaagatagctgtaccgaccactccaatgagatcaccgatacttctaggagcaataccaaggccagtgcaaataccaccagctgagggactcgaggaagtaacaaatgggtaagtaccaaagtcaatgtctaacatggtggcttgaccaccttcaaccaatattttcttattctgcaagattgattgattcatgaagtgcacggtatcagtaatataaggtcctaaacgctcggcaaacttttcgtacttctcaacctcctctttaagggtcttgcactgtattcaaatccttcaaagcgcagagctgcatctctcagcaaggtattgagtttagcaccaaatgtatccatatgccgcagatcactgactctaagtccattccttataactttgtttgaatagcatggcccaattcccctctttgttgttcctataagggaatttccaagctctacctctctgagcccgtcaacagtttgatgaaagtcaaacaaaagatgggcacgatctgatactaaaattcttccttcacaggaaattccatttgattctaacccatcaatttctttgaagaacccaggaagatgaactactgctccattaccaactacacacattgtcttctcattgaggatacctgatggaacaagatgtaatgaaaacttctttccctctgaattatatatagtatgcccagcattagctccaccctaataacataaaacattctacaagttaaaacaatatatatatatatatatatatatatatatgatcaaatcctattggacaaaactaagtctagtcttattgccaccttaagaaaactgaacttcataaaggtgtgcaaaaacctataaaaattagtcaatacaacaagtgcagagagaacagtaggagaaatgagcactatgtaatcaaggttttccatgaagcaggataatcattttttttaacccataagaactgcttgtgtaaagtgaaaaggcaatatccttgccataaaggaaatgcaccattagttatcaatactgcattactgcctcgactagataaccggaagggttatcggtattttaagatgttttataattctattttgttagtacgaaggattcgacattaaaaaaatgaacatatagaaggaatatccattgtggttatgggtttagaaaaattgggaatagacaaaatgctttctgcagatatattaaactgatgcttagaatagttcagctatccttattcgttaatgatgatacagccataaaaattatcatcataaaaattaaagatatattcaagaatgagaaaacagcaaggctctcgagtctcatcaagaatacgttgagatcggaagggcttcacacaattcaagaaaactggggaccaatggtacaagtacaacccatgctgatatcagtacttatcatcaaaaccaagcaagaaccaaaatggaagggagccttggactactaagcttccttcgtaacacggaatttctcctgttctgctagagttgaatttcccatgtataaaacgactttctgtgatagtgttgcgatcaaaggagtacaaagtagcagtagcttacagtagtacggtaaaggcagtctgcgtggatggcgccggaagataaacacccttcaagtaacgatcataaagcaaactaacgcaaattactactcccctctgtcagaaaaaaaccaacctagtacggaacgtgagacatcctactatgttggtttttttggacagagggagtccatctcagctaaaggatcgcctctggaaactcaccagcgccaacgggagaactcgtactatcctaccacaaggaaccaattaatcgaacaccttccggacaaactgacaaagcaaagaggagcagagagcgggtgtgtttggttgcaagccacacttt

SEQ ID NO: 21205 - DNA, 2070 bp, Oryza sativa
cggcggggtccaggcacggagggaagaatggcatggcggcgacggtggagggaaatcgaggagagaatggcggctggtggtgggccctccccgcctgctgctgggtttggaggcgacggtcgtggatgtgcccgttcgttatcttctctgttcgattctcccgtcgcgagatcggacggctcggatgtttcagaaatgattttcttcaattgtgtgttccaaatcttcaaaaattcgttttggtcgagttttgggggaaagtaagttgttgaatttcaggagatttggtgaaattcgtcatatcgcccgggctcgcatttcaaacaatgactttcagaacgcgtggtttgcttatttgcgttgtactttgggagcaacagtttgaacacagatttaaatttctcgtttaaatgtgaatcgcgctgcttgtaaattttcttaattttgatttgctttcattctagccgttaaatttctggagctaagatcgccatctactcatcatgttgcattttgcagcatcaccaaccggccaacagatatcaggccctaaactcctgattaagaattatgtagctagatgagcacttgagcagcaaccgcgtcaaaatttggaagagtaatagctactaatcatcagggaacacactttggacactaggtaaatagctcaaaattttctactgaggtatctgggcatattcttaaagcccatgtaaaacacctaaacatcaaaatggagctgcttatcatgcataagaatacgtaggtgtgcagatcatggcagcaactccacagaagcagcgaccgatgaacaatttgtcaaaacagatacagcatggagcaaatgaagttcgagcctcagcgacctttggccgaagcactggaatcagcattctttttccttttcttcagcaagttcaccttgtcctttttcctttcctggttaatctgtagttgcaaagggtaacagattagtttagctcaaagccacttaaatttacgctgaaacagggaaatgcttgtggcatctacaaggcatatgttataaaatttggcaatgtggctaaaatttcaatggatgacatggctgcaacaatgaacggatgtgaaacagcaagcaagcagaaagtgacaaatacatgcaaggcataagagcgcagacctcaattgcttgaagaaggcctctctgcttgcgagacataagggtcttggaaatgtcagcagcatccttctcggcttgtttatgagagtcctccatatgatcgtcagcttctttagtatcacttttgtccacaacatctggttggttatctgccgtcctatttgagaaggtctttccttcgtattccatcctcagctcatcgtggactgcttctctagcatctccaactttagaagagaaaaaggcaaaatgagacaacagagaatgctttctgtacaagaagcaaataagatgacagcagaaaggactaatgttttgtactacatggtgttgaatttaccttcctcttcttgtcagcaatttcattagactctgatcgatcaataattgcccctaccagtgaattttccatatcttcgtcccttaaacttggcagaggcaacacctggctttgagcagcagcttgcagcctcttaatggtctctgcatactcaggaatgtaaccctctgcatcattgtccacaaagggagataaatgtggtggaggcaccctgagaccaaaaaaaaaaggaatattgatggcaaaaattaggacaaacataagtataaaaaattagatcaacttttatgcatctttatagttcatttttgcaaactgtgcaagtacagacagtaaaaaaaggctgtcaatttaactaaatgttaaattatacatgaactatatttcagtaaagttgtttccacctaagaaccatcaatatgtgcaaccaaaatgtgaaaacagcatgcgacaaattaaggtattgcagtacagtgatttttaattaagttggaagtgggacaaacattgggctctcaactacaggagtgcaaatattatataatcagcacttaacaactattaa

SEQ ID NO: 21206 - DNA, 726 bp, Oryza sativa
attggacgtgactacacaactagtggtagctggtttatactccatctagtgtttcctttcaacttgaagaatgcaatagtatgtttccgttttgttttaagatacttttataatatatgtaaattacttttagactttattgaatttacttttatatgtctaagaagtaacttagtcaaatctaaaagtaacttatatatattataaaagtaacttatgtatatatcaaaaataatttacaaatataaatattttttcatcgtaatataatcatgtaagatcttgttgtgaaaatttaattgtaacaaacacaatggtgtaattggattgtagatcggataagtaatttgagagaaaaaaatataagaaggaagaaaaagacatgcatgtctaagaggaaaaacaagcatgcacgtcagcacgtgtagcagtccttctggttaacgctaaaccgagaagcttctcggtttagatttttcctatttatatatattgttcttacaaaaaaaaatacactaaatttgccatcaatcctacgtgttctgaacttctatgaggggaaaaaaaagagagcagacatggaaactaaaatatcctatctttcgaaaatcgaagtccataccatttcctaaattaatgactttatagaaaccatgtttctgttagaaggatgtattaaagaatacaaggaatcatgccactgatacgcgtccacaaaatactggt

SEQ ID NO: 21207 - DNA, 840 bp, Oryza sativa
ctgaccatgtgagctgtagtagttctgctgttaattgatataggccataattgtccttgcacaagtattaaggaggtgataaaattccccgcaaaaaaaaaaaggaggtgataaaattgagaatgcttactaggaatttagttctgttatgtaccatctcatgattgtttttggaggatgagggaatacttagtagtttgtatgggttttaacgaaagctgcatactgaggaaagataataagcaggggcatggttgggaagctcattccatcgacatgcaggcattataaaatcagaaaatatctcaaatatatacctttaaattttcaattgaggactgattatcatatcagattatcagctatgatcataagcattgcaagctagaaattgtagtatggtaagacggtaatgtattactgttctggcctactagttctgtgaacaatttccattcagtaggattctgtagagtttaactgggtatttccttccactaagcacataccttagataaagaattggattcttgaattaaaaatatcagcctgttccattgctctattgtggtatacttgtttttgctaatgtcccatttatttcgactttatgattccataactgttgttgtcatgttatttattatagattctaatattacgctaaaaatggttatcctttcagggataaggcctactttgtggatctcttcgtaagagcatctaacatgccagcaataaggatgtatgaaaaggtaagcttcatacaaatttcatgatcatctagcactctaactcactgatttatatgattacacatttatatatgaatactgaata

SEQ ID NO: 21208 - DNA, 2509 bp, Oryza sativa
ttatcccctctcttttttatcatgtgtctaggggagggaccagaaacctccggaaatttccatttatttagctcatctgtggtttgtttatacatgtacccttttcatccaatgaccattgtttatccaaatccttcatccgatggctaatatatttataatgatttggcacgttctcgtgtaagaaagcctgctgctttcattatataagataagataagattacccttacgtgttaaatattacctcgaatctaattatattttggccataacaaaaatattctttttccaatttaagagtataaatctatcagaatttttttctccccatatataagtaatgaatctgaattggactttagacatagatataacactactaagggtagatgtacattttttagagtttttttctcatatttttaagttggtgtatatggtgtgcacacaagaaaatttgtatgtataggatacgttttccaataaaaaatgctcgatttattgaccaaagttataatatgaatagtcatcggtgatatagatgtattatttatttattttttttcaattttgtatggaataagctgagcgcgatttctctaggtgtgtgatcgacagcgaaaccttgaaactgtcgatgattcctctttgttccacgtgcacacaccaccggaccgcagcagattgcaagttgcaactgcagcatccttaatcaactcaataaaaaaaaagcgtgcgcatgttatcctagcgtactaaagtactaaccttaaacaaggctgcgtttgaatgtaccatgacctttgaattatctctcatttttcgttagcatgttaaatggcacatttcgtgaaatgatctatataaaaattgagatcatctatttttaacattatattaattaatatttaattaattatatgactcattggaacggccccgttaacatccgtgcatgacgtgcatggagtcatgtctgctgctgtgctgcaccctaaaatgcacaggtagaagcacaagaagttacgtacaactgcgggggattggttggcattacatcccagaccgggcaaatcggcaaattgatacagcgttgtgaacgtgggagggcgaacatcaggcagggtaagctcagaactcgggaagtttcagaacgtgaaccacgcgagagggagtgagtgagggacggtcggaccaccagaaaggcagcgctgatgggaagaatctgggactttgtgcaaagttgtgtgaagctaccgcgagaccgcgggacggagctgggacaatcagtacacgatctgcctttccagcggccgggcacttcagatctagtcgctgtgctagtactgcttgtcaccagccggcaaaccaaaactttttgctcactcacagaaatgtggttgattagacccctttgctgttaaagaagatgagagtgcatgttgctttctttggcgtcgacaaaggaacgaagtctcttcttgacatgaagacacccagggcatcttttgaaacacgggattaaaaaaaaagaaagtataaaaagcacaaaatgtaaaacacacatggctccaaataggtccttttcttactggttcaaacacacctctgttaggcctccctaagttctctccccctttttttttttccttttttggaaaaaaaaatctgtagtcgatcatcttaacacctgtgaaaattggttcgcatgcggttgtgatgctcgcaagtgaatattgtgatttttcacatacacctggagctagacagttgcttcacccaccagcaaaaaatacttttggctgtctaaaaaggtttctttgtagcagtagtagaaaaagactatcaataatagatttgagtactgctgctacagtaccttgtatagtatgtgctaatgcatggaaatgcagtagtacaagacttaaacgctgcggttttttgataaaaaaaggtgatataaaaggcttttaaaaagattcaagtattttttaaaaatctataatagttaacattaattaatgatgcgataattgagtgtgttctccggcaaccaaaatgacaactcacctcacaatcttcaggggcttttggctcttttaaggatagcatggcaattgaatgccaatttatcgagaaagagagatgacacaactcaataagatttttttatgtgtccctataattttgttaacacctcaccattcttaaaaatgcttgattatggggagtaattaaattgcatgtgcggtacacagaaatatcatacatgtgcaattagtacataaactaataaaaatatttattctagtgcataaacttgtctagtacatatgaatcaagtcttcaacgatatattataactaattaggatgtctcacacacatataaggccatgagacatgttgtattcgttgcatactccctttatattttacgttttttattcgtataataaacattacttatttcatgtttgatcaagcatatgtatacgtaggtaacat

SEQ ID NO: 21209 - DNA, 662 bp, Oryza sativa
ccagatcgaattctacaaaaacctacacatcaggacaaagagaaaaaaaatcgtcagatttgcttccaaattgacaagcccgtgcataatccagcccataaacccactaatctgtttaagcatcaatagtctgtgccagaattggaccaagttgtcatgtgaattgtgaattcaacgatcgttatgcgcttgagcagcagcctacattcccacagcaaaggtatagaagtggtattcagacagtaatgcaaggaggaggatggcaaggaactaacagtttccggtgattctcccatatctttcccaaacactcggcaaacttgctcgtatgatgacaccgggcatctcttcagcatcgacgccctcatcgtctgcacgtactcctccggcacaacatactcctggaacaaacaaacaaacaaacaaccagctcgacctcaactccacgcagcaaccaaaatttcagcaaagacgtcacacgaatcaaagggaggagcccgatttcccgtagcacgaaccagctgggcgatgtgctggccgagcttgatgtaaatgccgccgttgcggaagcagagcttctggagcggtttgcggaacggaggtgggcgtcttgcttggcgctgacccaagccggggtgccctggtcgaggccccaaagggag

SEQ ID NO: 21210 - DNA, 193 bp, Oryza sativa
aatttattgcgcaatattaaccagggctgacgtcagcacggaggggtgcggcgccgacaggcggggcccactggtcagcggcacgggggaaaggaggggcggcggcgccacgtggcggccgaaccgacggccccgatctacccaagggtagatcggacggcggcgggacctcccggccggggcgcgcgggcgc

SEQ ID NO: 21211 - DNA, 1044 bp, Oryza sativa
tttatatacccgattcaaatttgaatttaaattcaaatttttttatatatagtatttctatacattcaaatttaaatttgaattcaaatctttttatatatagtatttctatacatctaaagtttatacacctaaagtttataagtcaaaagtttacatacccgtttcaaatttgaatttgaattcaaatattttctatatataatatttttatgcatctaaagtttatacacctaaagtttatagacctaaagtttataactcaaaagtttacatgcccgattcaaatttgaattatatctgattcaaatttgaatttgaattcaaatattttatatatatagtatttctatacatctaaagtttatacacccaaagtttattcacccaaagtttataagccaaaagtttttatacccgattcaaatttaaatttgaattcaaatattttttatatatagtatatctatacataattttttccaactttatttttttatttttttttaatttatagtgtagtaggaagagaaaaaggggaggagtaaggaaggagaggtgtgtatagggggcgtggggatcgatcgcccattagccacaccctaataaaatgcaaggaaacaatcagcataacggtactgtcgcatttcttaatttttcgtcagtcgtagtatggatgcccattcagattaccagcgcgcattctacatatcaccatatgtcgcatttcttaatttttcgtcagtcgtagtatggatgcccattcagattaccagcgccacaaaagaaccccatacctgcccaacatcacaaaaaccctatagcatgggctaccacacgagtatcaacacccatctcgaggcagaccaatgttaaattggaagtaatggtaaatattgattaccaccagaaacggataacagtgcttctgcaagaagcacgtatagttgctgttaaatgaacgtacataaatcgaattgtacataatcatagctttcaagtcgagcaaaaatcacaacagcagaaaaagaattaattgaacca

SEQ ID NO: 21212 - DNA, 1331 bp, Oryza sativa
agctcggcaaaacattaagaatgtgtttgcaaagtaggagttaaatcccatgagaatatgccaccatgcgtgcccttgtgggttgacgtaccaatgtgaaagcttcttacagaacattcgatcaaatagccagcaaagagtcgccaagctcaacgtaagaacccacagctttgctagacgcttggcagccatgtctttagtttggatgtaggacttggacattcgggggatgcataggaaacagaagccaacgtaatgcaacttgaataccacttggaatcgcaccaggaaatggactactgcaaaagcagcaccgtataggaaaaggaaagtaggcatagtgctccggtaatgccagtctggtgaataaagtacataaagatataggagaatctcccacaccattggagtctcatcgctctgctgtaaactggaaaacaatacatgaccaaaagaattagcactgcatattgtgcatactaaggaaacatgctggaattagaagatgaatactagctgcccccaattagtcaaaagggctacatgttgctggtataaaataggctatagcttttgagcaagctaacaatgtgatgcaattggcagcacatcaataaatggctgacctaatttattgggagatgatttacagcccgcaatcctctaatctgcaaaatggcaactaaaaggaatgtgctttatttgacactaaggcatataaactggatcgccacagataactaaaacagaactgtgggaattacttctgcaaaagatttgcataacaaacagttgcaaaatatcaagtggatttcatggtattcaatatgtcaaagaaccaaaatgtggcagtccgcagtcgtattacagaacaatgctactttaagatacactgacacatagaagcatgaggcattggaagctaactgttatcatgtgcaataactggacaatttgtggcacaatttgtgcagtgagtcgttgagtactaaccgttcaaattttaagcaacagtaactagggtatgcttatgctgtaaatcaaaaggataaatttatatcataggattcttactagcagagtgcaatccacagtcttactctttcttctaaacatgaaacagattccatatttactggctcaaggagcaccacattgacttgttatctaaaggaaaagcaagcctcctaagtaatatttatgaaaaacacaatacattaagttattaatacgtacttcctctgctgatccattcacttttagttaagcatttgacctttcacaatcccagatatgaccctggtggatataaatatttttttcatattata

SEQ ID NO: 21213 - DNA, 797 bp, Oryza sativa
gccgatggtcaaaccaaaagacgccctccccacagcggaacgagcaaacccaacgatcacggcaccggacgatcccctccctaccaacacaacacaccacacacgcaaaaaccgcccgactcgccgacccagaattcagatcgccctcccaccgacgcgggcgccgcaaccgtacggatcggccgccgccgccgccagcgccgcgcggagggtgctagggttttgatcggacgggatcgaggggagaagaggaggaggaggaggaggagggtggcgatggtggtggtggttacctcgaggtgtggctcccgctcgtaggctgcgcggcgcgtgctagggcatggatggagagagaggacggcgaggtttccctgctttccttttgttgcgctctcggctcggctcgctctcgccttctcctcggtcgatggatctgttgggctttcgttcgtttcgctttcccttttttttttctttttttgctttctctacttcgaattgacgtggcccacgaccccgcgtgtcagccactggatcgtggggccccaagttggtggggcccgtgttggagggggtgtgtgtggccgtgtttagttgtttggaaaaaaaatattttaacatatatgaaaatacatttaaagtattaaatagactaataataaaataaattatatattctgtctataaactataaactgtgagatgaatatattaaaagacgaatatattaagtctaattaatccgttattagcatatgtttattgtagcactatattatcaaattatggcgtaatta

SEQ ID NO: 21214 - DNA, 509 bp, Oryza sativa
accacatatatggttaaaaaaatcgtgacaccaataagtacattgcaaacatgtagcactacaacaagccaatcctaagaacaaatgctaaaaatcacaaatttgggtaaaaaaggggttctagggttacccaccgatctacaaattcaaccactaaaaacaaaaaaaaagaggggtgaatgaaagagtctacctttctcttcgatttccacaaaaaatctcgcgaaaaacgagttcaaatggagtggatttgaggtggggaggtgagggggagagctgctgctgctcagctcgggctggtgcttgggcgaaaatgggagtggggaggagataggtggtggggcccacggggtttaaggggtcggcccacagaggaggggcgcgccagccatgctggcgccgtggtaggaggggcagcgccagtgtggctggcgcccccattctgcccagtcagcacctctacgacagccctagtgccacggtggcacgggcacggcgccagtgtggct

SEQ ID NO: 21215 - DNA, 7164 bp, Oryza sativa
tttgcaaatgggaccctattatgccatccttggttatccgggcccctggcttatttgctgcgtggcttgctgagtatgtcatatactcaccttgcaatcattcatcaaaggaagagttctacattgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcctttaatggttctcattcaaaatttattccagtgttattagtactgtacatctattactgtactaatggctcatttactagcaaaagttttacaatactgttttatttaatcttgctgcaataaaataaatttagtatgttgattttataactttcttttgaaaccagttattcaaaattacaaaatttgtgacctcgtttccaaatgttttaatttatttcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtaagatgtcctttgtcattggatttgggactgcccctttttatgcccagattcgtcatgatcgtcatgaagagaggtgccgtgtcaaagtcaccttaaacagcaatagtgaagatattccatcagtgatgttcgaagctggaggaagaaattatatccatgcatgtcaggaagtggcaaggatcgccataggagagctccgtgatcgctacagtgatcagttggccgacactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcaacgggaatggtcctaacctcaacaaccccaataacaacaacaatggagagaatccaacccttgctcaagttcttgctcaacagactcagttaatgcacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgcttttcggaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagaacgccaggagaagtttttgggaggacttaatgatgagctttcttacccacttatggttggagattatcctgatttccagaaattagtggataaggctattcgtcaggaggacaagtacaatcgcatggagcagaagaaacgtcggattgctcaattcaagacacaacagggaaataatcagaagccgcgccttactttaggaccccagtccatgccacagggatgttcttcgtctgttgttcgtccgcaacgtcagttcttcaacaacaatgctggcaacaatatccgtaatcaagctccacgtcctgttgcagttccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgcggctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaggaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatacccagagaatgtgtgtggattatcgtgcactaaacgatgtgacaatcaagaataagtatccgctgcccagaattgatgatttgtttgatcagcttaaaggagccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaactccttggtcacgtcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgagcggagttttcaagagttgaaaagtcgcttaatatcagctccaattttgattttgccggatccaaagaagggttttcaagtgtattgtgatgcatccaaacttgggttaggttgtgttctaatgcaagatgggaaggtggttgcctatgcatctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaagctattgcaatgttacagaaggacgacagttgccattggaattatgcaaggaatttgaaagattaaatttgggaattgtcggtagaggtttcattgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggtaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaataggtatggattttatcactggtttgcccagaacgtcatcgggccatgactctatttgggtgatagtcgacagacttaccaaagtggctcattttattccggtaaagacaacctattccggtagtcgcttggcggaattgtatatggcaaggattgtgtgtttgcatggtgtccctaagaagatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctttagatttcggtggaagttgggataagaatctaccttatgcagaattttcgtacaacaacagttatcaagctagtcttcagatggctccgtacgaagcactgtatggtcggaagtgccgcactccgcttttgtgggatcaaacgggagaacgtcaggttttcgggacagatatcctaagggaagcagaagaaaaggtaaagatcattcaggaaagattgcgagtggctcaatctcgtcataagagttatgccgacaatcgccgcagagatttgagttttgaagaaggagattatgtgtatcttcgtgtcacgcctctacgaggagttcatcgttttcagaccaaaggaaaattggcaccgcgttttgtgggaccttataagattgtcagtagaagaggagaggttgcttatcagttagagttacctcaatctttggcaggagtccataatgtgttccatgtgtcgcaattgaagaagtgtttaagggtacctaccgaagaagctaatcttgaacagatagaagtccaagaggatttgacctatgtggagaaaccgatccgtatcttggaaacaagtgagagaaggaccaggaatcgagttatccgattttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgccctcgcagccgctgacaggtgggtcccacctgtcaggcccgtcgtctttctcgggccgaaaccctagtttcgcgccgccgagctgccgtcgccgccgctttccaatccggccgctcctttccgtttccggctgaattgatagaggggaaatgatctccgggatctcctctaccttttctcctttggaaacttcggctaaatcggtttggaaatcgatggattcgagttcgaatcggatcggctttccttctccaagccgcgagtttccttcgccgttgccgtcgccgtgggcctttcccgccgcccccgacccctttaaaaggatccccgtgctcttcttttctcgccgccaccctcgccttcgcctctcgttcgcggagtagccctagcgccgggtgccctagctttgccttcgc

SEQ ID NO: 21216 - DNA, 6102 bp, Oryza sativa
accattagagtgttttggagggaggagttgccaaaggtgtcacaacttgcaagaggagaagtaacgggagcacctttgttccctatgcgctgggctaaatgcctacagtatgcaaaaagaaaagagaatggggtaccacacatttgtttttcatttatggaattatgtgcggataccattttagcaaagatattcttctaagaaaattcactatttagaatacgacatcaagcaacattaatcgcaaggattgttgcctgttcattttgcctttttttttatttgataacatgggttgtcgatccttgctagatgtacttcgcaatttttattttttttcttatgaacaatgtagtatgaagtatgtcttttataaatttattatttttgcgtgtcatgcattatcttcccatggttcaactccgtcaaggtccctaaatatgtcctccaaatagtttttaaggcctaaggtgaaaaccaaaggtccaacaggacctcgagcccctagaataggaaggctcccaaatcctaccccataatcttggggctctagattccatcccctttcaccctagttcgtgtctctatgtaagatgttgctaggaagattggatctggagctttgttagttccactcatcttttactgctagggataagcgagaaggaccgttgcaaattctgattgcgctgataaaaatgtttcgaagttcagtagaagttatttgcactcctagaaaaacattttcctatttgtgttggtcaagaagatcataagcatatcacagaagaatgatattatctttgctggctttgattagctttgaattataataatatgataatatctctaaatgattgtctgaacaatctgcaggttttggatattcaacctattttgtttgggattaaataaactgttaattcaggatttattggttgagtgccacagcgtctagaatgcctacttcttattcgtccttaattcttattcttatcataatgcttaactacttcaattgctagtggaggtgattcctatgtagtgcatatgatgtctgaggatatgtcttttgcttgcttgaaaattttgaatttgaaaattttactttatatatggttgaaatctatgcattagaaatatttatatttgaattatcgtggtgtaaactatacgttaacatagagtatgtgctaaaatagaagagaaaataaaatatgagctaaataaataggcactattgctggagtaggtggtgtattttgggtcctcaagaaatagaagcaatccccttttaatccttgagaggtcaaatatggggcatgttgctggagatgctataagaaaacagaccaagatcaaaatttaggttgctagttatgctagtacgttgcataatctaatcaatggctcttgggtacacaaagcagttgaaacaacacaatcaagtaccaatgtaatatcaagaagaggctaaatgtagaaatacattatatacttaaacttcttcttcaaaataggttctactctctccatttcatattattagacaatttgactatttcctaagcaaacttttataagtttgattaagtttataaaaaaacatagtaatgctttcgacagcaaacaaatatactgtcaaaatttgttcaatattttatttaatgaagctaatttgtttttgtaagtgttattatatttttctataaatttggtcaaatttataaaaagtttaacttaagtgtcacgaagggaataaaatacaactaatccaacgacaacgagataagccaggtaaggctctatgcaacaatgagccgtggaatcatcttatcgtcctctctatcagggtttaattaatcgcacaagaacaggttactgtttcctgcaattaaagcaatatcctggcctgtcttctgatcccatcggtatttgttttccataagccatgcagttgaatttgctaaagccttgctacatgtatttgcatctctaagcaaccaatgtgctacgtgaatcattccgctttcacatacaattcagtcatttgcttgtttcatacgggaaagtagcatgaagagaatacaacatgattactgaccttctctttagataataatacacaggagatttgctttccaaatgtcctaagtgtatcccctgagcatgaagcttaaaacagcaatctaggtaacttaactactaggagagacccattcaacagcaaagtgaacaacaaacagtgacggagcgtggggctcctcaccgggagaccgcgctggcccccctttgccggttcggccggggaccctgggtgagactctaagctcccaatctgtggaaggttcgcgagacaggaagcatacaagacgccggcgatgtatacaggttcgggccgctgagaagggtaataccctactcctgtgttttggtggattcgtgtatgaaggaactacaaagtatgagccagcctctccctcgttttgggttcccaatctggaaaagtcccgtcccctctcaaagtgggcaaggtcctccttttatatctcaaggggataccacatgccccatctctccctccaatttgacttttctttattaatggacggagatttgcatcgccactgtccgaatgatcttctgacgggacggcccatacctacctccacttccgccggaggcaggcgcgacgtaggaagatggctgtctgctgatgacatgaccattgtcagaccggtcacaaatcggtcattcttgtccaccacgtgtgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggccgtcgtctttctcgggccgaaaccctagtttcgcgccgccgagctgccgtcgccgccgctttccaatccggccgctcctttccgtttccggctgaattgatagaggggaaatgatctccgggatctcctctaccttttctcctttggaaacttcggctaaatcggtttggaaatcgatggattcgagttcgaatcggatcggctttcctctctccaagccgcgagtttccttcgccgttgccgtcgccgtgggccttcgccgccgcccccgagcccctttaaaaggatccccgtgctcttctcttctcgccgccaccctcgccttcgcctctcgtcgccggagtagccctagcgccgtgtgccctagctttgccttcgccgccgccgctccagccgtgcgccgccgtcgttccagccgtcgccgtcgctcgggaaggtcgccgtcgtcgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgctcgagtcgtctgcctcgtcgagccgccgccgccgtcggtgacgtcattgctggcgtcatcaaggccgtccgccgtgaaccgccgtggacccgatcaatctcggccgtccgatttggatcggatcaatctcggccgtccgttcgcgtgaaccgccgcccgtgcgcccggtccacccaaaccctagccgctgacgcaataaatccccttttccttttcaaaaataattcattattgcgtcataattcaattttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaattgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacattgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaacgtgtcagtttaacaatctgcatgttcgcccttcttcacacaacatcttgcctgtaatggttaggatgaatcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccacgacctgaccggtctgtgactggtcacagaccggataaatgagtgcactgcactgcgttacatgcggcgtgacacgctcagccaaaccgcaataaatgtggttaggtg

SEQ ID NO: 21217 - DNA, 11733 bp, Oryza sativa
cccctcggggggactaagaggagggcgaacacatcaccctcgggcccgacgtcccccgagggtgccaggccacgtgggcgattgtgtctgcctcaagcctctagtcatgatacccccggtcccatgtcaccgacagtagcccccggcgttatgccagggcgatcgccctcctcaagggaagcggtcgggcgtgacgccactcctaaggcctggtgacaggtgggaccggtctccacaattgggcagaaacccaacggtcacaaatcacgcacatcggcaatggtaactcggctgtcaataatgagcggtctcttcaagactgccacattacttgagtagcacacgaatctggacatgacgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaagcgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcactcgctcttaatctcctcttcctccggcgccatggcatggggctccgctctgctcgatggtagcgtgctgccgccttcccgcatcgtgagcgagaggcaggctgggctgccgcgtcgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctctagatggcgcacctcacccccaacgcggtgatgatactggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacacccccctcgccgacgaagcgcgcctccgacttccgagccagcccccggcacaggcttccagctggcgggcgccggtagatctgggggatggctatgacgccgtcctcgaccgtctggcgggcctgcgatcccaggggctcacaggggccatggtgtacggcgactacctccgtcgtcggattgcgccgctccagcggcgcgctcggggcgcctgggagtacaccgggtccgaagacctcatgaggacccaccagggagtgagatgggactgggctcctgaggacttcaagatattggtccaacgggtgctgaatctcaactccgtggaggcgtccctcattccccaaggaatcctccccctctgcagcgatccagaccgcgcctccatcctgaccattatgatagcggtcggggcctcagaggagcgagctccaaagggccacgacggcgcaggcgggagccgcaagggggaacaatctaccccgggagggggtcgtgcttctgggtcccgcgacaggggcccggggagcagccgccctgccgatgcccgggggaagaggaagcagggaggatcacctcccccatctcctccccgagggggcggggcggcgcgtgccagcagcaggcgcccggagggggccgcgccgacatcgcagcccaagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctttcaacgcgagttttcactcacccatcttgttcgtcatctggtcttttcttttgtttcagcgagatcccgtcgcgtccctcccgccattccaagctcggccagtctgaggccgaggatccggcggccgcagaggcccggaggcgggaatctgaccggcgagaggccgcggatcgcctacgggaagccgaggaggctgcccaggaggccgcccgggctcgccaggccgaggaaaccgctcgggaggaggccgcccgggcccgccaggccgaggaagccgctcgggaggaggccgcccgagcccgccaggccgaggaagccgctcgggagaaagccggatttcgccaggacgaggcgatggcgacttccgaggcagctcgcgacgaggccgcgggcgcgtcgcttgggcccactccctcgggcgacgctcaggcgacaacttccggggcagctggcaacgaggctgcgggcacgtcgcttgggcccactccctcgggcgacgctcaggaccaaccgggtccggggaacatccccgagtccggcacttccatcggcggcccgagccgcgtggcatcctctccaaggcggctcttccccacgccttctatcgccccactgaacgcagagccccttctgcaggccttggccgtcgcaaacaccacggtgttggatgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccaggaggtgcttgacgctgccgctgcccgagaacagcgggcggcggagaccgaagcggcgtcccggcggcgcgaagaggcccttgaggcgcgcgccatggcgctggaagagcgcctgcgtcgtggagagggatctggcggaccgcgaggccgccgtcaccatccgggaagcaacgctggcggcgcacgaggctgcctgcgccgaagaagagtccgcgctccgcctccgcgaggacgcgctcaccgagcgggagcgagctctcgagggggccgaggccgcggcgcaacagctggcggacagcctgtccctccgcgaggcagcgcaggaggagcaggcgcgccgtaatctggaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcggctgccgaacacaccatcgccgatctgcagggcgcgctagactcgtccgccgaggaggtcgaagcccttcgcttggcaggcgaggtagggcccggcatgctttgggacgccgtctcccgcctagatcgcgccggtcggcaagtgggcctctggagagggcagaccgtaaagtacgccgccaaccagggaggtctcgcccagcgcctctcgaagatggccggggctctccaacggctcccgaggagctcgagaagacaattaagtcatccttgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgacccgggcgcatcggattgagcccccagacccccaccattcttcagttttttcttcttttctttcttctaaggccttcgggcctcttttttgtatagatcaacttaatctgtaatcaaaaatgaagaaatttttgtgtcaatttcatcttgctgtgtgtatgagatgaggatgatctgtgccgtggtccttttgtgtcttagcttgattaagggttcgtgcccaggtcccagtcctcaaaaggcgcgggtcagggctagtgcctggggagatccacatgtcgagactggccaggccgggaacgtggtgaccgagggttatgggtgacccgattgtgggtttttgccgattcccccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgaccccccccctcaggggtagaagcaacgaaggtgttcgatgttccacgggttaggcagctcagtgccgtcgcccgtggccagccgtatggagcccggccggggaacgccgaccactcgatacggaccctcccacattggtgaaagcttgctcaatccagcacgcgtttggacgcggcgtaggacgaggtcatcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggctcgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaagtcttggttttaaggcctttgaggatttccgcattggcgcgctccacttgaccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaacttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggccatcatgttatcccgtctgggcacatgccgaagctcaatcccgtcaaaatggcgctccatacgccgtacttggcgcacgtaggcgtccatctacgggtcagagcaccggtactccttacagacttggttaacgaccagctgggagtcgcctaacaccaggaggcggcggatccccagtccagctgccactctgagtccggcaaggagtccctcgtactctgccatattattggtcgttcgaaagtcgaggcggaccaagtatctgaggacgtctccactcggagaggtcaacgtgacccccgcaccggcgccctgaagagacagggagccgtcgaactgcattacccagtgggcggtgtgaggcagctgcgaggggtccgtgctggcctcagggatcgagacgggctcgggagccggggtccactctgccacaaaatcggcgagggtctggctcttgatagcgtggcgtggttcaaagtgcaaatcgaattcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaaccatcttctgggcctgagggtatcgggttttggcgtcccggagggcctcactaacaaagtagacgggccgctgcacctttcggtggggccgattctcttcgctaggggccgcatccctggggcactcttcgtccaagcagcctcgcggggcgcacttgtcttctgtgctgatgacctcggggtcggaggataacaggggcggccttcccacagtggcttcggggccgtcctgggggtcgggggctcctggcatcgtcggacaagcgggcaaagggccaactccggtcgtcaggggccttagacctccgttcggctcgggggcctcttctccctgctctttcccgggtcgagtcagcacagggttagcctcggggtcaaagggcgataggtacggccttcccacagtggcctcagggccttcctgggggtcgggggctcctagcaccgtctgacaagcgggcagagggccaactccggtcgtcgggggccttgggccaccgttcggctcgggggcctctcctccctgctctctcccgggccaagtctgcacagggtgggggtgcgcggaatgaggattgtcctcatcgcgctccacgaccaacgccgcactaaccacttgcggggtcgccgctaagtagagtagtaagggttcatttggctccggggcgaccagaaccgggggagagctgagatacgccttcaactgagtgagggcacgctcagcttcctccgtccaagtaaacggcccggagcgtttgaggagcttaaataagggtagcgccttctcccccagcctcgatatgaaccgacttagggcggccatgcaaccggtgacgcattgcacatccctaagcttgctgggggggcgcatccgctctatagctcgtatcttctcggggttggcttcgatgcctctggcagagaccaaaaacccgagaagcttgcccgcaggtacaccgaacacgcacttatcggggttcagttttatgcgggcggagcggagactttcaaaagtttccgctagatccgagagtaaggtttcttggttacgcgtctttacaaccaagtcatcgacataagcctcaacattacgtcctatttggctacccaaagaaattcgagtagtacgttgaaaagtaggacctgcattttttaacccgaagggcattgttgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttattaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgcactttctgccggaccggccttgcgcccggccgtacggcgagacggtgctcaatcgcctccctggggaccccgggcatatccgccggtctccatgcgaagacgtcagcgtttgcccgcaggaaagagacgagcgtgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtgaaccgccgccatgaactttaccaacgcgggcctccccaagaccgcgttgtagggcagactgaggtccgccacatcaaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccaacttcgcgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcaggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctttttctttttgtcgctcgcaggcctccccttttgggtggcccgcgaagcgccctcgacggcgactcggcgaggacatgaccctcgtcgtcggaatggactgacctcttcttcctcctcctgtcacgccgccctgtctaagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcgtcccttcgctgtactgcgtgcaagtccgcttcctcacctgggcgcggatacgtgccttggaagttcatggtgaactgttggcacaaatcctcccaggagtggactgacgcgggtggcaagttcattagccaaccccgcgcctgccccttcagggccatgggaaagaaattcgccatgaccctgtcgtctcccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcttccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacagcggctgccgctcgccgcgcccttcgtcttgacgacgcggagccggtggtagcagcaccagaggccttggtggcggaggaccgcccaccagcatctagatgctgccgtgcagtcatgaccaatttggccacatcgtccagccaacgttgggctggagactccgggtcatgggcgacgggcgggtgacataggagcgcgcccgcagcttggagcgcgccctggggcgtgctgccgtcaccatagacgaggagacgacgctccccatctcgccgctcttttccacctcctgtggatgtcgaagtcgcggatccttcggccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaataggaaaagcttggcgcacacgaaagagtgcaagagctcagaagatcactcgcagagccccctacctggcgcgccagatgacggagcgtggggctcctcaccgggagaccgcgctggcccccctttgccggttcggccggggaccctgggtgagactctaagctcccaatctgtggaaggttcgcgagacaggaaccatacaagacgccggcgatgtatacaggttcgggccgctgagaagcgtaataccctactcctgtgttttggtggattcgtgtatgaaggaactacaaagtatgagccagcctctccctcgttctgggttcccaatctggaaaagtcccgtcccctctcaaagtgggcaaggtcctccttttatatctcaaggggataccacatgccccatctctccctccaatttgacttttctttattaatggacggagatttgcatcgccattgtccgaatgatcttctgacgggacggcccatacctacctccacttccgccggaggcaggcgcgacgtgggaagatggctgtctgctgatgacatgaccattgtcagaccggtcacaaatcggtcattcttgtccaccacgtgtcagtttaacaatctgcatgttcgcccttcttcacacaacatcttgcctgtaatggttaggatgaagcctagcatatatctgactaggactaacgtgccatctctgggaggtaacacgctagctccagctggggacgagcgcctagaagccctcgtcctgacgggatggggcgaggcgtgcgtcagatcgcctgtcgccacctaacccacgacctgaccggtctgtgactggtcacagaccggataaatgagtgcactgcactgcgttacatgcggcgtgacacgctcagccaaaccgcaataaatgtggtta

SEQ ID NO: 21218 - DNA, 4414 bp, Oryza sativa
cgaccccctcggggggactaagaggagggcgaacacatcaccctcgggcccgacgtcccccgagggtgccaggccacgtgggcgattgtgtctgcctcaagcctctagtcatgatacccccggtcccatgtcaccgacaaacagaaacctcatttgccagatctgtctgaaataggagtagcttgcagcttagcagccctgcataatgctttggtataaatcatcatttgccttatatagtggataactggatatttgcgctacaagtatgcctggggcttcatatgcaatgcttaatggtcagtggcttggcataccattttattcataaggaaaaaatgctgatagaagaacaaaccactagctaggatgcaggtagtatggcctggtttagttcctaactttttcttcaaactttcaacttttccatcacatcaaaacttacatacacacaaacttccaacttttccgtcacatcgttccaatttcaatcaatcttccaattttggcgtgaactaaacacaccctatgttcatcaactgcattgcacacaatgtgatgcaagtggctatcacagtaagagacccaacccaagcaaaacaaagatattatgcctaattttaaccgatgttccaaattgctaggcaattcaatgaatggataatctagcacaccattgtagaacaatttgagcaaaggagccatttccagttgatgacacgatctgcaagcagtatcatctagcacagatataaaaaaacagcactaaaaacgcataaaggatcggcactggaaattttcattaaccatagtctagatcagaagatcggcacaacgttttttcatccgattcttcaattccttcagtactaaacataaaacccataacacctcaaatctgataaacccttgcctaacatcacgagagagcaagagaaaaatgcagcaacaactgaatctaggtagcctaacacattacgagagagcaggagcgaaatgcagcagcaactggaatctaatctaggtagaattaggcagagaggatgcgagcgattgcggtacgtgccacggcgaccgcctcgatcgacgatctatcagtatcaggcgcggagcagcctcctgccgacctcgaaggagacgtaggcgtcgatgcaggcgtaccggatttgctcgttggagaggcaggaggcgtcccagcggctcatggtcaccctctgcggcttgacgaggtcggcgcccatgacggcgcgcaccacggcctgcaggccggcctggctgagctccgggcggcccagcctctgcgccgcgagggggcgaaggtcggcggtgttcgccacggtgaggccgtggtcgtcgctcagccgctcggcgtccttgtccacgccgacaccgacgaagcagtccgcggcgccggcgaggaagcggcggagggagcctgggacgtagtcggcgtagaggagctggaagatgaggcacctgcggtcgacgcagagctgcagcagcgcgacggggttctgcgcagggccgtagctggggcgccactcgacgtcgagccccacgatgagcccgggccgtacgcggcgcggacctcccggagccacccctccacggcggcgccggaggacgtcacggtggtggtgatcacggcgtcgccgaaggccacctcggtgacgtacgtgtcggtgtcggccgccgccatgtggatcgcctcgcctgcggcggctgcggtgcggagacgacaagggtcaagagggttttggtttgggggagaagaagaggggaagcagcgagtcgaacggtgattgaggaggatgaggcgcaacgggcaggtggcccccgtacataaaggcttggacagctggacgcctggacatgaagctcgcaaattccttcgcaattcaaaccggagggcgcccatccaaatattttccaatgtatagagaaatttacgaaacaaaaagaacctaaaccaaatactagtactgtactactactccaatgtgagaaaaaaaaatttagctgtaggaggagtagtaattcaaatttcaaaaataatgaaagatatcagagaaccgtactactttttggtagacttcggtagggggtagttttgctttttgggttggcactgtagcttgcgggagatcagagaacagagcgagcgaatcacgttgtcagacgagagtttgacccatcttatctaacgtacagtacgctcttggcttgctgggccctgggctcaacaaaatgatgtgttcacgtcctgtttgaccattggcacgtgccgtgtcacgcctgattgcaaagccacaatgttggggcgccttttggcaggtagtactagtattactctaattgctttcaaaattcttaattttaattagcacctgtttatatttatccacttgcaccatccgtactatacaaagttaaaaaccacttcaaatttagatgagtgcattcatccttagaaattgtccttttggacttagagaggacgcagttacacttacaccctactcaataagatgtacttcctccttcccaatatatttgacgttttacttcttgtggtccattgacccacaatgcttgacgttttagtaaggagcataaacatgagacaggcgcagcagagtacgattcaaattttactaaccgggtaatcaggaacatcagctcgtccatgattccaccgtggcaggaacggccggtgtatttttatctaaaatgactactcatcatggctatttaaagtaactagtactccagttagggcagccataatgtagcaatagaagggggtcttaagcctctaaagtggccctttatacattgtgatagtagtccatatattagtctttaagatgagctagccatatgcataatgtctacccataaaaataaagtaataatactttatcttctctctcctcttctctctcacatgccatatattcgagtgggacagtggaatccaggctaatgcattctcttaccatatactaatattgggtcctaccttattacccaagtagacattatacattgaggttgtgtttagttcatactgaagtttgaaagtttggttgaaattggtacgatatgatagaaaagttgtgtgtgtatgaaatatttgatgtgatggaaagttggaagtttgaaaaaaaaactttggaactaaacagggcctgagcatacccttagggctatatggtaattttcacctaggcttgatttggctcaactatgctagaacgtcgagtatactgggacagatggagtagattctatctcggcttccattagcatgtttttcaaactgctaaatggtacgtttgtgaaaaaaaaattctatttgaaagttgctctaaaataagtttataataattaaaacttaattagctatatgctaatgtctttcttgttttatgtgctttacataatcttaatcttcatctatcatggcccctctcacacttctcccttcaataataactggatttgataagcatatttgaattaatacagagtttattagttatgtttccatattataaccatacgagtcaatgttaattttcacaaaacatgtatcggtgtctctaaatatgagttctgtgcacttttagttggtgcaaaggccaaaagttatatactatatttattaaaaaaataatacgctaattgtttgaaattcgtctcaagatgtatcgggtgatgtatacttgtatggtggtagcaaatttgattcgcaaacctaacaatggacaaggatgagcatagacaaatccgtagttacatctgatgttactctaccggagtaaattaaaatttggtttaatttaaaatttcaaattacactacttccgtttttcattttcattattttcgagtttcgaccagttttaataaagtttataaattcttatcccgacgcgctgatcagggtggtgattgctattttgttcttgatgggttttggatggaacttctaaattctagatgtcgcacaaaactgttggtattttggtcattttacttaaaaaaagttgattatataggtttatatgcatggttaaaagtggtaaataaattaaaaacggagggaccgagggagtaatttgtttggttgaacctggtggtgagtccaaaaggcaatccttcgaaagtcaaaggtcaaaagttacgcagtggagaactcaagcagaagctattgggccgggctgcagcaacagctggcccggcccgactaggtggatattttcagactaccgtccaggtggcaagaccgcaagagctcctcctcctccggatccgtacaggagaagggaaatgcaagtgcaagccgcctctcccgctaccgcggcgtcctcaccggtggcgccatcgccaccgccaccgccgagcgccg

SEQ ID NO: 21219 - DNA, 15693 bp, Oryza sativa
  unsure (1)..(15693): unsure at all n locations
tccgcctatctctgtttcttcaatcgcactctcttagcccacggcttcacacgagtacactagtatagtagtagtatagtatggccggtgaattgtgaattcgtgatcatgtattaatgtgttggttgcttgatttgtagccacattgtacccgagtacagcttcttagatgcgcgtggcctgggcgcgtttgaagggaagagcctagaaacattgcctgaggtattcttcacccgaatgatgcatctttgccactttctcgtggaacgcgaagttgcaataaccggaactagtaaaagaaccgttggtcattttaacaatataatcgcacagcagagtgatacaagactgttgtgtgaagatgttggttttaggtgacattgggtgctagattgagaattgatgcaattagtgaaatactggttgccaactgccatgaagggcttaaaaatctttggctcctgatagcactgctactagtattagattaatagaatatgttaatttgactagtgtttaagtgttttcgcagacaggagtattctcgacctgctagttaaatatctcaacaaacaatgaacaatgtaatatataggatataagttccgttcattcttagaactaatttgaggaatggatatcctcgtgtactcactttatcatgattcatgaatcaaacatacaagtttattctgtttggttttaggttactgggaaataggcagtgagattggtacctttgataagtatagatatatactttcttggttagaaatcagggaatgaactaatatacacttccacgccagtactgatattgcagattttgcactatattgactgagctatgtttctttttctgaagcttcttcggtttatggatcagccatttttttgcttggtaaattccatcctgttctcattgaatttccctttcttgctatggatttaggtgtatgcatcagacagtatttcgccagacatcaagccacctcctattagtgatggtacaccaaatgagagtgttgcagatgtatttgttcgggtaacgcagctcatgtcaatactagagactcagtactcgggggataccgttgtcattgtttcaccagattctgacaacctgtcaattctacaagctgggttgatagggctagacctccggaggtaaaaaccagcaattcattttattccactccattttgcaagtttttatctgcaggacttctggtaaacacagtgcaacaatgttagggagtttgttagtggaaacttttctcactgctgctcatgtatactctgcactattagtgattggggggaaacatatccttatatctctatcatttatcatttctgcaggcatagcagcctattctttcagcccggtgaggttcgacctgttgatccagccagcatacctgaatacaaacaacctgcctctactgttttcaagtgtacaaatccaccaagttgcaaataatttactacttgtcatacaaccatacaggtttcatatctgctgtacatgaagaatatgaatatatccctatatcagtgcatagttgaaaggaagtatacgttgcatgcccatgcttcttcaagacttcaacacctttgactaacccatccttaacatgagccagagtgtcatagacatctctagcttttataatggaatatttcactgttgcagttcacatgttgcataaacccttctaaaatttgtacagttcatcttacagaccaatgggaaaaggtgtacattgtggtaatcctgcacacttggtgactctggtgagttagaatccctcttagaagaaaaagaaaaagagtatattccgctaaggtacaacaaccagccaaccaggtgagcacactttagtgtcaagagcttgcactctgaacaatctgatagtagtactataaaaacttgactagagtgcgtgattaaaaaatagagctataaaatacgcaatccaatgtaacatgaatattagttcttatttagtaaacctggacaatgcttcatgcaaggctaatgtaatgattgggattttgagacgacaaaccttacatgcgctttccaaacacccgtcaagtttctaccgaaatactctggctgcaaatactaacttgcacttttctcatctctagttcacgattcaatttactgatcctttattactagtaaatcacgctcaaggatacgtccaatacaatttacatcaaggagttgttcagagcaggtacaagctataagccagctgtaaacatattttaagaagataaataaggagagagaagagcagcgggctacagatttatagctagctatagcacggatttcaagacgcagtgtgtgtatgacaggtgggaccatatattataatagtatagtatgtaactattgtatgaatgagctatagataaattggagctagtagttgcgataatgctcgttaccgagcgcccgacgcgggggagccggatcggacgctcccccgcgcgtccctcccccacgtccatactgttggacccacccactccccttttttctacaaaaatgtttcacctagtatacttacaatatttcactatttatagattcaatgttgcagtgaattaaaatatttttttcaacaaaaaacccacatattttggaaactcattattaagggaatttggttcatttttttccaaaaaaaaatgtttcacctagtgtactcacaatgtttcactatgtataggtctaatgttgtagtgaacgaacatttcattgcaacaaaaaaacccatatattttggaacccccctattaagggaatttggtttatttttttttccgcagaaaaatgtttcacctagtgtactcacgatgtttcactatgtatagatctaatgttgcagtgaactgaaacattatttcgctatttgctaaaacattattttttatataagatgaaacaacacctgatttaaatgagtgaaacattttcgctctacttagtgaaacaattccgatatacctggtggaacatcgtgtaatatttaaaaataattcaataataagctatttttttcgtcggtatatatccatgtgtgatcttgttttgaagatttaattacaacgaatttaatggtgtaatcggatcatgatttgaattagtaatttaagaaaaaaaatcagtttagattagttttacacgtaaatcggacgtatgacgtgggatttccctagccccggatcggtccggatccgtaagcgcgtcacatgaattggctatactattagggcccctttgaatcgcaggaatggaaaaacggaggaataggaaaaacgtaggattctgacaggaatgcaggtgtaaaacaaaggattggaaaatacaggaaaaacacaggaatgaccgtttgattagaccacagaaaaaacgcaggaatcggatgagagagatagactcaaaggaatttttccaagaggttggacctcttgctaactttcctccaaaatctctataggattagccattccataggaattttaaaggatagtatatgattcaatcctttgtttcaaaggctttcatagaaattttttccataggattgaaatacttcaaatttcctacactttttctacagatcaaagggggccttaaatctgctctcgtactcgtacgtccatttcccttgagaaacctagtccacctgaccacctccccacttccctttccccgattcttctcactactgccgaccagtgtgggctactacactgaactgaacaccaaccgaagcagcgacctcaacaaccatcgagcaaactagcaatggcctccccaatccactcgccgccgccggagccggccaccgatggcgatgatgcccaatcccaccctccccctcccaccccgcacccggcaaccgatccccctcccatctcaccccaaaatccaacccctcctcctcctccccttcctgcctccgccgccgcccctactactccgtcaccaaatcactccggcgatccctctcgccccattccttcgcaggcnccggcaccgccccctcctcccaccgccgatccgtctcctcccctcccccacgacaaccgaactccacagccgcgggcggcgccccctcccgctcccgctcccgatcaaccagcaccgccttctccaccaccatcactgcggccttctcccccagcaccggggtccccggaatccatgctggagcgggaggcgtcggaagcggatggagaaccggagaacatgacgcttgcccttgcgctggcggagacggagacggagaaggcgatgccgccgacgccgccgaaggccgcggaagcggcggagtccccaaccggatcgccgcagaaggagtctgccctgaccattgccaagctcctctccggcgaggaccacgcggggacggagacgaagccggtgcccgagaaggccgcaccagcagcaaccaccaccaccgccgccgtcgcatcagtcggcggcggcggcggtggtggaggaggaggcgtggggtctaagagatggcttcttggcggcgtcccagagaaggtgcggcggtcggagctcaggagggccgagctagggttcagggttttggccgccgtcttctgcttggtctcgctctccgtcatggccgccgataccacgccgggctggtccggtgactccttccgccgctacaacgagtacaggttgcgctctcaacgccgtaccatgatgcttgccaaatccccctctggcggccagcttctgttattgatggaagttgtgtgcttctgcaatgcaggtatacactttctgcgagtgtgttggcttttacttactcggggttccagttggtcgtggaagtgcactactttgtcacggggagacgtataattcgagacccatcagggaagtacttcaatctcgcaatggatcaggcaagaacttcagctctgaatgtattttctgtcctttcggtttcatattatgtgtgagctttaatctgttgctgattggtctatggttacaaattgttgtaagcttggattccgagacagtggtcaactttttgcaggattagattatcttaattcttaagttgtatgaattggggtaaagtaagctgtaagctgcatgcaggggatggactttggttgttcatgaactttatgttatagttgatcatttttctctacgacatattcaatcttgaatcgaggactcaattttacagttcattatcacagtgctgtttgcaatgtaagaaaattttcatgtacctgtcaagtcaatcatataatttgcctaaaaaaatgtggaattcagatgcttctggtgcaggcgcgtaaaatttgtagattatgttgtgcactttatccttagttcagatgttgctggttctatcgtgccaggcgcgtagagtttgtagatcagatgttgctggttctatcgtgccaggcgcatagagtttgtagatcaagttgtacacttcattcttctgtccttcctttgatataagctatatctcatcagctggagttatgctgcacttgttctctaacttcctgtttggcattgtcctaacatttatctctgaggttctgcacatattggcatcttggctgagaactgtatgcatgggataggatttcgttgcatgactatttatatatgttcattgcagatattggcttacctcctgttgtcagcatcttcagcagcactttctcgcaatgatgtttgggtgtctcggtttggagtggatcaatttgccaaacttatcaatgcttcagcctccatggcattcttagctttcgttgctcttggttttagctccataatctcagcgtatcatgtcttcagctcggttttttaaacccattgtacattacttgttgtaagtactatgtgctagtctgctagatgtatcttggtcaagccaaccttgattgttgcttcttgtttgtagaattgtggcaacgatattggactccgaaatgggaatacacggtgatctttttaagagcgtgtaatggcagttgggccttggggaccaatcggttctgtaataaaaattctgtagagcaaatcattcaaggatgcgacttttactggtattgattgactgtttttatggtcatgtactctacggatgcattatctgttctattagatggtcaggagtctatcagctaaatagattttgtcaggtataggcagcaaattccattctattgaggctcagctatgaacttctgaatagactgatgaacataacaaagagtcatcctcttgttagtcagccatgactcgcgatacaaaatcgcaaggacgcaagttagcactaacactacaaagccatttgcaaacttgataatctttgccaaagtgaagatagttcaactagttagatttcttgtagtagaattaatctacttgggtataagttctaaacttgttacgggtgtccgtatttactactaattattctctcctagattccttgtagtagaattaatctacttgggtgtaagttctaaacttgttacaggtgtccatatttactgctaattattctctcctagattccttgtagaagaattaatctacttggtataagttctaaacttgttacgggtgtccgtatttactactaactagcatggtaggcatcattatattttctctcatataatagcatatatgttttctcattatattattcaaatatattaaaatgacaacataattttaaattttgcaataaccttacaaactactaatgtgtaatattcatattatattttatatgtgtgttagttattaattatttttaatatcaaattttagttatttgtaaattatatatatttctatatggactctagactcgtcttttaatattttttttcttaattccgaattttctgtaaattgtatttctatatagactctatactcttcttccaatattatttatttttatttctgaattttcatattatattttatatatgtgttagttattaattatttttaatattaaattttagttatttgtaaattatatatgttcctatattgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgagaagcgtaataccctactcctgtgttttggtggatctgtgtatgaaggagctacaaagtgtgagccgacctctccctcgttctaggctctgaatctggaaagaatcaacctctttctctatgggcaaggtcctccttttatacttcaaggggataccacatgcacccctccctttccaaactggactttttctcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagtgcactgcactgcacttcgtgcggcgtgacacgcttagccgaggcgcaataaatgcggttaggtgagccctgctgtgctcacctaacccatacacgtggagtagaaaacgcgaggggtcggggcgcctcgcccctcgggggcaaggctggagtggtccgacccccccctcgggaagaccaagaggtgggcgcacacatcaccctcgggcccgacgtcccccgagggtgccaggccacgtgggcgattgtgtctgcctcaagcctcgagtcatgatactcccggtcccatgtcaccgacagtagcccccggcgttatgccagggcgatcgcccttcttatgggaagcggccgggcgtgacgccactcctaaagtgtcacgtcctgataaattcatcccaaaatttaaaatttattttctaaaaggaataatagaattaattaaaattcggaaagaaattggcaaacactaaaaatacgtacaagaaaaattccaatgtggcccggagaatttttgttaaattctccttggtctaaaaagagccctcaaattttacttgaattttcagagcaccagaaataattattaaacaacaaaaacaattatcaaagttcaataaaaagaaaacctaaaaatccctcctcttcctcctttgggccaagcccagtccgaagtcctcctctcctccctcttttctctccctcctcctcttgggcccccttcccctcggcccacctccctcttccctctccctcccgggctgcctctctcttcccctcccctcccggcctgcccggcccaggccgcctctccctcctctcttcctgggccggccgccggcccaagccgccccagcccccgagccgctcccctcccgcacgtgccgcgcgcgtgcgcgcggtgacgacgcgcgcccgaccgcgtggggcccacgcgtcaggccgggcgtcgtccccttcctcccgcccggccgtcctctctccctctcccgtgaaccctagctcgcttcctcctctaaatccgctcgattcaagcatgggattcccaaattaaataggggaaattaatccccattgactcctcttcatttccccctaatttcccccttaaatgccgcccccaatcgccgggaacggccgcgccaagtccggccgccttccattgccgccggccggcttttccgccgccgttccgacctcccccgtggccggctccctcttctctcatataaaatgggatccccgcactccgttctaccgttttaaccccatcccgagcctccccgtggtctctagccccgttcccgccgtcgccctcctctttccttcgcgccggccacctccagccgccttcctctcctcgccggagcatcgtccggccgtgccgtcgcctccctcggctctgcaacaccgtccccttcaccggcctcaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcgcccgcgccggcctctccttcctcctcggcggcatctcctccggctgcccctttcgccatgcccgtgcatcagccggcgctgccgtcccctccctcggcatggtgacgtagccctccacctcgtccactcctcggtttcgccggaacgccatcgccgcgaacctctccatccgcctcgccggagttgttcggccgcccgtccctcctcgcccgtgcaccggtcggccacacccccatcatcttcggcatcgcagccgcgacgtcgtcctcggcctcgcctcccctccgaccgaacaccgccggtgtccgtcgtcgtcttcaccgttccctctcgccggctcgtcgtctcgcggcgccgcctccgtcatcgtcatcatagcggcgtgttccacgtcatcctcgtccccgtgcagccgctgccggctgtcctcgtcgcctcctcgccggccccggtcgtcgtcgccctcgtcctctcgtcgttcccgatcgtcgtggcgttcgtccctccgtcaagccgttctcgtccgtcgtccgcgttcgtcaagcgagtcgctgcagccccgtcctcgtgttcgtcctcggctccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggtttcctcccctcgctgccccgtcctcgccctttcggtgtcgcccgtgctcgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaggccgtgtggtgtctagtggagtccgtttgttggccactcgcctcggttgacacacggggtccgcttccgtcgacccgtggaccgtctctgtgtatccggtctaccgcggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcctggtcatacgagctccgaatcgacccgttcaagtctcttaatgtttgttataacctaaagaaccctgtgctttctttttatgtgttgttattgcttctttataggcttgtagctttgcttgtgtgcttcgcgtagctttcgtcgttccggaggttcccgaagcgtggtttgcggtcgttgccgaaggttcggaaggccgttctccctgagcaaggcaagtcacatcatccttgaacatattgaatcccagtttgtaaaattatgttgatttaaattattgcattatcgctttatttaaattcccgcgttgtcactgttttatttagccatgcctatttacctttgttatgaccatattattattgttattgttattattattaccttgttcaccctagaataaataaaaccccaactagtgggtactctactcgtggtatccctagtttaaatttaggtagatgcttcgctgattaattaggcaacattaggtggttttataactttagacttgggaaattctcatatcatttggacactatggaatggtcggcttatgttggaattggacacacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaagtacacggattggagatggatgaagtcgggtgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaattttgctcaacaactaaaatatggaatggttggcctgggttggcttgggacgagctggaacccaggtcgggttgccagttcggtccaaatcatcgtaggccttgggttaaggcaggttcgtgagggttcacgaccttgtttaataatactgtgtagctctaggatcgtctttacaaaatggctttgggcaactaagtgacttttaaatgctgtttactgcaaaacctaacccctattattatccccttgtacccccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcccttgtaataatgtaaatattatcgatgtaataaagatgtgtcttttatatcatgtttgtatggtgtaccccggcttttcctgggacggggattaatacactagcgttcgggagaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcaggtcagtagaggacatcgtcagttgtttgccgaagctccagaagactgcaggatctgctagtgaagtggaggaagcagtgaagccagctgggaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcaaaacaaacaacacatcaacaaaaagagttagttcctttaaggtcttgtccctagttctggtctcttctttccttgtatgcttcctctctcaacccctaccttgtgacagatggataacattggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggtggcgcacagtcgagaggaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccacaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagtttgcagtgcaactacttctagaggattatgaagattttgagaaacttgtggacaaagccatgcaactcgaaagtgagcataatcggatgacgaactgcaagagaaggattgtcaacatcccagtatttccaggtggtaaccaaagacagcgcactgagccacttcagatcaccggatctcctgttgtgcatcaagagttcctgccccaagaagatgaatgcaatgcagacaacaacactagcaatactaataatgatgataccaccaacaaccatggttcttgccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcacaataatcatccccagatggacagctcagcaaagaagacgttgatttgttacaactgcaaagaaccaggtcatttctctagagattgtccacagccgaagcgtaacctgcgccatcactccggccattatgcaagaagaagacaggtcactcgccttgtggtcactggagcaaacgccgtacctgtgaggcctcatgttaattctaacccatagtggaaacaatgtaccgatgttaagcaccttccctttttgtttaagacagtgccttgtattcatgtaatatgggagagatttgtaataaaaacaagttctaagaggattcttttggaagatgcggatatgtgatcatgtgtataattgtttactgacaaaggggacctagggtctcgtgccagaggaactatattctaacctcgagctaataaccaacctgaggatggaaaagaaaatcaagtgattaaccaaagagacatttgtttggactaagagtttcagatgtgtcttttccggatcaaaggcaatgacagtcagtatagcttttggcgaaacacttcaaggtttcactgaaaggtagcagaccaaaggacctcatcgccaccagaagcatccacaactctcggagtgaagaatacttagcgaccaaggtcaaaagatgactgatagaagatatcgaaaaagatgtttattaccaggcaaagaagtaggtcgaaaggtgattgataagagaaatcgggaaagaacacatcaaggtcaaaggtgtaaaggaatacgttgaatgctaaccgaggacaacatgaagtgaatagtggtaagttagaagtaaatgacaagcatgatattctcatgataacgagcagggcatcctagtaatgacaagctgacatcgacgcataacgtgaagtgggtaacttgtatgaggttgacgccaaagatatgaattatgagaagttctggaactgaagtcccatcttcaagtgccataatccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcttgtaaggggggtggatttgtcacgtcctgataaattcatcccaaaatttaaaatttattttctaaaaggaataatagaattaattaaaattcggaaagaaattggcaaacactaaaaatacgtacaagaaaaattccaatgtggcccggagaatttttgttaaattctccttggtctaaaaagagccctcaaattttacttgaattttcagagcaccggaaataattattaaacaacaaaaacaattatcaaagttcaataaaaagaaaacctaaaaatccctcctcttcctcctttgggccaagcccagtccgaagtcctcctctcctccctcttttctctccctcctcctcttgggcccccttcccctcgg

SEQ ID NO: 21220 - DNA, 8629 bp, Oryza sativa
  unsure (1)..(8629): unsure at all n locations
gggttaaggcaggttcgtgagggttcacgaccttgtttaataatactgtgtagctctaggatcgtctttacaaaatggctttgggcaactaagtgacttttaaatgctgtttactgcaaaacctaacccctattattatccccttgtacccccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcccttgtaataatgtaaatattatcgatgtaataaagatgtgtcttttatatcatgtttgtatggtgtaccccggcttttcctgggacggggattaatacactagcgttcgggagaaggcaattttcccggtcgcgacataaagcctggtgacaggtgggaccggtctccatggttgggcaaaaaacccaacggtctcaaaccatgcacaccggtaatggtaatttggctgtcaataatgggcggtctcttcaagactgccacatcacctgagcggcgcacgaatctgggcgagccgatttgcctcgcctggtgatacggtaatgttgcttcggtcggcgagcgtaattaacgcgcgcacgatacgatctatctcgactgccgcaaccgcatatccatctcacgcaccgcaagcgggcgaatgggattagtggaagcgtgggcgcgagaaacgagggggcgaaataatgggcgcgagaaacgaggagccgggcacagcgttggcaagggtataaaggcactgaggatgggatttgtctccttcctttcgccatcatttcctttgccttcgccgcttgcgtcctaactccttcttccctgcgcccttctttcgccacacgcgctcgctcttcatcttctcttcgtccggtgccatggcacggggctccgcactgcttgatggtagcgtgctgccgccttctcgcattgtgagcgagaagcaggctgggttgccgcgccgcttcatgccggaatctgccaccggccgtgagatagtaatgctgggtgagggacgcccggcgctagactacccggggcggtccgtcttctttctccccttcgcaatggcagggctggttccgccattttcttctttcttcatggacgtcctggagttctacgatctccagatggcgcaccttatccccaacgcagtgatgacattgggcatcttcgcacacctgtgcgagatgttcattggggtgcgcccatctcttcggctgttccggtggttcttcaccgtgcagtcggtgtcgccgccgtcggtggttggtggctgctatttcctgccgcgggggccggtgttgaactgctacatcccctgcgtcctccgtaaaaagtgggatgactggaagagcgactggttctacacccccctcgccgacgaagcgcatctccgacttccgagccagcccccggcgcaggcccccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacaccgggtccgaagactacatgcggacccaccagggagtcagatgggattgggcccccgaggacttcaagatactggtccaacgggtgctaaatctcaactccgtggaggcgtccctcatcccccacggtatcctccccctctgcagcgacccagatcgcgcctccatcttgaccattatgacggcggtcggggcctcagaggagcaggctcctaagggccatgacggcgcaggtgggagccgccggggggatcaatctacccccggagggggtcgtgcttctgggccccgcgtcgggggctcggggggcaaccgccctaccgacgcccgggggaagaggaaactgggaggaacacctccctcatctcctccccgagggggcggggcggtgcgtgccggcagcaggcgcccggagggggccgtgccaacatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggttttcctttctgcttcagtgatatcccatcgcgttcctcccaccatctcaagtccggccagtccgaggccgaagatccggcggccgcagaggcacggaggcgggaatctgaccggcgagaggccgcagaccgcctacgggaagctgaagaggccgcccgggaagccgcccgggctcgccaggctgatgataccgcttgggaggaggccgcccgggcccgccaagccgaggaagccgctcgggaggaggccgcccgggttcgccaggccgaagaagccgctcgggaggaggccgcccgggttcgccgggctgaggcgatggcggcttccgaggcagttcacgacgaggccgcggacgcctcgcttgggcccaccccttcgggcgacgcccaggaccaaacgggtccgggggtggcccgcgatgaggccggcgcgtccattggcgggccgagccgcgcggcgtcttcttcaaggcagctcttccccacgccttccgccgccccgctgagcgcagagccccttctgcaggccttagccgccgcaaataccgcggtattggatgggttcaacgcccaggtggaggccctgcaggcggagcgtgcggagctcgacgccgcatgggcgcgtgtcgaggaggggcggcgctcggtggaggccatggtagaagcgggccgcaaggcacaccgccggcacgtctcagatcttgaggcccgcaagacggcactggcggagatcgctcgagaggtggaggaggagcggggggctgccctcatcgccaccactgcgatgatcgaggcgcaggactccctccgccttcagcacgggaactgggaggcggagctgaagaaaaagctcgacgccgcccagggggttcttgatgccgccgctgcccgagagcagcgagcgacggagaccgaagcggcgctccggcggcgtgaagaggccctcgaggcgcgcgccatggcgctggaggagcgcgcctgcgtcgcggagaaagtcctggcggaccgcgaggccgccgtcacctcccgggaggcaacgctggcggcgcacgagtctgcctgcgccgaagaggagtccgcactccgcctccgcgaagacgcgcttgccgagcgggagcgagctctcgaagaggccgaggccgaagcgcaacggttggcggactccctgtccctccgtgaggcagcgctgacggagcaggcccgtcgcaatttggaatccgtccgcgccgagagagccgcactggagcagcgggctgccgatctcgaggcgcgggaaaaagagctggatgcgagggcgtgcatcggcggggcggctgcgggcgaaagcgacttagccgcccgcctcgcagatgccgaacacaccgtcgcggacatgcagcgcgcgctagactcatccgccggggaagccgaggccctccgcttggcgggcgagatagggcccggcatgctctgggatgcagtctcccgtctggatcgcgccggtcggcaggcgggcctctggaaaggccagtcaatgacacgccccgccaacctggagggcctcgctccgcacctcacgaagatggcctgggctctccaacaactccccgaggagctcgagaagaccatcaagtcatcctcgagggacctcgcccaaggagcggttgaactcgtactagcgagttaccaggccagggaccccaacttctctccatggatggcgctggaagagttcccttccgggaccgaggacgacgcgcgcgcgcgggtccgggatgccgccgaccacatcgtccacagtttcgaggggtcggcccctcggctcgcgttcgcccccaactccgacgaggagggcgatgccagcggtgcagacgatcgtgacgacgaggccggcgacccgggcgcatcggactgagcccccaggccccctccagactccagttttttctttttctttcttctaaggccttcatgcctcttttttgtataaatcaacttacaatctgcaatcaaaaatgatgaaaaaattctttgtgttaattttattttgctatgcgaatgagatgaggatgatctgtgccgtgatcctctttttgtgtcttagcttgatttaagggcccgtgcccaagtcccagtcctcgaaaagcgcgggtcgggactactgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgaccttatttcaagtcaaaattcttcaaaaaggaaaaaaaacggcacagatacagcccttaggaaattgaaactgcttttattgaaatactgaaatgagagaaatgagaatgtgcatgtgtggcagcccccggccaaccctgcacacccgaggggggggtgcggggttgacccgagcccgaaacctgacacccgacccccccctcaggggtagaagcgacgaaggtgctcgatgttccaagggttaggcaactcagtgccgtcgcccgtggccagccgtatggagcccggccgggggacaccgatcactcgatacggaccctcccacattggtgagagtttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagtttcgcagtacatggtggcccgaggagacctcagggtgagctcagatgggagaaccgcttctgcgccgtagacgaggaagaaaggcgtttccccggttgctcggcttggtgtggttcggtttgcccagagcaccgctggcaactcctcgatccacgaatcgccatgcttcttgaggatattgaaggtcttagttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagtgcagagtgcttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgtttggcgtgaaactgacacgctctgcatcgccggaccagatcaactgcatcattgagagctgtcggccaatagaacccttgacgaaaggccttgccaaccaaggtgcgcgaggcggaatgggctccgcactcgccttcatggatatcggcaagaagctcaacgccttgttcctgaggaatgcacttcaggaggattccgttagccgcgcgccgatagagggtcccttctaccagcacgtagcgtttggaaatgcgttggacgcgttcactcccttcacggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtttgggctcgcgaggacgcgagccgtgagagttcgtcggcaatcatgttatcccgtctgggcacatgccgaagctctatcccgtcaaaatggcgctccatacgccgcacttggcgtacgtaagcgtccatttgcgggtcagagcaccggtactccttacagacttggttaacgactagctgggaatcgcctaacaccaagagacggcggatccccagtccagctgccactctgagtccggcaaggagtccctcgtactctgccatattattggtcgctcgaaagtcgaggcggaccaagtatttgaggacgtctccgttcggagaggtcaacgtgatccccgcgccggcgccctgaagagacaatgagccgtcgaactgcatcacccagtgggcggcgtgaggcaacagcgaggggtctgagctggcttcagagactgaaatggtctctggagccggggtccactctgccacaaaatcggcgagggcctggctcttgattgcgtgacgtggttcaaagtgtaaatcaaactcagaaagctcgattgcccattttaccacccgtcctgtaccctcccgattatgcaagatttgaccgagggggtaagacgtaaccacggtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacccttcggtggggccgatccccttcgctaggggccatatccccggggcgctcctcgtccaagtggcccctcggggcgcactcgtcttctgtgccgatgacctcggggtcggaggacgacaggggcggccttcccacagtggcctcggggccgttctgggggtcgggggctcctggcgtcgtcggacaaacgggcaaagggccaactctggtcgtcaggggccttaggccaccgttcggctcgggggcctcttctccctgctccctcccgggtcgaatcggtacagggttagcctcggggtcagagggcgataggtgcagccttcccgcagtggcctcggggccttcctgagggtcgggggcgcccagcaccatctgacgagcggggagagggccgactccggtcgtcaggggccttaggcctccgttcggctcgggggcctctcctccctgctcgctcccgggccaagtcagcacagggcgggggtgcgcggaatgaggattgccctcatcgcgctccacaactaacgctgcactaactacttggggggtcgccgctaagtagagtagtaggggctcgtttggctccggggcgactagaaccggaggagagctgagatatgctttcaattgagtgagggcgcgttcagcttcctccgtccaagtaaacggcccggagcgcttgaggagcttaaataagggtagcgccttctctcccagcttcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcaattttatgcgggcggagcggaggctctcaaaagtttccgctaaatctgaaagcaacgtttcctggttgcgcgtttttacaaccaagtcatcgacataagcctcaacattacgtcctaattggctacccaaagaaattcgagtagtacgttgaaaagtaggacctgcattctttaacccaaagggcattgtcgtataacaataagttcctatgggagtaatgaacgcagttttttcctcatcctccctagccatgcgaatctgatggtaaccagagtatgcatctagaaaacacaaaaggtcgcaccccgctgtggagtcgacaatctgatctatgcgaggcaaggggtaaggatccttaggacatgccttgttaaggtcggtgtagtcgatgcacatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21221 - DNA, 12446 bp, Oryza sativa
  unsure (1)..(12446): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgcaggtacaccaaacacacacttatcggggttcagttttatgcgggcggagcggagattctcaaaagtttccgctagatctgaaagtaaggtctcttggttgcgtgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccagggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgtttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacctcgccgtttgccggatggaaccaccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgccgggagttccggcctctttctttttgtcgctcgcaggcctcccctttcgggtggcccgcggagcgccctcgacggcgaggacatgaccctcgtcgccggaacggtccgtcctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatacgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccgtcgtacttctcggtgatggtgggccggaaccttgggggccaacggacgttccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccactcgccgcgccctccgccttgatgatacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcactctctctgtatgtggtcagattactcgtcggcaagacacacgagacacgacgatgtatacaggttcgggccgccgcgaagcgtaataccctactcctgtgttttggtggatctgtgtatgaacgagctacaaagtgtccgctgacttctcccccgttctcagctttcaatccgggaaaaaaatcccccctctaaatgggcaaggtcctccttttatatctcaaggggataccacatgcacctttctctttccaaactggactgttctttttctctttaatgggcggagatcggtacggtttccatccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgcgggcgattgcgtctacctcaagcctctggtcatgatactcccggtcccatatcaccgacaggaacattgagcaaagaacacagacttacggagcaaagcaactacactattgattcaaaccatggtgtttatgcagctgcataggattgccaggtcctaattggctgattctgccactaactagaaatactatacttatattagaactcacgttagatagatagagtagagcatatatagggggtttagcccctctctcctaaacacccccatagttgtgaactcccccatttagatccgagtaccatcttcttattggccttgtttagattctaacttttttttcttcaaattttaaacttttctgtcgtatcgaattttcttacacacacaaactttcaacttttccgtcacatcgttctaatttcttcaaacttctaattttagcgtggaactgaacacagccattggcttgtggcgtgtgtgagatgcaatgtgattgaattttttggaataccctcctttttatttgagaatttttcgtgcagctgtcaaacgctttcaatctggcggggtttatttgtgaccctcgatcggtcaatggccagtagcaatccatccgtccgttcaaatccctctctgggaaacggacgaaacgggagaggcgcggaaaacccccaccccccaaatcggagcgcggaggcgccgaccaagaaaccctacgccgcttgggcggcgatgatggaggcggcgccggacgaggaggccgggctggcgctccccgagggcgagcggattctggaggtcaccctcatctccgcgcaggggctgaagcctccctccggcctgcggcggcggctgctgcaggcgtacgccgtggcgtgggtggacgcggcgcgcaggctccagacgcggccggaccgcgcgggcggggtcgacccggagtggcacgagcgcctcctcttccgcgtccacgaggccgcgctcgccgacgactcccgcgccgccgtcaccgtcgagatctacgccgcgcccgccggcggctggcacatcgggggggactccctggtcggctccgcccggttcctgctcggcgaccacggcctcctgtcccggcccgtcgggtccccgtcgatgttcgccgtcggtgtgcgccgcccctccggccgcgtccacggcctccttaacgtggcggccagtctcgtcgccgcgccgccgtccccggcagctgcccacgctctccgctcatcccccgccgtctccctcagcggcctctccacggcgcccatcccagcaggccgcgtgctccgcgtcctcaaccgctcgtttccgacgcccccaccctctccgacggttcttacgaccaagaagcagcagattgcagccaagccgaacaagaagtgcgctgacaagctggacgttgcggtgaagctgaacaatggcgcagatgatcggagcgatgaggagcgtgaggagttgagagagatgggcggggtggtgttttgcgggccttgtatcctaccattaccaagaaagatccacataagcccctctgacgagaacctgcaggcctttgctagcatcttctccggcggagttggcattaccagacagagccctcgccattgaggagtccaggcatttaataggttcggttctttcagttgattccttgtggagatagcctgtttcttcttgttgtggaaaattagtttcttaaccatgaggatatagtgctgagttgtattatagcatctattgttgttactgcaaatatgtctcactgattcttttttgtgtgaatcaatggaattatagaattatagtgccacaatgaatagcgcggaatcattttgttatctgctatgctcaaagaacctcaatttaaggtttgaagatttcgtttgaagcaatataagcctgaatgcctgagtatttccactcatcttaatggcatatgtggatattttcttgttgctcaatatcaaatttatcggtgatagtgctattgtgaagaattgtcaaattggattattcctggggctgtttgctttcttgatgctgcagctgcattgcaaaattgttgcctgggttgatttgtagtagcattgcaaacttagatgttgtgaaaagttttaatgacatcatattattttcaagtattttcatgtgaaatatgtagccactgttctttaaggttaacttggccgtacatgggtattcatgtttgtcttacactttacctgatgaattatgttatgtacagacaattcataataactagacatatatctatcatttcactgcttctaattaatgtcttctgtggtcatgtggaatttagtaacagttgaacctttagtttaatctgagggactattgataattttaattcatattcagtgatcaaaagtacttaatcttagatttagtttgaaaggtgtgattgtttggtttagaggaaagatcacacattaatgattgatcagcatgcatagaacagtattctatggttttttttttacagactagctctgtgggatagttctcaagccttaatggcctttgaattattctgaatgatcccttaatgaaacataaaatgaacaaatgattattattataatagtgctgggaagattaataagcagaaagatacttcaatggtagaaccagaggattagtgcactaaaggcctgatgcaaacaagtccatagtgatttgttttcccttcttttctgagaacaaaaaatgatatcagtactaactactctgtacttggtttgacttttgaaaagtcaagtgttttggaatgattagtgtgagcttttttatgtggatatcatattagttaccatatttgttgcaaaggacaataagtcttaaaaggttgaagatgcaagtggcagattaagttcaggatgatgctatgaatgccatctggttctctcacaagtcacaactatcagcttaatttctgtaactttgtttgtattcttttgttgagatatgtttactgggtttaactgatttgcacgttcttttatagtttatgtcataattcttaacacacaaagcttctttatgatgatttggcatgtgatggttccaagtgtccaacagttttttgtccaagtcagtgattgaatgcagggaataaacatcacttgtactgttgtagctaattactatcccctgaatgtagttgatattgtttccttctaagtttacaatctgaactgcaaaatctgatagtattgtataggaatgctttatggactgggttaaaatcttgcaggccatgtttagggcccaaattcgaaatagtttctttagcctgtgactatttatgtctcgagcctgtttgtggctttttttttcatagcctaggcttctggggctttgtagtctgctgatatcgtgggacatctaattgtaactttgttgtatttggcttttgtattaccaattttctttgcattgattctgaaattacgtgcttcctcgttttctatcttacaaatgtccatgttccttttcgatgtatcggagtaagataaagacagttttggttaattgacaactcatggaaaagtatctgcagactgcaatgttaagttatcttctaaaaaccaaatggtatacttgcttaaattgttagtgattcttaatgcttccaaagttccattgtaggatcaaggcagatttggtgaagcactgagagataaagtgctgtattataaaattgtctggaggatatccaaagctcatattgtgaccttacgatctaagcattgggtggactatacatgtacagtgattttttaaccgttttgacagccctttccatcttggtattttatatattttttagcaaacggtaattcaatgaactatagcgtcaaacttttgagcatttcaatgtagttttgatatctttgacaataatttgtggactatttctatgtgattagtggatgctttctatataaacaatcctcttggttctgatgtaaagcattatgtgccgtgtcacttgaaaatgacaaaacaatattcagattctgaaaaaccatctgccttcttgactttgatgattcaagtatccagcaaggggatagcaagcaataaactcatgatgttaggtcatttgaagatcacatgttttaatagttttgtcaggatagtttgtcggctttttttgggttttggcacattttttaatttttttttctgtacctcgactattgagtatatatttttttgtcaagagctgtgctacagtacttatgatcctgtatgacgtgctgccaccaaaactatcaaagatgccattttcactgtacacctaaatggtggtttcttcaccatcaccatcgccatcctccattctaaagtcgttattatagtttccatcagttgggtcatatgtgcgatttctgctctccaaaatctgcctgctttctatggtaggatcctatgttccgatttagcctgttccctcgtataattgttttcctgttcactcatattgctttacaatgacttatcgactagggtaaactgtttgacagttcagaactggaaagggccacttgcggccgtcagatttacgtggaactcgctgttcctttgcttattgcgcttattggacactgcataattctccaaaaagaggccataaagaagtacttgacgattgtgacctcacatcaatggccacatacaaccatgtaccatctcctttgttttttccaggacttttccatctcccccttcttccaattgcgatccacacaatcctgattcaagttgcgccaccgacgtaacatgccgtctttttcctggtcgatcctttgattgcctgaattctttcttcttttttttctacgccccaactggttgatttggatcccattcgttccctctcctttaccggaagaaccagcccacttcttttttttttctctgtctttgcagcttttcaagtgcaatgttggagaagatttcttcgacggcgcgagctccaagaacctcacaaattgttccaatattccattgcacactcggggcatattggttggatcctattgttttagatgctgcccatttgctaaacacgccatgttagaggtctacttgtcctttctaggttccttttcttttgatgcgtttgcatatacggtatatatgtactagattccatggagcatagcaaaagataaccactgttgctttgcgggcatctcatagaagagaggagcttcgttgagttgaaaatgtttcaaggacaagtgatgcgaattctgtgtgatgccacaagtggaaagaatagcgcaaatgtggcaagcaaagcaatgcatatgcgctgcttttcctggtaggtatgtggcattgctaggtgcggtggtagatgtccaaggggaagaagcacaaggaggcagccgcctctagtggcctcgccactcactcacactgcccccggagtcttttgctctccaccacctcccatgtttcaaggtaaattcgtcgtggtggtttcatgccttgtgcatatcaagaaagatgtacttaaagttcctgatgccttgcaacgtactcgagtttatatatatatatatatatatatatatatatatatatatatatatatatatatatatatatagagagagagagagagagagagattatgtgacggttgattgtgtttcttccttagaagttcatatgctcacaggtgctaaagtttcggacagtcaaatgtatcggcaataccgtatagaggatgcacgttcattttattactccctccgttctataatataaaaatctagaaccagatatgatattttatattacaatgaattggacagtgatcattttattattttcttcattccataatataaaaatctagaaccagatatgacatttcatagtacaataaatctgaacaaggaatgtcctgattcattgtgctatgaaatatctcatctgatgcttacatttctatatcgtgggacacggagggaaaaactccaaagtttgtaaagtagactggtagcttcatagggtgtgggtgtccctacattctgcttatatacaatcacaaagggtatcattgctagctaaaaacagtcacagtacaaggtaatctctccgtcccataaaaaatcaatctagtactagatgtgacatattctaatactacgaatctagacatacatatgtccagattcatcatagtagatatacatatgtacatatttatcgtactaaaatatatcacatccggtcatatgtttattttttatgggacgaagagaatagatgagcaaccgggctgatttagggtgtgtttgagaagaaagagattggggagattgggaagatacgcaaaacgaggtgagccattagcgcatgattaattgagtattaactattttaaatttcaaaaatgaattaatatgattttttaaagcaacttttctatagaaaatttttataaaaaatacaccgtttaatagtttgggaagcgtgcgcgtggaaaacgaggtgctttctcaccctatatcacacccaagcgaacgcagccttaatatacacctagccaaagctacccgaccacaactgttctactaggggtcagtgattcagacattccgtactcatttgttcataccatcttcatttcaaaatattcatttcaaaatatatgatatggtttacttttcgtataatatttgatcattcgtcttattaaaaaattaatataaatatgtttaaagaataagttaagtttgtattttatttgatgataaaataattcacaataaaataaatagggacatatccgatgaaatgagctaagtgttggaaactcatgaaaatcatacttaaaagtttagtaaattcatgaaaaaaatactagagatgggtgtagatatgaaatacattctcaccaaatcccagctccaaactcaacttcgtttatttatgaaactttcagatacgatttttacgaggttttaacatttagcttgttttcacactttgaagatgagtgattaaatgttatgtaaaaaatcaacgacattataaatttggaatagagggagtatttgccttgcaccctttccgacagttgagcagacgaaagtatcgccgcgacgccgcctcgttgctttttactcctacgtggctacgtggtcgtctcctttggccttggccgattgatcgatatcaacattgatcttttgacgcgccgaataaataggtcgcgacgttcatgagaaaatccacccggtattggctttctcccttccgcgtaccggatgctcaagtgctcaacttggaaacaccgtgcttgcctgtttacacataatctttaattttctgcgatgattgcctgtgccctgacacctcgctgcccgtccgtactagctttataagccttgtttagataaaatttttttaacaaaaacatcaattacacagtttgcatgtaaattacgagacgaatcttttaagtctaattacgtcatgatttaacaatatgatgctacagtaaatatttgctaatgacagattaattgggtttaataaattcgtcttgcagcaggcgaaatctgtaatttgttttattattagtctatgtttaatactttaaatgtgtattcatatatttaaaaattttacacacataaaactaaacacaaccacagtgtagtgtgcacctaaagctgggcctcatgtcttcaggacaagcaaggttccattgttagtctgaaacagagataagtgaggcaggcagctgagaggtcactgtttttagctctccaggcgtccagctagttactgtgttggcgttcagagagtgacacacacacacaccgtggagcatctgcatgcgtcgggctcgtcg

SEQ ID NO: 21222 - DNA, 19958 bp, Oryza sativa
acggacgcggcactgcacggcatggcacgttgccttcgctcgcgccgctgccgctaccacacccacaccacgcgcctactatcccccccccccccccccggctgtggaggagtcgcaacctccgctcgctctaggatccgagtgactagctccggccgctgccgcagcggcagcacatgcagatgcagatcgacgcgcggctcgggtcgccgggtcgcgcgcgcgggaggtgtggttgcggtgtgcagttgcgggctgcggcggggggagtcgctcgctcgtgagtcgcgacgtgttcgactcggcgcatcgatcggtgcgcgggggcacggccgggccgggggagggggaccgagtcgtgtacgctcgggtacattgtccgttggtgttgccgggtacgagggagtacggtatcgacgaggagtgcgatgcattgcggggatgagctagaggggacggaacgagttatctaatcggttctgaccacatactccctccacccattccataatataagagattctgacattttgcttgcactatttgattattcgttttatttaaaatatttgtacagatattaaaaaaacgaaaagttttgcttaaaataatttggataataaagtaagtcaaaaaaataattccaattttttgcaagtaaaatgttaaaatctcttatattagaagacagagtgagtatatgagaaaagaggatttttttgaaaaaaaaataaactagacttatggcttgttattttattcaaatttcaattacaactttctcatttttttcgtaaacacacttttaaaaggttaaatgatacgtatttttcttgaacaagtttatataaaagtttttaaacattaattaaatctaatctttcatgtttgtaatagttaatactatttaattaatcatttgacaataagtttttcttattttgcgtgtggctgaaaatctcttccaatctaaaataacgaatgcagccttaggaaatgagccattccagccattttgcttatatagtcaaaattcaaagctaatacgagtaaaacccaaatcaagtgacaaacatttcaaaaggacaatgttaaaaaaaacacgaatattaggaaagaacctaatatcaaataattaaaaggggtgagatttcgaatttaggccagctagcctaccaccctgtggagctaggcgaaaaactctaaacgtttctctacaaggacaattgtttctaataaccacattccaaccttatctccaattccaaatttccaatcgctagtaacgaccgactatatatactgagtaacactagtaagactatttttagagagagaacgattcaatgattcatacatatagccaagtgaaaaagattggtatagatagggctaattaatcctgcccccgccgttttctctcggtttgttaatcttaaccgtggatgtcaacatcacacattgtgtaccaatcgccatctcaccacctttccttttgcactataaataaatccgaacggcctctgcttctcgaagcccggcctgtagcctcgcctcgcctccctccgccgccccggttacgcaaccaaataccgacggcgccgcccgccgacgagccttctcccttcgcgccgccccctcgcagcatcctcgtgccctcctccggcatcttcctgcgccgcgttagcatcgtctgtcggcgccgtcggaggttctgctcggagctcgcttccgatggacggcgcggcgacgggcacggagcgcctctgccctctaggatgaggggccggagacgtcgccggcggaggcttgtgcaagtacgagcacttaatattctcccctactctattccttttccatttgagaaaattagaagaagaagaaaaaaaaaactcggttactttatttctttgtgagaaatgtgggattcgataagatatggccttgctcgtgctgttctaatgcgctgtaactgtgggtgacggcggtgcgtttggtatttgttgataatgtattgcttcgtcgctgcacattctgcgagcctctgcttggaaaagcaaaccagcaatatttcggtgtaccatcactaactggagtagctgcggcttgttctgttcggttcagcatgatcttatttcagagtttattcggtggattgatatgaaaacgattttttgtacggattaaaccgcacggaaaataccgctgaactggaaattttttttgaagaaacggtggcccgtggaaatattttatatgatctgttccttataacatttgggtaggagactaggaggaacataatgtgctccaactgtgccacggcatgcaaaccatttacagatagcacagaagattgatgaactaacattatggtaattgagttctgctgcaatagtaactgacatagcttgagcgctttcgaaataaaatggtttaggatatcatgtacttacatatcatgtgttagtatgtctgcaataggcaatggtaacttcctgttcctgtggttaaacattaaccgagcttttcttgaaataatatactgatgtaattagcttatgatcccatgttcgttttattttccatttatttatttataggtaaatgatctttgcaactgtcctataaatataacttttttttattcaggtcatctatgctagcacacttgatgactgatgtcatggaagataattcttcatggacagctctttctattgatcacattagaatttctgcattcaatttcggaattgtctccgaggataacgatgaaggcaaagaatttttgctttcattggacactgttgttcctgatgatatcctggagagaattttcacgtttttacctatagtaagcatgataaggtcaacagcagtttgcaaaagatggcatgacattatctactcaagcaggtttctttggacccacatgttgcctcagaggccatggtactttatgttcacttctaatgaaagtgctgctgggtatgcatatgacccgattctccgcaaatggtatgatttagagcttccatgcatagataagagcagttgctttgtctcttcttcttgcggattagtttgtttcatggacaatgacagcaggaatgccatttctgtatctaatcctatcacaaaagattgtaagagaattttggagccccctggtgcaaagtttccagactacagcacaattgccataaaggtagatcgttcctctcataattacaccattacattggcaaaatgcaagcaagttccagaggattacgtccgatgggatttctctttatacaagtatgactcacagagtagttcatgggtgactgcggttgaggaggtgttcattggttggagagggggtgatgacagcgtgatatgtgatggagtattgtactgtttaattcactccacaggcattcttggtaatattgaaccgcgtcatagcattatcatgtatgaccttattgctgggccttctaaggcgtcactaatgcaatcgtcgatcccagcaccttgctctctcacctgtggacgtctgcttaacttgagggagaagctggttctggttggtgggattgcaaaacagaacagacctgacatcatcaaaggaattggaatatgggaacttcacaaaaaacaatggcaagaggtaggtcgaatgcctcataaattatttcaaggatttggtgagtttgatgatgtatttgctagcagtggcacagacgaccttgtctacatccaaagctatggtgcaactgctttgcttgctttcgatacgaagcagaagcagtggaagtggtccgcaaaatgccctgtgagcaaaagatttcctctccagcttttcactggcttttgctttgaacctcggcttgatattaccacttaattgtaatgccttccaatggaatcaggttggcagtcctggtctttgtgaatatatgcatgcttcattagattgttgcgtcacatgcaatgtgctctcctttgcttatcatcccacattcgtcctgatggatgcaatttcctttgcctcttttcattggattaattaatctttagaatgttgatctctctctctctctctataataatgcctgtttacaaatgtacctctattttctttaaaaacaatgcatagatctatgctatttatcacatttatctgaattctcaagttcagccatgtactgcctcgacaaaacctgcatacaatgtctttgcttgatgcaggccttagaacctgtccatataaactgaatgagctattgtccttacagcatgtctagacagataaattttgcagcgccataagttacatgtcttttcatcgcgcaacttcctgtatgtgatatctaaatttttgtcctttgcggtctcaagggacaagttcaactgtatgcgttttgtttcttgtgatacttcatcagtgatgggcctaccactgatgtttgctgctccggaacagtttgcacactggatgtacaaggcgattgaaagtcgtttgtctgtacactgaccagtcactactagctgattttgtagaatcatcatgggccaaatccaggtttcctcttgtaggagctggcccatccctgaaaccgccgtgactctgcatcgtgatgcaagtgtgagccagaggtgccattgatgagattccagctcgtcatcacagctcctctgtatgtagtgctcagttgtgacattaatagttcagccgtctcagcgtttctcagaatggtgtcacgcgctcatgctctgcatatgattttgttttgttgccttgcagattgcaatgttctctctctcttttcttttggccgtacgttttagctggttagctcactctaggtatggcaccatgatatggggccaattcgtctgctgtttttctttgttaatctttaccgtgtctctgatttgttaccagttctgcgtgctgttttaatcagaactagctgggtggcccgctcaattcgcaattgcgcggctagcacccaaacaaaatcatatattttttaagtatgattttacttaaaatttattaaatagctatctagctatttcattgtcttaagactttgaaagaccaaaccttatcatcctcgtgtttctaattatatagtttttaaaagtcacaccagttgctacctcttatgtcatctccttctctatttgcttgcttgatctaccactattttcattcattcttcttggaacctttaaaaattggattttatagtttttagagtttattgtcatattgggtttcatttctagatgtcccatcaaacgttgacattatactactctacggcccgtccactgtctcttctcattgttgtcattgagattttaaaaatcgaacataattattgtttgggttcattttttactttctagaagtcccgctaaaccatcaatggctttgctattgtactcctctacggctcgcccgctgcctcccttctttattggcattgagattttaaaatcgaacatgattatcattggttttttttttactttttagaagttcaaaacctttaaaaattggacttgtagttttattttttataatttttagaagtcccatcaaacgatgctacaatgcccctctacagcccgtccgccgccaactctttattgttgtgattctaaaaatcaaacataactgtcgttggaattcattttttattttctagaagtcctgtcaaccgtcggcggctctgcaactatactcttatacgccccgcctgctgcttctcctttttattatcattgaaattttaaaaattgaatatgattatcaattgatttttttttactttctagaagtcccggcaatcgtcttactcatttgcttcacggcctgcctgacgtctctccttttaatcgtcattaggattctatttggtgttttattaacaatttttatatctcatatcaaccgccaccactctacttctttataggcatgttacttaatttattttgtcatgtgttttagatggtcttttctttcaataatctttatttttatcacaaattttagttatttataaattgtattcctaattgatatcttatttttcattttctaatttcagaatttttttaaaaaattttagttaatatcgtattgtgttattttaatgtttttattttttattttcaatttcagttgtttcaaaattgtattcctatttgaactctcttttattttttctagttttagatattattttatttttattctaatttttaattaatctcgtattggattcttctttcaatattgcttatttttaatttcgaatttcagttatttttaaattatacttctacttggactctcctttttctttttttatttttctccaattaatgtgggaattatttttattccgaattttaattaatcttgtattgagttattatatagactcttattttaatatttcttatttttaattccgaatttcagatatttttaaattgtattcctacttggactctcattttcttttttaattttggattttattttatttttatttcgatttttgattaatctcgtattgggttcttatatggaaacttattttaatattccttatttttaattccgaatttcagctatttttaaattgttttttttacttggactctcctttccttttctgattttggatttttatatttttatttcgaattttgattaatctcgtattgggttcttatatagaaacttctttcaatattgcttatttttaattttgaatttcagctatttttaaattgtacttctacttggactctcctttttcttttctttttctttttctccgattaatgtgggaatttctaacccccacaacgaacatggtgcgtcatttcaaagttgttttaataatataatagatagatagatagatagatattgcttgacagatgtgtcctatcttacaggtttggaatcctttttgttggttaagaaagcagtaatcgcctgttgcttgctgctcttatcagctgtcacagacaaaccctttggcttctcaccctcttaaccttgttcacttttatccagaccagataatatatgaggtgagtgtttttagatgaacacaatgggaaacactgcgtatgcagtcatggaattatttttatctcttagattgttaatggcatggtgtttccttttctggatgcttacacagaaacgaaatacaaatagggaagaaaaaaagaagaagaaagggatgaagtacccgatttcattgtgtttgaatcttctcctgcactttccagtttcatcgtaccatttggccatttgagccctttaggctcgtgcttcgtgtccaactttgtagccaccgaattactgcaacttcgtggggattaatcgagattttgatgtgcactctagtctatcttggctggccatccaacttgcccttgtcctctacgggttgcaagtggccacgcacagttgcgttggtctacgcaccgtagatcacgccgctggtgtcgacgaatttaacttggttcaagatgtgccatgtgtgccgtgtgttgccttgtccgggaaagatggaaattctgaatgtgtggtttactagtacaaggattatttcatccaaagagggaaaaaaaatctgcgagttcccttcagtagaaaatgggtagcagaacattattgttttaagctgagttctagatgtgtggacagttttccatattcagatgaaattcagtccttaatttttcttctaagaaatggtttggttgagagggttagaaacagctgcaactgtgttttttctcctttctcaacgaaaggcaggattgctaccgtcggattgagaaggcaaataggtatttataatacagaaacgagtttacaggaggctataagtactaaaactcaggcctgtcgaaaaacacaggctgatgaatgatgattgaatgaacagagacaactgggccttaacccagtgcactcactactctgaataatgatcaaagcacttatttgcatgcatatctaccatgcagtaaaaatgaattctgacgtatgatcagtgttcattggaccacttagagctcattcagagtttcaggctaataataaaactaagactaaccgctccccgcgtcgctcttgcacagatttctcgggggcgaaaccctagccgcctgcgtcgccaccttccatccaccctcaacgcctcgccgtcgccggagctcgctgctgcaaaggcgagcggccaactgggaaggcggtggtgaggacatcgtgagtcgtgacccagcgaagctcgcccttggcacgagaggacggagcggcgcatggcgttgcaggtccacagcggctagagtcgatcggcaagggcgcaatggatccgacgctctcggaagtggatttggcattcccaatgcaggggcgcagacggcggtggaggttggcagctggagagaaggtggtggcggcagtggcggtggtgccggatctagagctcccagatccagttcgacagtggcgctgtgacaggaggaagcgcacggcgccggccgacacgacgacgtgtggccggcgaagcgcgtggagagtgcgacacctgttgtggggctccagagggaagaccatgatgatggccctggcatgaaggagcacgattagtggaacatggccggcgtggtggcgagcctgctatggtggagcacggcaaggtgaggtggtgcggtgacgagactgtcacagtgggaggacggaggcgaaggtgatgcgaccaggcggcccgtaggagacacgggcagcctggtcgagatggcggcaacaacggtagcatcataagaggggcgttgaggactgcgacaagctcctctctaggtgttggtcctcttgcggcggcgatttgccatcgcaagatggccacactggatggactagtgcggggagaggggattcatcttctctctgaccctcttcctctccagcccacccatgtggatgaatctggagcacgccagaggtcgagatgcttcttcgatggccggccggtggtgaggcgtcgacacggtggctgcgtgttgaagaggattagctagtagtgtctgttgaacttgacatgcacacattgacatgagaaagtaggaaactacaggcgaaagcctagccttcgggccgataacggcgacgcctgcgtcaccgcattcctctcgggacgttgttacatttctcctattctaatggtttctttaagtattaaccatgtcctggttctttaggacgggcggcggcggcgctcttagcgttgttcccttatttttagacgttgttcagaagaactattcctctggcgtgtcgtgtgcttgttttgttttcagtagcaggattagacgttgatgcgtggtgtggctatttttttctttttttttctagtcttctagaactacagacttattcttttttcctgatatatcaacgcattaccttgtgcgggttgtttcggaaaaaaataaaactaagagcagagtatcaccagttggagactggccagtcagtttctacttaagtagactctccaatctccatcatgtgactatgtctggatcactacaacttcttcgacgtatggtttgctccatggcctgaacaagttgactgggacgtgacctacgtgtcccgcctaacatttcttaagttcagaccaagcatttgcctcgtacatacgtaattacgtattccataaaaaacttcaccgcgtccaaagcagatgcagccgcgttgctacttaattatcaactgacatgagccaatgatacattgattctatagctgaaagctaatgaaatcactgatcaatggatcatgtcaaagtcatccctgattagcgggttgcgattaactggtggaggaaagtttctatccacaaattagaagtcgacatctctgcagaactggacctaatggtctacttacacgtgaattctcgcatgcagttcgtgatggtacaagttgtggccacacaaaaggctggacctgttctgttcatctcttgcagaggattttcacccgttttgtcttgtgtgaaaattgacattgcgtagtagtaaccggtaagccagcgatggaacttcagtcaacaggttgttctcatggagggattacttagcagtgtaggcaacaatgtattgaggccgtgttttctccttcggagaaaatgacgaatatggcttctgttcttaattagaactgtccttgttgctcatacatggattacttaactgagtagacaagttaataagagatcatatagagggatagtgcacagctaggagcttaggacgttcgaaaataacttccaatccaatcgattgcttgcaaagataagacgatgaaactaacacaatacggacttcgatgagaaaagggaaaaggggcgaaagtcatcgctatccaaaattctacaaagttcctttgaattggcttaggacatactccctctctttaatattatactccgtaagtcgtttaacttttttagtcaaagtttttaggtttgatcaagtttataggaaaaaattagcaatatttataacaccaaactagttcattaaatatactattgaatatattttaataatatgtttgttttatattgaaaatattattatatttttctataaatttatttaaacttaaaagaagctttactctaaaaaaaatcaaacgacttataatataaaacggagagagaaggaatttcggatgaattttaacatgagatctagtctcgtaaaaaatcatttatcgatatatcttcttattcatgtgttccttatgtgcttccctcaaacggtcatttctacatcatttctgccttttttttttaatccatggaagcccttttacgtggtgatcatcagaatttcgtatgcaaataatcttgatgatctttgtaaacatttagatggtatggttttacttccttgaagatgagcttctgattatatagtgtaataacataagacacttattatttacattggataagtaaacttcaaaagtgtaaaattttgccaaaattgaagtaacataaatcataaaagcataactttgttagatatttttgataatattaattatatgtcaaagttacatttaaatgattgtgttaatatgtctgaaacaccaaatatgagtaaggaggtttacttaagagtaaattgtaatttgagccatcttttattgtcaaaatgttactttacacacccttaaatcaacttttcttttttctactttgtactaggtaatttttgctattttttaaatatggatcacccaaatattttttctaactatgtctagcctccactctagcaaatatatagactgcacatagatggaggagttcggcggtgtgctggagccgatttgtttgaggttgttgatatatatacatagaaaagtttatttatgatgatccaaactacaataataaggatgtgtttagttcacactaaaattggaagtttggttgaaattggaacaatgtgatggaaaagttggaagtttgtgtgtgtgggaaagttttgatgtgatggaaaagttggaagtttgaagaattattttgtaactaaacacggagtaatattattattcgatccaaataaaaaacaaatagtttaaatataattcaaagcaaaactttaacgataaaataggactcaaattacaactcactttcttaatctattaaattattaaaacagctttgaaaggaggcaccacgtcctacattaatcggagaaaaagtaaaaaaaaagaaagaaaaggagagtccaagtagaagtacaatcttaaaatagctgaaattcggaattaaaaataagcaatattgaaagaagtttccatataagaacccaatacgagattaattaaaattcaaaataaaaataaaataaaatccaaaattagaaaaggaaaggagaatctaagtagaaatataatttaaaaatagctgaaattcggaattaaaaataagcaatagtgaaaaaagtttccatataagaacccaatacgagattaatcaaaatttgaaataaaaataaactaaaatctaaaattagaaaagaaaaggatagtcctagtaggaatacaattttaaaatagctgaaattcagaattaaaaataagaaatattgaaagaagaatccatataacaacccaatacgtgattaattaaaattcagaataaaaaataaaataatatccaaaattagaaaaattaaaagagagttcaagtaggaatacaattttgaaacaactgaaatctgtactattatataaattgaatatgtttttaccggtattttgttacgtcatccgtgtataagttggtttttaagttcttttgtttttgaaaagacatatccgtcatccggtgaaaaaaaagtgagaaaaaattaaaaaaatagaaaataaaacttctattgtaaaaaaaacgtccgactccgactcctccggtggaaaaaaaaaagagagacgacgggaaaaaaatcaagaaaaaacaaagaaaggagaaaaaacaacttctacccaaaaaaaaaaacgactgactcctccggtggaaaaaaaacagaaaaaaataagagaaaaaaaaacttctacgtaaaaaaaacgtccgactccataaaaaaagtccgactatctgcggagaaaaaaaggcaagaaaaaataaaaaaagagaaaaaaaacttctaccgtataaaaaaaaataaaaacgtccaattccttaaaaaagtacgattccctcaaaaaaaggactttttgtccgtaatcttctcttctacttctactatttttttaaaaaaaatctctactattataaaaaatttaagatattttgccggtacgtcatccgtgtatgagtcggtttataaatttgttcgcttttgaaaaaatatatatcctttgagttggttttaagttcgtccgcttttggaaatataggagtcgtataagaaaattcgcatgctaactttagacgaacagactcctaaccacagcttatgattttctagaaatatatagatccaagcaaattctcacagtgatgaatcatcataactaagccatataacaataataagactaaaatagttgtcacccgttgtagcgcatgggcttttctcttgaaaataaaaaataaaaatattaaaagaacacaatacgatattaattaaaattgaaaaaaaaattctgaaattacaaaacgaaaaataagatttcaatttggaatacaatttataaataactaaaatttatgataaaaataaagactattgaacgaaaagaccatttaaaacatatgacgagataaattaagtaacatgcctataatggagtagagtggtggcggttgatacgacatataaaaactgttaataaaacacaaaatagaatcctaataacgattaaaaggagagacgataggaaggccgtgaagcaaatgaacaagacgattgccgggacttctaaaaagtaaaaaaaaatccaatgataattatattcgatttttaaaatctcaatgacaataaaaaggaaaagcagcgggcggggtgtataggagtatagttgcagagccgccgacggttgacgggacttctaggaaataaaaaaatgaattccaacgatagttatgttcgatttttagaaccacaatgacaataaaaagtaggcggcgtacgggccgtagagaagcatagtggcatcgtttgacaagacttctaaaaattataaaaaataaaacccaacaagacaatcaactctaaaaactacaaggttcaatttttaaaggttcggaatttctaaaaagtaaaagaaaataatgataatcatgttcgattttaaaatctcaatgacaataaagaagggaggcagcgggcgaggcgtagagaagtacaatggcaaagccgctgacggtttggcgggacttctagaaagtaaaaatgaacccaaacgataattatgttcgatttttaaaatctcaatgacaataaagagaagagatagtggacggactatagaggagtataatggcaatgtttgacgggacgcctagaaattataaaaacgaaacccaacgtgacaaaaaaaactctaaaaactataagatccaatttttaaagtttctaaggagaatgaataaaaatagtggtagatcgagcaagcaaataaagaaggagatgacataaggggtagcaactggtgtgacttttaaaaaactatataattaaaaacacggggatgataaggtttggtctttcaaactcttaagacaatgagatagctatttaataaattttaagtaaaatcatactaaaaatatatgattttatttaggtgctagccgggagctagttattactattgcgcacaagtctgaaacaaccacccggccgtgttttagaaccaaagacagagagagaggtagtacaaagtatataaagactaaaggaaattagagtccacttcgaataattaatgcatggtttctgcaagcacaattgaaatagacaagtcaatgcatggtttcaagtcttcgttgtactgtgcgccaaactttcctggctagaaagtacactgcaaaaattgccatctagtttttcaaagttggaacggttcaattcaaccatgcatatatgcatccaccccctataaaatggccaccccgcaagccacaaactccaccaccaagcaaatcacgtagtccctccacacacctcgtacctcgatctcgaagcttaattactagttaacattaacaatggctgctaataagctcaagttctcccctctccttgccctcttcctcctcgccggcatagccgtcacctcccgtgccggcgacatcgccgtgtactggggccagaacggcgacgagggcagcctggccgacgcctgcaactccggcctatacgcgtacgtcatggtcgccttcctcagcaccttcggcaacggccagacccctgtcctcaacctcgccgggcactgcgaaccaagctccggcggctgcaccggccagagctcggacatccagacgtgccagtcgctgggcgtcaaggtcatcctgtccatcggcggcggcgccggcagctacgggctgtcgtccacccaggacgcccaggacgtggccgactacctgtggaacaacttcctcggcggcagctcgggctcccggccgctcggcgacgccgtgctggacggcgtcgacttcgacatcgagaccggcaacccggcgcactacgacgagctcgccacgttcctgtcgcggtacagcgcgcaggggggcggcaagaaggtgatcctgacggcggcgccgcagtgcccctacccggacgcgtcgctggggccggcgctgcagacggggctgttcgacagcgtgtgggtgcaattctacaacaacccgccgtgccagtacgccaacggcgacgccagcaacctggtgagcgcgtggaacacgtggaccggcggcgtcagcgccgggagcttctacgtcggcgtgccggcggcggaggccgcggcggggagcgggtacgtggcacccggcgacctgacgtcggcggtgctccccgccgtgcagggcaacgccaagtacggcggcatcatggtgtggaaccggttctacgacgtgcagaacaacttcagcaaccaggtgaagagcagcgtctgagctatagcctcaacctcaagcccccaagcctgagtaattaacttacgtgacacgtatacttattacttgcacagtggttgagttggactataaataagaggagatccgttcatacgcatctgtaatatagtagtagtaataagcagttatgtatgcacaacccacatggtgtactttgtgtaactctgtgtttgatcatgggagtgtatttgccgatataaattaaataaggagaatgatttgcattaagccagtatgttcgagtttggagagctgatcggctctgatccacgggatagccccagtgaaccacctcttcgtcttcggtgttaggtcgcgtgacctatcgcgaccaaaaataaaagaattcttgtacgaaggaccggacgcaagatagatgtcgttaggtgttttttttttttcaaatgaaactcgtgatcagaaagtcaccaacggagccataaacgtatacgcgcagggcgtatccagttgtactatacgccggtgcctagcgttaactgatgatcgtgtactacgtgcatgcatggtggaataagcgtaaaagttgactaatccaacaaaactcaatcggtcaattcgcgaagcggcagctgtctttctccccgtcagcccgcagagcacgcccaccggcgcaccgcgcacgcatgtgacgtgtggttccgctggggaaggagaaacgagggcacgcgagctccgcgactccggtctccggcgctcctatggctaagaattgaaaggcaaaagctactctcatggtcatggcgaagcttccgcccgttgcctgagcagattggacctgtttaaaagatttgttacttcactggggaatactagggatcagttgaccgattcaggaaatgaaaatcggacgtacacgcgcatgaaggagactccaccctagtttcttctccctctctcctctttaaatatttttcctactgaattacttatctaatctaagtataatttgattatattgttatattcgttattcgttgtaattaaatctttacagcaagatatcatatgattatattctgataaaagaaaaacatatatttcaaatcattaaaactcaatgttccatacgtgatagcaacatgttttaacacgtgtcttctttgtgtttcataagctacctgtccctcttttttctccacttcatgcatgcatttagtgatattcggaatgatttttctcctaactacatatccgatctatgatccaatcactaccattctattcattgtaattaaatctttacaataaaatatcacatgattatattatgataaaagaaaaacatatgtttaaatccattaacactcgatgtttcatacatgatagcgagtttcaacctgtctttattgtgtttcacaaaacttttaaatgtttaatggctgatttttttcaccatatataaattaaagtttcatctgcggtcaattgaaacatttgactgtccgtttttttacatgacattggacgttgtcctttttttacatgacatccgacgttcgatctagagctcccccctatttcacctacaacaaaatttttattcaacttgcagttgtactttttaagcactattttactttttcatcagtaggaagttacatcaagattcatgttcttttatttttatattcagctggcagttagcagttacactcagttatatagcacttgtattcagctacaatgcacttacacttggttatagcgcaccaaaattagattttactatagttttttcttctagatttatgatttttgacctttttttatttcattgaaaacagactacatccattgattgaaaattctgcaagattcaaaactaaaatctattgaaagattaataagtagtaaaaagaaaaggttgtgttgcaagttccacaacttcaaacacaattatttgcctcatgcagatatctatcaagccttacagtaattcatataataaaattgtttctgttcatacaatctctgacaaggaaacatataggcagtaatacaaatcaaagaaccctgcgatactcatgctacggattgggaacgatcgctcacaccattttacatgcaaggtaacatatttagcaacgaatatagaatcacaacaatggctctctcatgtcttgcacacaactcactaagctcacagttaaatgatgccagtaatgccagcgtggtattatcatcaggcctaaggttttgctggaagaccgtcaattcattcatgggttaatatctgtgcccgcagtcttcacatcaaaccttcctgacctgaatattatgggtggactgcgaccgccagataggttgcctgccactttgaacaagtgcaacctcctcgccttccttcaccataccatgtttctgtggaatatatatagcatcatatcaaatggtgagtatcgtatgtggaatagtggatatttggggcatggctattttatcagtctattttcagcaacaattgctttcagtggctacagcgcaaataacaattttctgcattctgctaaccccaaaagttctgaaaataaaacattctattattctaaaggcgaataagtcagctgcttgtttttaatccaatttatgttttacaacaaaataaatggtatgaatatgccattcacagcaagaccattattttggtcatttcaatgccttttctagttctatacttatttgtactggaaaataactgtgcctgttggttcgttggctcaaacattaagacttgcctcaattacggcgtaaattttttttacatctttttcacacttgaacagcaaagcccctaatggtgcaaaattatctcactagagagaaggcataatactacaatattatttggcctttaatgataattgatcatgccttaaaatatcaagatgcttttcaacatcgattttatttcccagtttacaggcaagctgtaataaatttcaattctgaggtcaggtgtcaggacattctcctgataaatgagtttaactaatgcctattaaagtgacgcagagaaaatcagaaggggtagaatatattagaaattaccagcaagtatgacaaagcgtcaccaaatgtcttctcagcatcatcagaaaattccatctggactggacatacaccttggtacaaagccaatcgttgtctaactctctccctacaaacataccatcaacactaattaggtgcttgaagataccatattataaaggaaaaatgaacaagagaaacatcatacttttagagagccaaacatttcagatcaattgtctgttataacgtcagaagtacatactgtaattatattatctaaactcagttgtcattgatcacaatctcataggaaatactatcagctgatatttaaccattacctaataatgtatcaggacatttccaaatagagccaatggctggtaaattaaaagggccttccatcttgagttcattttgctcctagactaaagcaaaccaatgctaactaaaaccatgagatatccatgtaaccatgtagcataacagtttttttctttactaggatgcaggccacaaaattacatatatcatttgatacaaatggatagctcatgtaatgaacacaattgagcataatttctttcttggttcacagaggttatcaactaagaggcttggttggccaaggcagctcctgccaaagtagtaccgctagtcattagtatatgatgttttggacaagtaaatgaactatcatttgcctaaagttgtttgttgtaacgacaaatattatagaccagaggaagtagtacagatggattggaaatttggatgtgctaaatggaaaaccataacataatcagacaaaaaaagttaacataatgtgtattttactgttaattcaagattatacaactagaaagaaattggggtttatcaagcatcagaacgaaaaaaatagaatcttactggtccgtaaaggcaaaaatggtgccagaagggcggtaatgactaagtaggatagccataaatcctgtcctggtgaaaaccacaattgatgttccaagagtgttggacatcattgttgaatggtatgcaaacatttcactcatgtgattctacagaaagaaatgtaattagaaaagggaattgaatgaggaaaaggcacaggggtatcatggcagttcagag

SEQ ID NO: 21223 - DNA, 28719 bp, Oryza sativa
  unsure (1)..(28719): unsure at all n locations
atcggcattggagcctgagaatcaaaacaaaacacactattaagacagttgaataagtgctggatatttttcataatgtaggggataattatacttctgagatatccttcaattcatgcacaacttgagcatctttgacaaaagaaacggcatagtagtcaacttgattctccacaccaaacttaatatcatcncaatccttgtctgcaagttcaganaatgagaatgaaacaagagtgtttataatattcagtgaaatgaatgttgactattaccagttattgatggcaaggttgcgctctttccacgaacattcaggtgacgcctggatttcagttcacctccatcaataacttcacattttaccgaatcttcagttttggacttgaccaacaacgacatcattccacctaaatggtatcaacatatcgatcaataaaagcacatcatgaaaccgtatagaatcgaagttatatcagaatacacaatcatctcaaagcagaaaagaagatttctacaaatatctggtggtctagaagaagtgttaatcagttgtgcatgactgagcaatgttaacagcaaatcaagactagcagacttcatctaggaaatgatgtctaaaaaaaatgtcaggtaacagtgttcttagaacttgccagttgcagataattatgttgtatactgtgcccacatacgcatactcatacgacacataattcatgtgaattggcacttcacagtagtcgcaagaatgagctctagggaagcagcaaaagaatggaaaaaaaggaaatgttaaattccattaactctgggcagaaggaaatgcatatacgatatttgaagagcttagtaatttaaccaagagcagatcactcatggatctatctactgctctacgtatgagcacgtgccatatatgaaataaataattaattctaaccctacagcaaaattttaacacttaactgttttcgatagagtgagttgttttgcttacagtgaatacaatcatatgtgtgtctatgcaaaggagacaaaagtaagttaaagattagaggggaaggaatatccacataccatctacgaggagcatgtcacccacttctacatcattaacaaagtcatcatagttaacgctaacacatgtctcagtcccaactcctctcttaattgtgaaagtgaactcctggccagtttccaacattattggttgaggcaaatctccactcctaacttctggtccctgatatgtaaaacaccattatgatccgagaaaccctctatagcataagaaaatgaaaagggcagagtcagccgccagcaagtttttttcctggtacttggtaagtattgaaaggtataggtacctcatagtgttaagcaggaggtatatagctctcagtagatgtattatacctcctgattaacactagaaatgcctctacctcacaatacctccagaggaggcgtagaccgcaaaaaaacactctagcatgagcacatcatactctgtgtaagactaacacaaatatagcaggttcttaggatgattactgtgaaccgcccatacattagagtacaaaaactcaaagaaataatactgaccttcgtgtcaagcataatagcaatcacgttatcctttgtttgagcattatattcctttactaagtcaataactttctggtgtgatgcatggtctccatgtgacatattaagccgagccacattcatgccagcctcagcaagtttccatatcatctcctttgtgttagttgaaggaccaatggtgcacacgatctttgtcttgcgtctcacatttggtttagaccacacaccattggctgatgttgcaagttgctgaatggccttgagatgctggaagttttcttcttcctgtaaaagagatattattgccaaaaagtttaacaaactttcaagtcataagagtatgttttaaaagattacagcattacattctacgttactgaaactttcaatgcacagtaactaactacggtgacaatctgtgcataatactccctccgtcccattttacaaggcgtaactttttttcgacggagtcccaaattacagggcgtatcatgtattaagtagctttcttccccatgatgcccttctgctttgcatgcatctaacgcttggatatccgcatgcaactaacccgacaattaatcggcttgtcaagccataccctttgcgggagagggcagacgtatcgggcagggacatttggatctaatctacatgcatgcgtgagttatgggaagaggagcgatgggagtgatctgcatgctagattaattagtgtttaattaggggcacatgcagaagaaatcgtgacctattttcacgtcttggtctttgcaaaaaaaaaggtgcgccataaaaaatgggacggagggagtattcacctcaaaccaaaccagaacaaaaggaattgagtcttcttgatggttgggagttttcatagcttaatgtggcttgagaaatgacaacgttcttgaatggttttaaccaaactaatcacagaagtagcacattcttgttcgaagtagcctacccatgacgagatagtttcattatgctcaagtagtttaatatttcacagtggcgggaaataagattagcacatttcagactctgcagagaaatatttccaaaagcacctttttagaagactgttacaagataaggaattgcaagtatgaagtttttccttccttacaagataaggtccctaactaactcagaattgtgccaatgtcattttccaaaatagtacatcaacccagatccacacaaccagaaactaaaaaaccaaatgaatcatgagctgaaagagaagaggggaatggccacttttactaaggaaaaaaatattttccaatgatctattcaataaaactactgattaacaggttagctaccagcctacgagctcctaaggatgcatgaaacgtatcaaaaccgaaagtacacgagaacgtattcatggagaaaagtgaagaaaatgacatttacagcaactccgccctctaaatttcaccgccacaggcacgaaaacgatacccccaaatgtgacaaactcggtttcaccgtcacagggtgccaatttcacgcccttttcatcccgaaagcaaccggacacctcaaacactccatcccatcccaaatccacccggggggataaacccagctagcgacctgcgagataccagtcaaaagagtacgaggagagagagatagagagaaccttcacgtccgcgtcgtcgtcggccgacaccggcagcacctcggcgtcgagacgcggggcgcggctaatcacggacgtgacggcggactcgcggcgcgcccttgctgcccccgcgctcccaccgcaccagcgcggcgcgaacgacagcctcgccgccgggcggagcgcgtcggccccagatccgccgccacccagcggcctccccaccgccgccaccgccgccgccgtccctgccgcagccaccacctgcgccatcccgatgcggaggagatttgggaatggagagcgagagagagagggacagaggaagaggaggaggttggcgaggaagagaagagaataggaggtgaggtgcgcgtgcgacgtgacccgcgtgcagcgggaggaggagatggatgggtttgggtttaaggagaggaagaaagcttgggccgctgctgatgcggagcggcggcttcgtttgtatcgaagggggccccctctgccgagctggccttgcagagcccgcgtcgtgacgctctccgctctcgcctcgcgccccgcggcctcggagaatccgtcgttgagtgggacgcgaatatgcggctggggttaggcctccacgtttgttggggggatccgtgaatccgtgatacgggtggcaaatgacacgatgaaacccctgtaaaatactccctccgtctaaaaaaagaaaaactctgatttccatatctaacatttgaccgtctgtcttatttaaaaaaattatgaaaaaaattaaaaaggcaagtcacacataaaatattaatcatgttttatcatctaacaacaataaaaatacgaattataaaaaaatttcatataagacggacagttaaagttagacacggaaacccaggatttgcctttttttttaacggagggagtatgtgttttgagccttgtcaatgagatatgcgagtgaaatatttaactgctaatgattatacttcctctatctcataatatagcaatctagtacccgatgagacttttcatagtacaacgaatctgaatagaagagtgtatagattcattgtaatatgaaatatctcatccggtactacattgctatattatgagacggaggaagtaactactagtaattctactgccgaatgggggcgtgaatctcctgtattctgtgatggtgacggcaccagtagatggacttttgttacgcttcaaaactcaaaagtccggggtaggaaaaccatgcggtggacttgggattggatagcccggcgcaggcagacggtcgtgccaaacgcaagaacatgtggaacgacctctccctccgtcttttaacatgtgtgtttacagggcgtggagttgagataaaatccaaccaccggttgtcgctgttagtaatcctgcgacagtacattcgtggaatatggtggtatatactctctccgtcctaaaataaatgtagttttgcactattcacgttcaacgtttaaccattcgtcttatttgaaaattttttatgattaatgtttttattgctattagatgataaaatatgaatagtactttatgtgttattaaatattttcattttttcataaatttttcaaataagacaaggtacacttattttgggacagaggtagtcctactatgtactccgtatacggtagtactccgtagtacggtaccgtgcaccggtgcgcgtgattctggtcggcgatggaattatacgagattacgtggtgttctgcacgccacgcgccgagcagtggacggggagtcggggacagcttgggcagttgggcgccgcgctagctgatagtggattcgtgggagcggccgcaggcgcgggcgcgcggctgaaccgctgaagcgacccagcagtggccagcaccagcagatgatcgcgtcgacgggatggccaatttattttggctaatggctactggttcgatagcgtgggacgagtcgacggtctgagcgcgcaggtgcagacacaggcctcctgtttagttctcataaagttttttctagaaacatcacattaaatctttgaacacatacatgaaacattaaatatagattttttataaaactaattataaaattagggaggaaatcgcaagacgaatcttttgagtctaattaatctatgattagcataagtactatagtaactcacgtatactaatgatagattaattaggctcaaaagatttgtctcgcggtttataggcgagttatgaaattagtttttttattcatatctaaaaacttcttccgacatctggtcaaaaacatccgatgtgacacccagaaattttcttttcgtgaactaaacaagcccacagtcgtaatgagtgtcgcgtgtgcaccaaggccgagtttagtcccaaactttttcggagcggtcgaccgatctaagttgaaaaaaaatcggacgctgctattctacatgtgctctatttttcttgcagcatagtatgtgtctctatatgtactctttcattgctatttaaaggataaagttttattagcaagttttgaatacttttttcttttaaattactcatctgttattgaatctaattacaccatcgtactcattgcaattaaatcttcataataagatctcacatgattatattttgatcaaaataatatatatgtttcaaccattcaaatttgatgtttcacgtgtgaaaagaaattgtttcagttggaatccaaatatgttgcacgttttaagttttcatgctataatcaatttttatttaatgtttgtacgtggcgttatgtggatgtgacttattctgatgtttcgttgattcatttgtaaatgttgcacattgtattatttggatgtttcagtagatattatgtgatgtttcaatcgttgcaccccgatgtttcatgtagtatataaaaatgtttcagtaaatattatgtaatatttcaatcgttacaccccgatgcttcatgtattatataaaaaattatataaatgtttcagtagtattatgtcatgtttcaatcattacacctcgatgtttcatatagtatataaaaatgtttcaataaaaaatattatcaattttctcatgatatggtcatgccgaatcttattataaaggtttaattaaaataaatacaatggtataatcacatcataaattggatcaatagtttagaagaaaaatcatttagaaaattgattagaaaaagtagtatagatgtgaggtacaccaacccatgagagagaagaaagaagagaaaagtacaaggagtacatgcatgcagagattcccacatcacatagagaagatcagaatatggtgcgacaaatatacgggcgtccaatttttttcagtttaatcggacgtccgatagtaaagccaaagacccccaagacaaggtacaattgttgggaagggccgtagttatctccaactttttcttcgaacttctaacttttccatcacatcaaaacttttctacacacacaaacttttaacttttctgtcacatcattttaatttcaaccaaacttctatttttatcgtgaactaaacacatcctaagctaacaatagttatggctttgtttagatccacccctttagatgtaggggtaaaattttttaccgtgtcacatcggatatatggacacacatttgaagtataaaacgtaggctaataacaaaacaaattaaagaatctgtcagtaaaccgcgagaataatttattaagcctaattaatttatcattagcaaatatttgctgtagaaccatattgttaaatcatggagcaattaggcttaaaagattcgtcttgtaaattagttgcaatctacgtaattagttattttttagtatatagttaatacttgatgcaggtgttcaaacattgacatggtgaaaaattttagggtgagatttaaacaggacctatagtacaaagctttaacacctctcctttcacatgttcaggtagctagcgatgatagtcctacgttataacgggcagcatgttgatactgaaacccgtacgctccgttatacaataaatcgtgtccaccagataccgcatgacaagattttttttaccacctcacctgaaaagatatattcactctgttttttaatatataacatcgttaactttttaagatacgtttgattattatcttttttttaattattactctctccgtcccaaaatgtaagtattttttaattattttgcgtgtctaaattcatagctaaaaattgtaacactctgcttttcgtgagacgttaaaaactaattcggcaaaaatcctaattgcgaaaatttttgttctttgtgtgcgagtctaagttgtgccaaggatcccaatttaatcccgttgttccctctcatcgaaatcaaaatcctccacctcgaaaattcctcttccgattcgagtctctgaaatcaaattccgaaagtcaatcccttcccttgaatcctcgccaaatacatttccgaatcccaaaaatatccaaactcccgttttgtttccttcttagactccttgaacccttgtgtacaaagtatcaaatttagattcaaaacccaaactccaaatctctccaaatcaaaatcattcagaaaaagtctattttacctccctctggctcggtgggccgactcttcttccccggcccatctcctctcagcccgcttctccacctccccgcacgtgcgctgcatgtgccgagagagagaggcatcgcctctcttcttcctctctctttcctcgctctctctctctgcttcctttctccctctcctcggcgccgatttccccgccgccgccgttcgaaatccggccgcacccccgcgtcgcgcgcgctcgctcgcgaggaggtcgaccggccggtcgctgccgctgtcagccctgccgcgcctgcgccgcgcagccgcccggccccgctgccctgccgcgctgcaccacacagctgcacggccccgcgcgcgtgcctgagccgctccacgcgcgtcctgctaaaacccggaggccgagctctccctctccctcctactcccttcctgaatcggcttggagcgagcctctctttttcccccttctttttccctttccccgaccaccatcggcgtcaccgcctgccaccgcctggaccacgggcgcgaccgccagctcgccgcccccaccttgacccagcgccagctcgccccgcgccagccggcgctgctcctcccgctcccgcggttcaatttccgccgcacgatccaccgccttcgccgcccaatgcatccacgccgtcgccgctttcgcatcgcccacgaaaccaccgctgccgccagccgagcgcttgaccgccaaggtcggttctcccctcccaaaccgacatcacctcaccccgcgcctataaaacccgaagccgagctccccttcccatctcaatccctcccgcttcacactcctactccaccgcaccattgtcgcccttcctctgctctcgccgtcgccgtccgccgccgagcaccgggaagaccggtgcgtgcgaggacgcgtgacgcgggactccgggcacccatcttcctccccttccccggcccgaggccggagagctcgctcccgcactgtcggccgctcgtcacagcgcccgtctcggctcggtagtgcctccctccgttctcccttcccgcttgccccctccttcctttagctcgcgcggtagctcggtagtcctcccgaacgcgcgtggacaaagcccctagcctcgccaccacccgccataggcttgccaccgtcgccgctcgctcccggaggctgccgctcgtcgccagatctccacgacgtcgctctgccccatccaacgccggagatgaactccttgaaccccggagatactcccaccgccttgaattgatccctcgtcgaccgccgccgttttccccctttgctcgccagcggcgcgcgtcgccgcaatccgccgcctccggcctctttccggcgaatccgagccgtcggctcgcttcctctcgtccattccctcccccggtgcgctttctttttccattgaggtagcgccttgctccggtgaactcggccgccgtccgccgtccattcggccgcgcccccttcttcctcctcccaccggcccgcgtggctgccacgtaggcgccacgtcggcgccacctcggctttgaccgagccgagccggtcagccgcctccttccttccccccctcgcgcgcacggtccacggtgcaccaactggctgcgcgtgggcccgccacatccttggtccatccggtgctcgcgcgtgaaccgcgctcacccgaaacccttgcgccgcacctcgcgtgcgcccatccctccgtgaaccatgtcgcagacatgcgcgccccacccgggacctcgcatggtgggttcggtccacccggaccgccccctctcccttccgcgcgcccctaatgggccgcctccttgcgcccgcgccggcccaatggctcggccgagcctccttcaacccattgggccgcgcctcacgctcggcctaaaagtccatatttcctccctccgtccaagtcagtgtccatctctcatgagctacaagtccaaatttgctccctctcaattttattctctctcaccttcttgttgaccccactagtcaatgagtcaaagatattcttgagaatgtcttttccaatattccacaaatatttctcttttctataaattcaataaatcatttccccctctttcagaaatcaattccttattccaaaatttcatgaatcattttccttggtcagtgactgtcaataatattcttgagaatattatttccataaattccgacaaaacatttccttgtccagaaaatccacttagacctccaaattcatatccctcgatccgtagctccgatcgcctccgttccacttccagtaattccgtaaaattgagatctatttaatggcactattaattagtctaaataggatccttctttggtcttttgtttaggttttcgattgtttgcgtatggttgcggttgcggattttcgtcgatcgcgggttttctcgaagattcgtgaagcttcgtgaaggccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccatccttgtggtacctcggtattcgtgctctctgagcgcatataccaaatatcccacatacaccgttgtttgtcgaaaacttgggaaatgggtttgtgaagccttcaaaacccgatatgtggtgtcggtgtgtttaaaaataaaattaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaatgcaagaacgagaagcttgctgaattaccgatcgaggtggttggagtttgaattgtgaacacctataatggcctatgtttatgtgaggattgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtaaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaaatgagctgttgaaaaacatctcttaaagtcgaaacgagacgcaagtctcttttcggcccaaacttagaaagaaataaaccacttagtgttttcaaaatatcttcaaataaaagatttgcaaaacaaccttgtctctcttccaagcttgcattaaacacctcagttcccgtgacttgctgagtacgagagtactcacccttgctctatataaatatatatatatagttcctccgctctgaagagaagataaagtgaagtgaagattagggtttcgtcctggttcccagccgtcgcctgtggtgttgggtgttagttcgttggttccgctgctgctgttgttgttggtgtttcctcgtccgtgtcgtcggttgcattctcgggttgttctgagctgcaacctaagttaaggtaaataagtcctctatctattttaaggatttgcaatgattcatatttgtcaccgtgggtaccagcactatgtcctgggactggtaccgagatcgcggtttcgtaggaagcggttcgcgccatttttcctacgacacgctcctatcaggtgccgttgtgcggcggtgccggattggggtgtgacaaaaatgcttacattttgggacggaggtagtatttattttattatgacttgattttactaaatgttctttaagcctgacttaaatatttttatatctacacaaatttttttattaaaattaatagtcaaatgtttgttaaaaactcaacggcgccatatacccaaaagaacagtatatgtttaaccgtccctttgacttctatgttcaacatgttccgtcacatattcatacttgagttcttttggccattgtatttacagtcttagcacgtttttaggcactcaaatcgtggacgggctcgtagctttctttttggctatgttttgtggggacacccaatttaggcctggtgccccaaatatccactcgtgatcgtctaggatttcgatcacgcacagattgatatacaaaacagctttcaattaattatacaaatttgtttatacaacctaattatacaattgttaaaggttgaagagatccacactaatacatccttacttgaaaatacaaggaaaatccaaactcctaaactactaaactacaactaatgaactccacaagcaaaagctagactatcctagaaaaacttgttgttgctgtagacctcgctatcttctggtcttcttattagcacaattctctatatgttaaattatgcaagagtgggtacttatgtactcagcaagacatattataaataattaaaggtgaagagatatgaataaatgaaacaatgagtaaataaaggagtaataaaatcatatatcattcttatcctcaaaatttattttttaaaactacttatacttcaggagtaggaatcacccttatgacatatctccttaatcgggagcatggtgtattcgaatacggtacgactatgtagtgtttgcctagctttacccacacgatgagaacaatttgcaaaggctgtaaacaccatagccgttcgagagtcccacttactactagttactgcacagtggggtcttggttcatcatagtggttgaactcttgccaggcctaggcaaggttactatatcgtcacactttcatgaagcccactgttgtgaatcatgccgcccaaacaccttacgcatgattcaccccaaaaaactgctcctaatgagctacccaacagtctttcatatagtgggacaatactaggctaagtccaattacttggtcgtgtggatgggcgcaaactatgtcatttcccatggtataagggggtaattataatccagttaaaccaccaaaaattatgtcaacatccaaaacttccataccaacaaacttcatcataaattccaacattcacaactttcaacaatcacaacctcaactcaaatgcccattttaaccagattcctaagtttgtaaagatatttgaataataaaccacataaaatgataaccatgtatctttctataacctcatgtaataatgcttgaaggcatttaacatctaccgatgagatgctaaatgagtaatatatcatgcataaaattaaactgaagattatattgagttttctatatgatcaaaattttagttatgtcttgcctcacgcctcgagattcttgtggttttagcgtagccatctgggtccacataagctccttggatgtcgatagaatttgctgtacggtcgaacgtactaatacaaaaagatagcaaataaaccctataaaaaaatgctacaaagaaatgataaaccaaggaataaataaaattggagcaaagcgagggaaaaaggaatggttcaaaatagatttaaatttggaaaacaaaagagaggttttggtttctaaaggttgggaattaaataaaatcgaagaaaggataatttggataggtggggtttatttggtggatttggtttctagtcggtgctatagttgggcagcacgacggctagaaatttgggtttggttagccgatgctgaggttgggtagcataacgccttaaatggcttgtctagtcgatgctacagtcaagcagcacaacgactagtgagttaggagatttgtgtggagcggaacagtgttactctatagtcgtgagtgacaatagagcggctaggattgcacatagcccaaggacttagtgtgcagcgtgttatggaggtcgagagagtagtaaggctccgaccgctatatgcgttgaggcgtggggtgcaaagacaaacacttcaaccttgggattaggttatgccgggttttacgaccaacggtttgatgtaggagtttgagaccacgcgaacgtctccacagaaggcgtaaagtgtccacagtagctgtttagtggcaatgagatagtataggaatggtttagaaataaaaagggtatttaaataaatcaaaggaatttgaattcaaaaaggggtttcaaatagattaaagaaataaaatttaaaatggtattttaaaataaagaaatggggttttaaagaaattaaaggataatttaattttaaaaaggtttttaaataaaacaagaaatttaaaattaaagggatataaagtatatcaaataaatttaaaataatttttaaaggttaattaaaataatttaaaatcagaaagtaaataaataaataaggaaaagctatttaaataaagaaatttaaataaaattttaaaaataggaaatttagtatcaaaataaagggtttgaaactagatgaacttaggtcaaaaaaattctggaattggatcaacggttggagagatatggatgtctaaagtttggaatttgaaataaatcaaataaagaaaaggattactatttagaagtggggcccactcgtcatagccttcttttatctcttcttcttccttgagccacagagaaagaggggggaggcagagaaggggcggtgcgcacggtccggtggctcggcgcttccggcggcggctggggacggcgcatgggctaggacaacggccgacggtggaggagcgaagggaacacgacagccggcggtggtggatttgaggaagagagagagagagagagagagagagagagagagagagaatttgagttttggatggggaaaatgggaggggttcgccggtttatatgggaggcaaaggcggtggagggagagttggtcgacgacggcacggcggcgtcagctcggaatagtgatgtgacggcaccgagtgtcagctttcgattggctgtcgatgacgggttggtggttggcggcggctagtggcgacacgcaaccgaggggaatggctcggcgtcgggcggcagtggcaaaaacaacggcgatggcggcttagcagcggtggtggcggagtagcggcggcggccgcggattggcgatagcggcggcaacctagggggtgccgggggcccctggtatgcggtggtggcagaacggtgccggcgtggcaatagcggatggcggggacggtgcgacagggcggcggcagcggcgcatgattggctggtggcggcggcgcccatggtgatgcggtgtcggtggcggcgtgcccacagggagagaaggcaagaggcgggcagctcggctgggctggtagcccaagaggaagaaagaaaattgagtaagggggaaaagaatgagccaaatgaattgggagtttggcccaaattaataggaaacaatgagaatttttgtggacttttggataagatttggaggaattgaaaattaaggaaagttgttgactctttgaaattttagaaaaggaactaaaaaaagatttctaggaataaaaataaggaaaatttatatggagggttttaaataaattttaaatgagataaaaactaaagaggaaagcttgagggtcttttgaactttataaaaagaatttaaaataaagtttttaaagtaaaaggagtttgaaatattttaaaataaaatcaaagatatttatttttgagatataaattgtgaaaaggattaaaatgctccaattttataaaattcaaaaagagccaaatgtaagagttgtcacaaaagattttctctaatattttaaattttaaaaattgaaaagggtttaaaaggaagggaaagaaatacgaatgatttatctactaactttggataaattttgggaaggtggcaaaaataaatggagggaaataaataggatattagccaattaatatgtggtatggatttttaatggttcatttgtgggctaaaggaagttggaaataagtttcctagcacaaaagcaatcactcaaatatttgtgataatattattcttgtgctacaaatgggatcaagccatagaaatcaaatgggtggttcaatcaaaataggaacttggccacgaaatattttgaatcgatggagaggaagtaaaggtttactggattaggtttagacagtggtttgatccaaaataaattccaacaaaaatggaattatagtggtttagcctcaaggataaaaatggatcatttgggtggagaggatttcaaaggagagagtatttactggagggtaaaactgcattttggaaataaatgtaggtagggaaatataagaatttctataggaacagaattggtggtagaatggtaagctctaaaggaagagtgttgcctctagggagatggtatttcatgtattttggagatgtttggaaaaggatccaaaggaaatttgttctggagcaacgcttagaggctagaaaaataaatgaaggggttttgtaaaagtcggaagaaataaaaaaggagggttttataaaatttgaaataaataaaatagagaataaatgacttttataaattcaaaagaaataaaacaggggataaataaagggttttataaaagtcgaaagaaataagatggagggtttttttataaaatagagaataaaagaaggattttataaaatttaaaagagagcttttaactttgcaaataaaatttagatccaagataaaaagaaaagattaaaagcaagatcgctctaatggaaagatcgagaagaacacaactaaaacttttcgtaaaaatttttccctaaaaatttgagtatttacagttaccaagtgttagggttacggataaggcatacattctatcctacgacttatggaatataccgataaggtataccttcacgtacacggatcgtttccatgtacatcgttaggaatttgttccaaattatggaaaatatctctacgagtgaagcgatttccaaagtcctactcggaagggatagaatttttgttataccgtactagatcaactatcctcatatctttattgggggtcaagatgatccacggtataaaagggactcctagggaggggtgcaaggcatcgaatttcatcgccaacacacccaccatagtttacgaagccggagtatgcggagccaagttgccgggaggtctcgtcgaactcatcgactacgatttcgccggtatcatctgtttcgtctactctctttgtaatctgttctcgtcatcatcaatctcatataaactggactaggactattacctgacaagagacctgaaccagtataatccttgtcttttgtctgcttgatgtcgtactacgtagaccctcgttccaacataccccgatactcaactcatccggtccacgagtatcactcgttgacaccaagcttggaccaactgaagagacttttctgaagcactaggtcataaataatggtgggtactcaacatgacaagtaggacaaggccacaccaaaaaatctcttctatgtagctttaagtggcatctttaactttttgtgcagtctctaatatgttctattttaatcctcgtgttttctaaatttagatcaaagttcaaaattttacactaaacactctaaaatccaaaactaatataaaatcccttcattatttgatagtctatcccctttcccctccttactttccatactctaccccaacctctgctctccccccgactgtggcgacggctctccagcgttctcctaacggtgacattcgactcctctttgtgcgtctgctacaacttatcctggctttggctgcttcaatgggacacacaggactctgtcagtgacctcatgtgtccatcgtcgttgctccttcgcggaaaagcaaaggcgggcacaactgctcctccagatccacctcgcttagttcctttgaattctatgttcaatgtgttccgtcgcatattcatactagttctttaggccattgtatttacagtcttagcacggttttagtcactcaaatcgtggacgggctcgtagctttcttttcggctatgtttccagcatggcccatttacaattaccaagcttggaccagctgaagagacttttcggaagcattaggtcataaataatggtgggtgcacaacatgcagagttgcagactaggacaaggccacatcaaaaaaatctcttccaggtagctttaagttgtgtctttaactttttgtgcagtctctaatattttctattttaatcctcgtgttttctaaatttagatcaggttatgaattaacaaataagacaggaaagagtaaatattcgccgaaacatcaagaaattgtgcatatagaaaactctaaagaaagaaagttcaaaattttacactaaacaccctaaaatccaaaaactaatataaaatcccttcattatttgattgtctctcccctttcccctccttactttccatactctaccccaacctctgctctccccccgactgtggcgacggctctccagcgttctcctaacggtgacatttgactcctctttgtgcgtctgctacaacttatcctggttttggctgcttcaatgggacacacgggactctgtcagtgacctcatgtgtccatcgtcgttgctccttcgcggaagagcaaagacgggcacaactgctcctccagatccacctcgcttagcacagatcaggggacgatgaccaacggagcttcgggcagcatggattagagcatgttgggcccgtagaactttgggcggcacagattagggcccctaggccgatgaagattccaaccaagacggcgagtggtgtcgagggctggtgggcttcatggttgcacgtggtggtggggcttctaggcagcatggatcggggcgttgggggtcggcgaagcttccccggtgaggcaacgaccatcccagtgacactctagtctggtacgtcgctccgaagttttcaatggtcgtatttgtgcatgctttgggggtgtggggggggggggttggacctcgtgcagatactttttttctagcgtgaggaaaccttgtcttgcataatacacgcaattcacaagcttgtagaggccaccccttttcttccatctctcctccaccctggcttgaatctaacgtggattctttgaccacatgttagagtggagcattcatatctctcctccaccttggctcgaatatgacgttgattttttgaccacacgttagagtggatcatttatatctctcctccgcatttgctcgaatctaacgtggattctttgaccgcaccttagaccggagcattcatggccaagtggtccaaacatcaaaaggtgaaagatcacacggccctttgtggaatgtactacagtacaaactagctagctcactttagtagtagcacactagcacccatgtctctcaacccgcactccctatcaaactcaactcgattagttaaatttgagattagggacagcagaaggtgaattgatgagtaccgagcgtcaaaaaaacatagacactgcaattcaatgcaacccgattatagaagtgaagaagaggggggacattgcgaattttctttgtggtaaatagacagtgcacggcctatataatatcagatgataaatttgtatatgcccacaagctaaaagaaggagagacacttgaaccacgtagtgtgctcaccacgtagtcaccactgtacccgacgggagttctcacacaatattggtatatatacatacctggattgagaatttgagatttattccaaatcaatatgttatactcgtgtgctcaaaactgcgttgatgaaaaaggaagcaacacggatacatctccgaatagagaagagtcgagggttggctaaaaaggaaattgatctattgataaacatcactaaaaataatctaagataggttggtagcaaattgatatgacactcaggaagattataggattgatattacattacagggcacacgtgaaaggtgtcgacagaccaagaatggataagttatagttgatttatctctagaatttgggactctattttacttttagaattccatctctaaatcgtacttatctctataatttatattcgaactaaacattgcaccggtggcaagttcgccctgcgtgtatgtacctacaacggagcggccagtataggttcaccagagagcagccgccggccaatctcataggacacgtatgcgtcgatgcaggcgtagttgacctgctcccacgtcagcgtcggctcaccccatctgctcttcgtaatgtttttctccttctccatgtgggcgcccatcaccgtgagcgccagtctcttcagccccgccctcgcaagctccggctgaccgagcacggccgccgcagcatatctcagatccaccgcacaggcgaccctcaggttgcaatcattggccagacgttgcatgtcgttgttgactgcaacgccgacgaagcgaacgctcgggtcggcgaggaactccgcgagctcatgtgggaccatgttgccggcttggtagatctggaacaagaggcatcggcggccgacacagagctggagcaccgcgaccttgtaacatgttttgccgttgggcagatggtcagtgcgccactccgtgtcgatgccgacgatgagccccccctggggacgttcgcgggctatctcgttgataaattgggcagcgagggagtgcgacgacgtgatggtggtgtggatcggtatggtgtcgccatccatgaagacgtcgagcgtgttctcgggtggaggaggaggatgagtttggggagtgtaatatctgcctgccattggtgtaggggacaattttggacttgacaaatttggaatttgcggtgagaaaagaaggcctctgctgtgtccttttaaagcgggcataccggtagaaaccgaaccggacaagcatgctacttggaatcgtaatcggacttcggaattcgcggggacaaccgagtcgttgacttcggaattcgcggcaagttgcgagcccactccgcctgggatctccactcctcccacacgcccgcatcgccgccgcctctcccctcccgtcctcaccgccgccgccgcctcaccagcgccacctccacctccacctacgtctcctcttgctcctcccctccccgtcacttcagccgctgctgccgcctccgcctccgcctcttcatccccaactccactgccccctcccatctttgctcggtccagcgaatgcggggatctaatttgggggccatggctcgatccgacgacgaatttggaggccatggatcgccgccgcctggtcttctgcatctccacctgagcttcccccaaaatctcctttgattggagaagttaacatcgaaagctatggtgcgtatgatcttttaggttctagctcctgatagtggatctgtcaattgatttagttcagataagaaacaaggtatccatctaatatgcagttcacgcttgcactgaaataatgaattgatgattactagattttgaaaaatggcaaagacgtcaagactgtcagtccttattgaggtgtttaggttggcaaaaaaaaaagatggagcaaatggtagtgaccaacctctgcaaaagtgttcctgaggataaggtgagaatttcttttaaagtttcaaccttgccactttggattctttactggatgacctgaatcatgagagaaaatcaacgctcaagatacctgtactgattactaagcttattgtcaacactagggagctaggtacctgaagagagagaccatatatgttgcacacttgcacataccaatatgagcccaactacaagtttggcctactggtttgggaaaattaaatcacattttagaaataacaatcgttaattcttggtacgatattgtgtacatctctcttgatggtactatcattgatatactagttaaataagtcgggcattcgcacgactataacctctttctctgctagatgctttcacttatcatatacagaaaatgatgatcaaccttttacttttggttcccaaagtacgacaataaaaacacggccccttgtatatgattattcaagcacctctgttggtgaaaaaaatcacgtttacaatccaaccaggcaaggaccaaagcattgactccgagtatgggatcattcataaatccttgaaaaaaatttaagcttaattggaacagaacttgggattttttttctttgcaaatgcttttatttaccaagacgtaagagaaaaaatattgattggggcggaagtaaaaaaaagggcaggaacacagacatgagaaagaatactgataggggctgaagtaccaaatgcttttattgcaaatttggatgtcttgatactctgaatatgtgctgtcacagccgcatatcggaactgtgtgcgcctaaacagaattagtttattgcattacgaaatatcaacaacataagtcgaagattcataaggagcacttcctttcctagtggccttataatcttaacttgtgcttcttaatatgctttgcattcatcaaccatcaacaaaatgggaatcttctttctgatgatctaatcgatgaaccgacatttgttcaggatcaaagaaacttgctaggccaaaatcggctattttcaatatgcctcggttgtcactcaaaagattggaagcattaatattgcggtgaataatgtgatgactatggcaatgatcaatgccacaaagtagctgtggcatgtaacatttcacctaaaaatcagtatgattattgcctgcatgttcgaaccatattttaagtaaataatgatttcttttaggacttctatagattacagtatattcgatatggattttttttatggtgctccaagtttacttgatctttctttaaaaccaataaggcaataagatttcaataactggagatctaccatggcttattacaactgaagtgcaactgcaacttgacttcagttgtagaccttttgggttgtctaccagttacagtagcactacttgtcaaagagttaacttagtataagcattaagtggtagcgtggagcagtataagtgcaactacgaatatatgatgtttaagactaagttaatactttctcaggccatcaataattaaattggtagctcttttggcactctgcgaaaacaaattaatgttactcactttctctggtactttgacccaatatcacgaagacataaattttctactatattctgatatgttattgtttcagttttataaatctgtctgcattccacccaatctcgtcctataatgctccacacaatcatggtgatttcagtttgtttttatgttttgtagttgaaagcaattcgaaagtaaatttcaagctttggtcagccagctgagattatttatataatatttcctaaaaaaaagggtaaatgatgagaatgtttcagcaccctgaaaagttgaagaacaacatgctaagcagtagttatgtcagtaagaaaatagaaactcgtggtgttgatttgcactatcatattcagcaatgtatttatatgtattatagggttccttgaaacttttcatctaccggtcacgatctataaaatgtagagaatgaaggcccaagtattaagaagtaaatacctcagcttaatttcactccagaaaaagaatttagtctagctagagaaggtagtgcaggattgatggatctgggtagatggatgtggtggctccggtgatgggcattggaagtgaggagatggcagtagggatgcggatgaggaggcgattcactcccatcgtttgggatccgagaggatctcgccactggacattgggaggaggagattctagcggcgcattgcatgggaggaagatggtccagtggtggcgctcggtatggggaggaggacgacccgatggtggcagcaaggtggagggaggtggcggcagatgcggagtccatgaggtgacaggcaggagaggcgcttggcttggcttggggtccctgcctcccacggacatggaaggattctttttacaaagaaggttcttgaagtaccgggaagagatttctctgattaaaggatccgatggctcttgacattctgagcaaaaaattggacggtccatatttcctgcatgacatggcgctgtaattttgcattttgggggttcaactttcatatattaagatatattgctattaggtgcttgaagtcttgaatgcattggcataaactacccaaaaagcctgtgcttcgcatctatgaatggacagtcctatcatttattcgcccaattcttgcagatgcacaaggcctccacttttcagttatatttgtttcttctgtctcaatgggacaaatttaccattttaacagttcttatcggttctctgtgcatgtcatatatgataactatgtatagtctatatataatttcttaagaacatatggcctagctgcaagattggatttaacagtacatgtttatccatttatgtaataatgtaattatgcctcaaaagctggaaaaccttaatctgttgtgagtatggactaaaatgtgatcaacatgttctataatggagtgtttaaagcctcttatgtatttttcagtttttgagtgtgcattttttttttcaatttaagagcacatagaaaagaatacatcctaccaaaatgtaaaaatttaagcattaaatatcccagttgtacagcaacaaaaatatgttgatggttcaggttcattaataataaatagttacatgcaaaattgaattgcgtgtcattttatactcattttcagaaagatataaaaaaatatgtatgataacaaatgggttccaaactagcaacaaaatatgcatatatgccaaccatgtgaataattatgtacatatcatgattaacagatgaaatgatcagtgctagcttactagctttctattgctgcagtaccagatagaagacgtaccattccttactctaaactgaaacactgctacttcattttttttttgcaattagccggtttacattagcatcgcatcagtcatgtttggtttcgataaaattaacttgatctttggcgaactattttggtggtttgctttcttttctaaatttaatatcgttgtagaactgagaactctggtgaaaaacacttctgatgtatgtcacattgccattcagcgtaaagtccgatctggtattatctgaatacggtggtaaaaaaagtacttccaaatatatggatccatgaatatatattatctaatattgtttcctctgtgtgcatctcctgtttgaaatttatgtatgttgttttcatgtaaaagtctaaggctttcagttcaaataaataatttcttatggtttgctattaaatgcttcattcttgcaagcttgttactgagttacattgatatataatttgggttaaaatgctttaggctcatatattttttaatttgcaatacctctctaccctctaaatagataactgaaaatagatgtcttagcagtgtcttttcaattatcagaagttttgctaattttcagaagttcagcagaccattattttactcttattctaaattgtagcgagcgaagtctatagaaaagctgatcttggacttgtccaagctcaaggttggctgaaggtgtaatctgaaactaatttaggtcaccaccagaaacacaacatatacataacccatgcatagggtgtacctctaagcattcatgagttttggagtggagggttttactgatttcatggtctaactaagaggtgatcaggttgtcttcattaactttgattactatttgaaagatccaatcgacacaaaaaaataaacctttaatgtgccaagtatgattgcaattgtaatatctgtacacatttaaaaagataccaatcatttagcctgtattgcctgagtgtttcatgaatgtatgaagtcgacataatatttaatatttacttagaagttccatttgtaatatggatggttctcggagctgtacagtgaaactagatggcatattgctctaggttgtctacataaagatgatcatgatgcctaaatatttactaaccttttgagtgtagttgttcaaagagctgctactgttttggaggacatacatttaaacaagcatatcaggcgcatggtctgggagaagttagcagcaaaggatactaggtaaaattgttgctgttaaaggcatataaatgtgatgttctgttcttttagcgtgtgaataaattcaggatgcagttggccttcgaccagtgatcaacactacttccgggaaaatttcccctcctagcgttgcattagtagtgttttatgtgagttgctctattggctgttcaagttgctccttattttgcgcaccagcttatgcaaaatattgttttcttaaggtctatcccagattcggccggagaaggggagctggttggcgacaccggacggagtaggagccgacggcagtggtggaggcggcgccccacccctccctctccctccctcctagatctagccgggggaagggagctggctgcggcggcggtggatggaggaggagagccggtggctcgctctctcccctccctccctccagatccggccggaggaggggagccggttggcggcggaggcggcgctccccttcctccctcccacccagattcggtcgaagaaggggagccaaccgacggcagcgacggacggaggaggaagaggagaaccgacgaagttgctttttattttgcgcaccagcttatgcaaaatattgttttcttaagatctattaagtgatagttttgataaatgttctcatatacattaccaactagcggttaagagtggtcaggtctggtggaggttgctggtttcggttgaatttgatggatgctctgatatcgcaagctgggggaggagagcggaaggagaagcgtgctgcatgagaaagataatgggtgttattttttttaatagggggtaggccctacataagttgtaaacaaaagtctaaacacgagagaaattttggacaaattaaacttaaactctatgtatcagaatgaggaaaaataacatttaccttcctcgcattgtatacatactaattcatgctattagtcatgtttagattgtaaagtttgttgtttttacatcattctttgcttgattgtcaaaacatgtattgtcttttaaagtcaaatgtcattgtagcgttagcacgtgcatattactatttaagcctaaagcatcgaagtgtcatcgtggcgagccgatcgaggacgatgccgctgcggggtttattgtgctcactgggtaaattaaagagtaaagtccatcaccggtccctaaacttgttcagttgtgtcaccccggtccctagacaggatggtctaaaaactttatatcaaaaaataattcataaatttttcatgtgaactctaatgaagacaaactttatatcaaaattgtagccttcgacgtgaactctaatgaagacaaactttatatcaaaattgtagccttcgacgcgacctacaactctgtagttgaaaagtttttgaattaaaactgtttagggtcctaaaatattgttgcatgtttatagattttaaaattttaattttaaaattacattttgggacaaaaaatgacttaaaataaaaaaaaattcaactacaaagttgtagatcgcgtcgagtgctacaagtttgatataaagtttgtcttcattagagttcacatgaaaaagttatgaattatttttaaatataaagtctttagaccgtcctatttgacccagatgatattcaaatccaagtttagggatcgtggtgccacaaccgaacaagttggaggacctaaacgagtgatctacaagtttagggaccgggatgacacagtcgaacaagtttgaggacctgaacgatcgatttgcgagtttagggatcgggatgacacaacggtacaagtttagggaccagtgatggactttactctaaattaaacaagttgtgcgcgcgaagctgtgtgagacagagctaactcgcgcaggaattagtacatgcacctgggtaaaaaattgattttttttggcaatgttacgattttattttttcagacggattataaaatcatcatttgtaaaagtagttcatgataccataaagctagtcccgcctatttcgcaggcggggaccttaagtcctccgcctgcaaaaatccgccatccacgcgctacccacttcctatccttcacccactaagtcctcgctcctccacccataaccct

SEQ ID NO: 21224 - DNA, 18670 bp, Oryza sativa
ctctctctcctccctctcaccagattcggccggaggaggggagtcggcgatcggcggaggcggcactccccttcctccctccctcccagattcggtcgaaggaggggagccagccgacggtggcggcggacgaaggaggagagggaggagagccgacgattggagggggagggggcagcgggtgggagtggtagcaagcgattttcttttattcggtaggattgtttttgcaggcgggtgaatgtaatgcctatgaagatttagaggctcacctgcgaatgtgattttagcgggcggggccaatgtccgcatgtaaaaaaaatcgtatatttttgtatgccttaaagtaccggcggcgtggagctccgcctagaaaaatatttttagcccatttgcaaaagcaatttttctactagtgcgatgtgccaaaaacgcctcgtatttttataatagtaggatttgtaagatgacatgttcaccaattaaagcagccatcgatatttttatgggacctaatttgaacgttttgttaaaatggaggatgaacccatttccgaaaaggttattcggcaaacgttcgccactaatacatcaggcaaatagattaggataggggaggatgagagacgtagcgatgcgatattggtgcgtcgcgtcgttgcagtatctttctcccgtttttaatttcccatttttccttttttatgtgattcttttcgattttccgctattttcctttgcgtgattctctagtacattatgtatcagtctttctatttttctcaatccttttcttttccgaatttatttttttcgttatagtatttctctgtagcctttttagtggaaacatttttatatgagttattttcatggaaactttctacatatattcttttttatatataaactttttatatagactttatgctacaaactttacataaatatgttttttatttataaactttatagtatgaattatatttgcagttaaaaaatttagtgtaaaatttttagtacaaatcaaaaacaaatctaatcatcaccagactccgggtttttttaggaaataaaaaaagcattcagcgatttgtttttgtaactagaaaagtctataaagtactgggagatgaacgtatctgactgtgaacgcgagacgcaaacattcgtgggctagacccaccgactcccgtgggcgcggcgcggccgcctctctggcctggtgatcacgacggctttggcttggccgtttcctctttctatctcatgcagccgtagccgttcatgcgctttacctgggttcagtttcggctgctagtggggactgcagtcaccagctggtggtttatgagcagggacgtcagacatgagcgtctgcatcttgcatgcctcttacctttcgctagcatagtagtggcattatgcatgacgtgtgtgtcaaagtatgcgtatacaagtacacgccatgcttcaccttgttctctgtcacttgtgtgtatgtttgctgttaatcctccgtgcaccttgctgtaattgcttgaacatgttctacttggaacattgaatcccattacctggaagtctaaatctaaaagctgaacaaattcttgacaagtataatatctgaagggacaacaaaattgagcatcaatgacacgacgaggatttcattggtgattacaaccagggttgcatttaccgcggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctgattacaacatgtcaagatacatttttcatttttctgaaaccctacagaactgccagcgatttattaatggagtaaatcccaaacgacaggcagtaacacgctggaatacccactgaataatcaggggacgagccagatcggaggcgagcagtctgcagtgaattcacgggggaattggcgagcgccaggcctgatcttctcgcccttcctgtacatgcccatgtcgacgttgcagtacgtgctcccgttgttgagcaccatggacaggtcgaggttcgcgtcgtcgaggaagtagatggtgtcctcctggagcatggggaactgcgccacatcgacggacctggagcagctgcggccgaggaagagcgcgcggccggtcagctcggggatctccacccaccagcacggggtggcggcgcgcctgggctccgccggctcgccgaacgtcagctcgaagatccggaacatgcgggtgcggcgccgcacgacggggttgccggtgtagtggcgcagcaccatgagcagcttcccgcgggactcggcgaggtagcgggtcgcgatgaacgtcggcggcagggcgtcgtcgggctggtagtcgtcgcggggccgcagcgagtagcgggtgcaggcgagcttcagcggcgcgccggggcggtggggcgccgtgggcgcgtacaccaggacctcctccttgttggtgaggacgtggaagccctgcagcagcgctcccctgtggaagatgaggtcctggatgatgtccatgtcgcgccggtacgcggtccagctggtggacagcgacgccggctggcagaaggcgatgttggaggcgctggacacgtgcgcggcggcgatgcagtacggcgaggtgggagggcaggagaagacgacggtgcggatgagcatgtggtggcgggtgaagccggcggccaacgcgaactggtcgtggttgccgccgggggggacctcgaccctcagcttctccgggagggggagcctcacgccggtgaagaggttgacgaccgcgaagcctcgccacgtatcggcggcgaccgcggcccagccaccgtcgtggacgccgcagaagcgcgtgccgcggacgccatcggggaggcgcatgcggcgcgtggcgccagagtggaggctgaagaaggacggcgcgtcgcgggccgggaggaggagccacgggacaccgcgctgcggggcgtcggcgtagggcgccgcgtcacgccacgcgcggcagacggccgagaagcaggcgcggtcggcaaggcagttgagctgcaggacgattatggcgagtagctcgggcgggaggccatccgaccacgcgcggcgagacggacaagccatgagatgagatggaaccggtggaggtgagaaacctcgaggcgtaccttcctatttaaacctcgacgaaacggtggaacccagctggcagagagtgccgttagtctcaagtgcgatgcgctggtgttctgcccaaactctccacgccggagaatccgagagagttgttaccacttaccacaagtgcgtctgggcccacaaatcacacgttcttcgatgtcttcgagggcgtggggcgtgggaaaggagtgatgcgaccgcgctgtggatgtcgtgtcctctagtcgttcctctgcatcggcgactgcacgcatcggccacaccgctctctgattcacgcccgtcggaactcgccgccttgccacctcttgatctgcgcgcaccagagctcgccgtccgtgccgctatccgatccacgctagccgaagctcgccagccacgccacccctcgatacgcaccccgcggagctcgatgacgatatgcaaaactttccaagtttagtcacatactaaactgactggtggaacctagctagcagacgttgatggtagtcacgtttcttgggccggtgggttggttagcttattgacgttgtgtcccatacgtaacggaacaaccgacggtgtgtgccacatttaacggagtaatcgatgatgtgtcttacacataactgagcaactgatagtgtgtcttagcttattgacgttgtgtcccacacataatggaacaatcgacggtgtgtgccacatttaacggaataatcgacggtgtgtcttacacaaaatggagcaactaacagtgtgcccgcgtataacggagcaactgacggtgtgtcccacacacaacggagcaactctcggtacatctcccacacataccggagcaaaaaagaaaagagatagagcattatgacgcaaagacgctcgtagtatcacgccgaaatattttcacgttctaaatagggaaaaggaagagaaaaggtaatacgttatgcatgactttttaagttttagtgagatatcttaggccagttagctaattgacggtgcgccctacgcataccagagtgagagacaagagaaacggtgttacaaggcacaaaggcagtcattgtactacatcgaagtacgctcacattttacaaaaggaaaaaggggaagagaaaaggtaggacgatgtgcagaactttccaagtttagtcacatactgggtcagttggctcattgacggtgtgtcccacgcgagataaagcgttgtaaagcataaagacactcaatgtactacattggaaaccccgaggtgtagcttcctatttaagcctcgactgactggtggaacctagctggcagacggtgatggtagtcacgtttcttgggccggtgggctggttagcttattgacgttgtgtgctacacataatggaacaaccgacggtgtgtgccacatttaacagagtaatcgacgatgtgtcttacacataacggagcaaatagcagtgtgtcttagcttattgacgttgtgtcccacacataatggaacaaacgacgatgtgtgccacatttaacggagtaatcgatgttgtgtcttacacataacggagcaactgacagtgtgtccgcgtataacggagcaactgacggtgtgtcccacacacaacggagcaactcacggtacgtctcccacacatactggagcaaaaagacaagagctagagcgttatgacgcaaaaacgcttgtagtatcatgccgaaatattttcacgttctaaataggaaaaaggagagaaaaggtaatacattatgcatgacaagagctcattgatggtgtgccccacgcatgccagagcaagagataagagataactcattgacggtgcgccctacgcataccagagcaagagacaagagaaacggtgttacaaggcacaatggtagtcatagtactacatcgaagtacgttcatgttttacaaaaggaaaaaggagaagcaggcgcggtcggcaaggcagttgagctgcatgacaattatggcgagtagctcgggtgggaggccatccgaccacgcgcggcgagatggacgagccattagatgagatggaaatggtggaggtgaggaaccccgacgcgtagctgcctatttaaacctccactgaccggtggaacccacctggcagagagtgatgttagtcacgagtgcgatgtgctggcgttctgcccaaacgctccacgccggagaatccgagagagttgttaccacttaccacgagtgtgtctgggcccacaaatctgaagcccgagtggccaaagaaagtcacgcgttcttcgacgggatcgagggtgtggggcatggggaaagagcgtcgcgaccgtgccgtggaggtcgtgtcctctacgccgttcctctgcgtcggcatacgtcctcgctcttcttgttccttcctgcagctggtcagagactcggagctcactgctcactgcacgcatcggccacactgccctccgattcacgcccgtctgaactcgccgccacgccctcgatccgcgcccaccagtgctcgccgtccgtgccgccattcgatccatgccagccgaagctcgccagccgcgccacccctcaatgcgcgccccgcggagctcgccgactgcagctcgtgggccggccggctgcagctcgcgggccgcgcgcccctcgcgggaggccatccgaccacacgcggcaagacggataagccatgagatgagatggaactgatggaggtgagaaacccaaggtatagcttcctatttaagcctcgactgaccggtggaaaccagctggtagactgtgctgttagtcacgtttcttgggctggtggtgccagttagcttattgacgttgtttcccacacataacggaacaaccgacggtgtgtgccacatttaacagagtaattgattgtgtgtcttacacataacggagcaattcacggtacgtctcccacacataccggagcaaaaagacaagagatggagcgttatgatgcaaagatgcccgtagtatcacgcctaaatattttcacgttctaaattggaaaaaagaagagaaaaggtaatatgttacgcatgactttttaagttttagtcagatatcttaggccagttagctcattgacggtgtgccccacgcatgctagagcaagagacaatagatagctcattgacgatttgccctacgcataccatagtaagagacaagagaaacgacattacaaggcacaaaggcggtcatagtactacatcgaagtacgtttacattttacaaaaggaaaaaggggaagacaaaaggttttggacgatgtgcagaactttccaagttttagtcacatactgggtcagttggctcattgacgatgtgtcccatgcgagatagagcgttttactacattggaaaccccgaggtatagcttctgatttaagcctcgacttaccagtggaacctatctggtagacaatgatgttagtcacgttacttgggccgatgggctggttagcttattgatgttgtgtcccacacgtaacggaacaactaacggtgtgtgccacatttaacggtgtaatcgactgtgtgtcttacacataacggagcaactaacagtatgtcttagcttattgacgctatgtcctacacataacggaacaaccgacggtgtgtgccacatttaatggagtaattaactgtgtgtcctacacataacggagcaatcgacggtgtgtgtcacatttaacagagtaattgacggtgtgtcttacacataacggagcaactcacggtgcgcctcacgcatgccagagcaagagacaagacatagctcattgacggtgcgccctacatataccagagtaagaatcaagagaaatggtgttacaagtcacaaagacagtcatagtactacatctaagtacattcatgttttacaaaagggaaaagaggaaaataaaaggtatgacgatgtgcaaaactttccaagtttagtcacatactgtgtcaattggctcattgtcggtgtgtcccacgcgagataaagcgttacaaggcataaagacattcattgtactacattgaaaaccccgaggtgtagcttcctatttaagcctcgactgactggtggaacctagctggcagacagtgatggtagtcacgtttcttgggccggtgggctggttagcttattgacgttgtgtcccacacgtaacggaacaaccgatggtgtgtgccacatttaatggagtaatcgacgatgtgtcttacatataacagagaaactgaaagtgtgtcttagcttattgacgttgtgtcccacacacttattgacattgtgtcccacacataatgtaacaaccgacggtgtgtgccacatttaacggagtaatcgacggtgtgtcttacacaaaacggagcaactaacaatgtgtccgcgtataatagatcaactgacggtgtgtcccacacacaacagagcaactctcggtacatcacccacacataccggagcaaaaagacaagagatagagcgttatgacgcaaagacgctcgtagtatcacgccgaaatattttcacgttctaaataggaaaaaggaagagaaaaggtaatacgttatgcatgactttttaagttttagtgagatatcttaggccagttagctcattgacggtgcgccctacgcataccagagtaagagacaagagaaacggtgttacaaggcacgaagtcagtcattgtactacatcgaagtacgttcaacgttttacaaaaggaaaaatgggaagagaaaaggtaggacgatgtgcagaactttccaagtttagtcacatactgggtcagttggctcattgacggtgtgtcccacgcgagataaagcgttgtaaagcataaagacactcaatgtacttcattggaaaccccgaggtgtagcttcctatttaagcctcgactgattggtggaacctagctagcagacagtgatggtagtcacgtttcttgggccagtgggctggttagcttattgacgttgtattctacacgtaacggaacaaccgacggtgtgtgccacacctagtgcaaaaaaccggaccaagtcggcggttcgatcgtgaaaaatcggaaccagcgatgtggccggtctattcgtgcaaaaagactggaggggaaaataaccggcatgcccagcctggtaacacaaaattatgggccaaatcaaggcccaatccagtaatttgcggcccaacagccaaaaatagcacttaatctagtgcgcatgggattcgaacgtggatctctggggagatcgcaaacttttctagccaaaagagcaacgcatatattgtgtttgaaatgagtacatgagtaaataacggtttttcacctgcacttgaaccggttgacccggcggtccaaccgttcgacccgtgacctagacgtccggacggttcggtgaccagtccggttttttctactatggtgcaacatttaacgaagtaatcgacggtgtgtcttacacataacagagcaactagcagtgtgtcttagcttattgatgttgtgtcccacacataatggaacaaccgacggtgtgtgccacatttaacggagtaatcgatggtgtgtcttacacataacggagcaactaacaatgtgtccgcgtataacggagcaactgacggtgtgtcccacacacaacggagcaactcacggtatgtctcccacacatactggagcaaaaagacaagtgtagagcgttatgacgcaaagacgctcgtagtatcacgccgaaatattttcacgttctaaataggaaaaagaaagagaaaagataatagttatgcatgaatttttaagttttagtgagatatcttaggccagttagctcattgacggtgcgccccacgcatgccagagcaagagacaagagatagctcattgacggtgcgccctacgcatactagagcaagagacaagagaaacggtgttacaaggcacaaaggtagtcatagtactacatcgaagtacgttcatgttttacaaaaggaaaaaggggaagagaaaaggtagaacaatgtgtagaactttctaagttttagtcacatactaggtcagttggctcattgacggtgtgttccacgcgagacagagcgttacaaggcataaatgcactcgttgtactacattggaaaccgtgagatgtagcttcctatttaagcctcgactgaccggtggaacctagctggcagatagtgatgttagtcacgtttcttgggccagtgtcctggttagcttattgacgttgtgtcccacacgtaacggaacaaccgatggtgtgtgccacacataacagagtaatcgacggtgtcttacacataatagagcaactcatagtgtttctgcatataacggagcaactgagggtgtgtcctacgcataacagagcaactaacggtgtgtcccacacacaacggagcagctcatggtatgtctcacgcataccaaagcaactgacggcatgccccacacataccagagcaaagggacaagagatagagcgttatgatgcaaagacgctcgtagtatcacgtcggaatattttcacgttctaaataggaaaagggaagagaaaaggtaatacgttatgcagaacttttaagttttaatcacatatctcgggccagttagctcattaacggtacgccccacgcatgccagagcaagaggcaagtgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaattttttcaccgaggttcggaaattcgccggtttcctaatccccgttgagacgagcccaattccactgctcaaccacgaagccaccgcacgcccccttcgtcaaggggtgggcaaggcgggagctggcccacggagaggactacccaagcctcgatcactcgaggtagttcttccttcactccgaaggtggtgaactccaaaccactcacaaacggtgccgggcctcctccacaatctcctcggagaggtcactgggcaacacctccacaagccgtctaggaggtggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgctgctggggagtgggtatatatacccccaaccaccaaaactagccgttggaaccgaaatccccaactttgtgctctaccggtcagaccgccgttgtgaggccggtcagaccggactactttgtaacggttagaaaactagccgttacagggcaatcattgagcccactcaacctggctgtcacatcctgattttcgttttaggatttataaattatttaataaattattattggaatttatattaaatgatctttaatttacaagtgaagtaaaatgtgggaaataaaattttcttaaatctaaagcatggatggatttaatttttattaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccagataaaatttcattaaatactttgcttaattctataattcctagatttttctgggaattatttgagctaaggaagtatttttaataaatggaattgcatttaagaaataatttaattgaaaaaggttttaaaaagtcttcttttggctttgggccgaaagtcggcccaaaacctctttctctctttccctcggcccagccggcccagtccgccgagccgccgctctcctctctctctcagccgctgacaggtgggccccgcttgtcaggttcgtcttcctcgagccgccgctgccgcctgaaaccctagcgcgccgccgtcgccgttttcttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgttgccaccatcgggttcgccaagtcgtcgccgtccccgtccaccgcttcgccgccgccgaagaccgtcggagcgccgtcgccgtcgtcgacccgaagagcttcgccgcttcctcctcgtcgccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgttatcgtcccttctcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttacttttcatgtattgtttatttggtttttattagtctttttcttcgttttgcgtgttagcttgtcgtttccgtcgttgcgaaggttcgcgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctactctttgttatggcccttttgttctcgattactttattccttgataccttgggtgattataattggactagttgagctttatatatattggttcaactagatattagatgtgattgcttagccatgcttagaaacattagcacactattgggataacttatgactcactatttttttaatgatggcttaatgatagttcacgatggtcaatcgtgattgattaattaattacttgccaactaaaacttgataatggtgggttgtgagcacatggttttgagagtcgtgctcatggcaattaaggaccggttcgcgagctactgttgtgaaacattaaccgtaccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttatgcagagggtattgtcacagcctctatttaggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaatagttatggatgttatacctgataataatttgcttagctcctggtttggagattagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccaggaggagaagacgtttggcttataccccagttgagctgcctgtgggagtggagccggagcttcgctagattttatttttccgctgcagttttcttcatgttgaggactaagtgcctcttaagtaagtatttattcgctttagttattgatgaatctgtatattaaattgtcagtttgtgtacctcggctgattcctggaggaggattttatgcacaaataagttcggaaattactagtgaatttccgggcgtgacactggccggtctgaccgcagtgtagtggccggtcagaccgtccacggctcggtcagaccgccgtcggctcggtctgaccggttgcggctctggcggctctgtatcgccaccaaaaaccagaccagtgcaacagaccagtggggccggtcagaccggccttaccacgccggtcagaccggctaacagacccggtcagaccggcctaaggcccacggtcagaccgcaggtcacttttcagctcaaccgaccgttagtaaaacggcgatatctcttgactcgggtctcggaatttggtgttcttggactctatggaaagattattcaaaaggccatccaacccatgaaaaatccatccaataaacacaacttaagtcaaggataaagggctcacactccaaaggatatccaccggacatacgcacaagatgtcactcactcctattggacatgcccacttctctcttggtttaagacttgagaaaactcatcacacttggttagacaagcccacaaaatgcacctacatgcgtatgaactaatatggcacaagatcatccacaagctcgcttcatagacccctcttgatagtacggcgcctatctagcaaatctggtctacaccaaacaccaagaccgggaaaatactaagaaaacattcttagctacattatacctttgccttgcgccatccatcttggggtcaagcttgagccgagatcaacacttgtgaccatccggttgaaccatgtttatgctgaggtcttgtccatcctttgtcaagactttattctcatcacaagtttgacttcattcttgccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagattcgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgctgtagaccaacataaaacatatacattcatgatctccttgttctcaatgtaaatgagactaaataagataacattcgagtaaacattagtctcacacttatatatcaataacatgaaaatcatatatatgaaccaatcaaaaagtaggagataagaagtggtacatatcgttttatctccatgcatttcatccttgtcatgattaaggtccatcacaaaagaatgcatatcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaataggaagctcacactatattttggatctacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttacagcaagagatatcgcattgatgatgcatcccgcgcatgccggagcaagagacaagagatagggtgttacaaggacaaagacaatcatagtattatgtcggaatacgttcatgttttacaaaaggaaaaaagggaagagaaaaggtaggacgatgtgtagaactttccaagttttagtcatacattgggtcggttggctcattgacggtgtgtcccacgcaagatagagtgttacaaggcacaaagacaccctttgtactacataggaatacgttcacattttacaataggaaaaaatgaagaaaaaagataagccaatgcgcatatcttttcaatttttttagtcacatgtctttggtcggtcggctcattgatggtgtgtcccacgcatgccagagcaagagactagagatagagctttacgaggcacaaagacactcattttattacgtcggaatacgttcaggttctacaaaatagggaaaatgaaagagaaaaggtaagacaatgtgcaggggtttccaagttttagacacatatcttgggtcagttggctcactgacggtgtgtcccacgtatgccagagaaagagtcaagagatatagtgttacaaggcacaaagacggtcatagtaatacgtcggaatatgcacaagttctacaaaacaaaaaagggaagagaaaaggtaagacaatgtatagaactttccaagttttacaatggaaaagaaggaaatacattcatgcatctcctacataccaggatagatagggtctgcacaatcacaagaggagtcaatgctagtaaaataacgtggcatgtttttaccaaatattgctccactatttagagctctttagaacacatgcattttcatttttttagaaactagtttagatcccatgaagttctcttgtgatttctccgtttcaaaagatgccttaagatacgtagagaaaaagaagcaacatgtgaaatcgtccaaattataagatgatgcataacgagtacaaaaatgtatctcctacatggagtagtagacaaaggggttacggagtgacgactggagtcttttctaacaaaactttaggagccattcacaccacatacggtggagcaacatataggatatagaacacactagaatgcgtctgcaacacatagggcagagctgcatgcaaaaccgaccaagttatgtagtaggatgttgagcgtgcacatagatacatctcgtacagtgtgagtgacacctggaggtagtcctagcaatacatcaagatacgtttcgcattgtataacacttgacatacatagaaagagcaaactaatacggaaaaaaaatacaaatatcttacgtagtagagatagcagttgtagtcttgcaaagtgatgaccggagaactggagttcacatggacactagtgagcatcatcacacatcatggtctgcgacatacataaaaaagtattcataggtcaaggtggcaagtaatttgcgtaggccaccattctagttactctttattttataaataaagcatggggaacataatataatgtaatcactatttgacaaactttgtgaagtattatggcatagaaggagcatccatggcaaaaaaaaaaagatttcactagtgattgcaacatgtcaagatgtatggagtagtagatgatatggtttacagagtgagaaccgaagtctttgttagcatcaggatgcgttcacaccgcatacaatggagcaacatacattagatgcatccacattgcatggggtggaacggcatgcaaaatcgtccaaataatgtaataggatgctgagtgagtacataggtacatctcctatagagagagtgacaactagaggcactcttagcaacacatcaagatatgtgtcgcatcattttccactttacatcatagacatctcctaaagagtgagtaacacgaggcactcctagcaatacatcgagacatgtttcgcatcatatcccactttacatcaggatatattttgcatcgcataccacttgacatataaagatagatcaatgcaaaaaatccaaatattacttacgcagtagagatagcgtgtgcggtcttccaaagtaacgaccgaagaagaattggagttacatggacaatagcaagtgtcatcacacatcatggtctgttgcatgcataagatagtattcaaggtcaaggtggtgggctatatacatgggtatgtattaacatgtcaagatgggctatacatatgacaaattaacagaagatcatgccttgtttgatgcacgttttgttttaagggaatcattatcgtgtgaatatgagttatatacaatagatgtatgtgtatctaataaatcattctaa

SEQ ID NO: 21225 - DNA, 727 bp, Oryza sativa
agagagagagagaaaggcaatctatcgagctatgaactttgttgtttgcatcctggaggaccaagtgtcggtaagcctgtatctcggttgctagcatgcatgtactgatgcacgcctcccttgtgattgcttcgactttaagctcactcatgtactagtattttttttttgacactcaaagtgaggaggaggaggaagaagaaacaacaagcaaaggcaaaagaaatcgagcgtgtgagtgagtgagcccccacggaccgatacaaaaaaaacccgtgtgccacgacgtgcgatgcattcatatgcatgcatccatcctcgtttttttttattattccctgtgtaataataatcgagcccgtcgaccagtgcatctggatatatatatatatccggtgctccagagaaatttttcacgtgccattacaccgtacacgcatatggagtgtacacgacgcgcaaaacaaaatttcgccggggagcagcgaaaacggcgtgcaggaccagcacagtgagagggcgacgggtcgaccatgtgaggaaggacgggaaagagagagagagagagcgagcgcgtagtacagtacagtacgtgcctcgaccggaaaaaagggggccggccaaaatagcatggaactgctaaaccgaggcgcgcgggcgcatgcatatgtgaccgtgatcccgtgctgctacgatgacgcacggcgagcgcggggtgtatcggcat

SEQ ID NO: 21226 - DNA, 591 bp, Oryza sativa
aatcttctctctaggaccatcgatccccacaagcttctctgcttccacatagagcactgggagtcgaggatcaatttgaatatggctaaatttttcagcaacttcatcaaaattatacctcgagcggcgataactttcttctataacacgagccttaagttcttcaattaggttcgcgattttgtggcgccaccgcgccaccataactttctaattttagctgccatcttccggacaaggcccgctttagcattagaactgctcaccttgtgcaggaaaaggtcgatgcagtcttcaatatcatagctaagctcacgcaccttgttcctccaatccttcacctgctcatccaacttctcctcgttgttcgccagcttcaccagcagggtatgcatgctgctcagctcatccttcagaaaggagatcccacctttcacgcctttgagaagcttgtactccccttgtatcaacagggagagcttaggaagcagggtgctcagggcaccagttgaaacactcactatagctccagccatgttgacctctttgtctaaccctagtcaagatgtggttcactagtaaatgagaggg

SEQ ID NO: 21227 - DNA, 24562 bp, Oryza sativa
tatcatccacagccactgcatcatttcatttctgcgctcctcatctactattgagccactcaattagagttagtcagagagggcaacatggctggagctatagtgagtgtttcaactggtgccctgagcaccctgcttcctaagctctccctgttgatccaaggggagtacaagcttctcaaaggcgtgaagggtgggatctcctttctgaaggatgagctgaccagcatgcatacccttctagtgaagctggcaaacaacgaggagaacttggatgagcaggtgaaggattggaggaacaaggtgcgtgagctgagctatgatattgaagactgcatcgaccttttcctgcacaaggtgagcagttctaatgctaaagcgggccttgtccggaagacggcagctaaaattagaaagttatggtcgcgccacaaaatcgcaaacctaattgaagaacttaaggctcgtgttatagaagaaagtgatcgccgtttgagatataattttgaagaagttgctgataattttagccatgttcaaattgatcctcgactgccagcactctatgtggaagcagagaagcttgttaggattgatggtcctagagagaagattatcgagtggctggaaaaagatgaatctcagaaactcaaagtagtatgcattgtgggctttggaggtcttggaaagacaactcttgcaaaccaagtttatcacaaaatgaaaggtcaatttgattgttcttcttgcatgccagtttcacggaatcctaatatgacaaagatactagttgatttgctcaaagaattgggaagtcgtgttgatacatcagatgatgagcgtcagctcatatgcaagctcagaacattcctacagtgtaagaggtatgtagaaaaaactgcaaatggtgtttttccatatattttaaccatgtttgaatatatttcccatgttaaaatagctagcactgtaaagcgcttgtagattctgatcttcaatttttgctagattgtaatatctttgcaagaaaaaaaaaagaaaaacttgatgggcactccgctcattggtgcttgcttaacattggcatgatgaaatgtaaaatgaaaggggcaatctgcacagaatagttagaacctttaagtaaaggctaaaaatagtgatactgtggcttcttcatagatcataaaaataaaccatccatagtttcagtgattatgttaaggattagctatataagcaatgcaattctggaacaaataagatggcattgaacttatggtcttgtatttacatctatgccaaatattacaaagtagttcgttaaattttagaagtgatttggcacgattcatataaagtgccgagttcatcaaaaagaaatacttcttccattttatattttaagtagttttgattttcttagtcaaacttcttgaaagtttgaccaagtgtatagaaaaatatagcaacacttatcgcactaaatccgttgaaaatatttctagatttttctataaattagaaaaaatgcccgtgcgttgtaacgtgtgaagtttattttaattttattattattatatggtttagttaagatgaaattcactgtgggagttcgcttggatatatatatttttagaaaatcatgagctgcaattaagagtccgatcgtctcaagttagcatgtgagtttttttaaacatatttcttacatggttccttcagtattatcaaaagtgaacgatcttaattaaaaccgactcaaatacagatttgtatttccaaaagtaaataaacttaaaaaccgaatcatatatggatggcgtaccaaaataccggcaaaaacatctttaatttttattatagtagagacttggtcaaactttcaaaaagtttgacttaaaaaatcaaaacgacttgtgatgaaatggaggtagtaatagcaagtctggtgtgtggccgtctcaagcagggaatacatgctgtagctgcaacaaatgacaaactccaccttaattaaatattggtctcgtttcacccaaatggccaatctagtaaacttttacaatgtagttttcaaatgggattgatgttttttggagcagggcagcatggtatttgctgaaaatgactgcacaatacatagcttgttcgttttaaactctatgatttattaaccagatcacgttttctcaatgctaaccaggtacttggtcattgttgatgatatttggagcacaaaagcatgggaagttgtcaagtgtgctctcccagagaacaatttatgcagtagagtaatttcaacgacaagaaatgcagatgttgcaacatcatgctgctcctgtttagcaggatatatccataacatgcagcccttaactgagcaggactctcagaagctattttttaagaggatttttggggacaagtcagcatgccctccttaccttgaacaagtctcccatggaatcattagcaagtgccatgggttgccattagctattatcagtatagctagcctgctagctggaaaatcacatatgaaggagcaatgggagcaagtgcacaattctattggttttgtgtttagtcaacaaggaattagagatatactgctgcttagctactatgatcttccgataaatctgaaaacttgcttgctatatcttagtgtgtttccagaggattacaagattgatagagaagagctaatatggagatggatagctgaagggttcatcagtgaagtgaagggtcaaacactggatcaaattgctgataattacttcaatgatcttgtaaacagaagcatgatccaaccatttgacatcaagtacgatggcagggcagatgcttgtaaactgcatgatatggtgctcgaccttataatttccctgtcaacacaggagaatttcacaaccataatggaagggcaacaatataaatgttcttctaataagattcgtaggctgtcagtacattcaaaatatctggaagatgaagtaatgcacgagattatgatgaattgctcgcaagttcgttccatcagcttctacgaattgcaagatcaggaaattagtcttctctcaactcttaattctttgagagtgctagcttttaataattcccaccatcttggtaacaaaagcattaaatatcttggaaggtttttccagctgacatatttgagcatcgcttctcgtggtatcactgatcttccagagcaaataggaggtctgcagaatctactgacactagacattcgtggcagtagtgttgaaaaattgccatcaacaataggttgtttgaaaaatctggtgcgtctacttgtaaatgaagctgtgaaattgcccaatgaggttggagatctacaagccttgcagcagctgtcatttgctggtaactataattccatagtatttgtggaacagctgaagcggttggcaaacctaagggcgatttccatacgactgcatgatagcgcacgacttggtcatcatgatatggcaaggtatatggaagctttgaagtcatctcttgctgtgatggataaacaagggatccaatcattggaaatatcctgctttgatagtgtgataggagaaaaactcatggatttattatgctactcaccatgcctccaaaggcttgtcatacatggttgttgtatcggtctgctatcaaagcagatgacgttgcttgttaacctcaggcatcttgaaatatgggttagaaacattaagcaggacgatctctgcgttctaggaagcatacccactctgctcttcttcaggttatttgtagtatgtggacctgatgaaaggcttgccatcagcagccatcaattccgatgcctcaagcagttcatcttcgtaagttacggaggtgggctggagatgttgtttatgcagggagcaatgcctgagctccgatggttctcttgaattccgcgcacatgaatcagactgcaagatgggttttgagttcagcttaaagcaccttgcaagcctggagcacctcaaagtcacaattttttgccatgttgccaccagaagccgggtggaggctgcagaagcttcggtcaggaatgcagccagtgcccacccagggtgtcccatatttgaaatcaatagatgtggggaacaaaacatggtagatgataaggtcgacaaggaggagatactcaaggatatagatgctcatgaagtggttcggcgtgacatgaataactgaaattgcagtttgcaacaccctatgtgagattctacttttactgctgcttataattgcctgagacagaggctaaactgctagccacatgatcactattgatgcatggaaactaagttatcagaccttccaattcagaaccatcatcatttggttttgtctaattactactggtaatactggcaagtagaccttctagcttgatttgtaaacacattgagctttaatatttcaaatgcgggtagccggactgccaatgagcatctcttgcttcagttgtactttactctatgtacgccgaaagtctgcaagctttgagtaatctcttctgcaattacttctccgaaaggaccaagataagaaaacaatatgtactacctccgtttctaaatgtttgacgctgttgacttttttaaacatgtttgaccattcgtcttattcaaaaaaaatataagtaattattaattcttttcctatcatttgatttattattaaatatacttttatatatgttgtcgaatggacaactgcgtcacgtcgaaagacgtggttttctcaacagtggatgggaaataaaaaaacaattgtattactttgttcaaattttttgggatccccctattacatggccataaagagctatttatagccccattacaggtttctactactagggtttagattatataggggaattttcatggttacccttatgatagggacattatggagggcacactgtgtcctttacacatacgggcccctactgggcctaaatggctcggcccatctatctggcgaaatcccccgagggcgtagcggcccaccaggcctctcgacaatgaggttcggtacttcggcgaaacccgtgcctgtgtgccgaggctttcaccgcatcatcttcgcccatgccgccttctggcaaggactccactcggcgaagctggtgtaacccaagccactgctttcgcccgtatggctttactctcaaccttcgccgcccgcctccggagcgagcctgttgcttgaatttttggtttcagcaggttcggccgaaggccctccgtggtaagcctccaacaagcccctaacgggcaagggtgagtagggagcttcggccgagaccgtgcaaatcgaatggtataccacgaggtgccccctttcggccgatgttcctgccgaaatccatgatgtacccctgcgaaataaataacttgtttccatgtttacaaaaaattcttgagaaaattcctttctcgcatttgttacaaagtatcgaaagggttgacttgtctttgtcattactatgaatagtaatgggccctgtgggcctctcctttattgcaatcggcctttcgctgttcggctcaggcccgatgggaatttaccgtttcgtctgcccttgggcacgtgtcaggatttgattggctggtaggcgaacggtctcgcgatggggttatatagccctgggccgacttgctattttctcttcccccccccccccgctcttcacttttttaccacttgacgcgctccacgctctcttcatttgtctgccccttagcttcttcgccaccgttgtgcttccgcctttcggctactttccccttttttcttggccgcgagcctgatggctcctcgcaagcccactaaagccgggtcaactggcgaagaccctagcggccttggcgaagggtggtcgtgtttccttggcaaatcgctcgtcaaggaggccgacttagccgagttggtatcctccgatgctcttgtggagggccaaggatcatgtgggggcgaagccgttgtcccttcgccctgtaatgggcgaacggttgtcttcgctgcctacttcgccgccgggcttcatctcccgtgtgacgatttcttgtcgtctgtgctcgcgacatacgaggttaggcttccccagcttagtccatcagcgttcctgaagctcgcggttttcgcttggatgtgtcgaacctgtgggtccgctcctaccgccgagctattcgccgttctatttatggcatgcgccacgaccaaggacgtgcagacgccgaccgggccgaggaaaactgtcttcggctgcgtgaacttcatgctgcgtctggagtgctcaaatgcttggccggtgcccgcgtcgatggccaagtgggataggaactagatgcaaaaatggttctacatcgccaacccttaccccgccgaggatgccaaggcaaattggctcctttttcagcgttccgccgtctccatcatcgcgaagctaaacgtggagatcaatgggaccctcgagagtcgagtcccggcttatactcctccttaaggtcacacgatggctaagcacccaagacctttgtgaggagttttgcctccttcggatctcccttctcgctcgtgtctgggatgtgttcgtgaacgagggcgaagaggttctcgggcttccccgccttgttctccccactggggtcgaaagtgagtttttgcttttgctccgagccgtatatttcctttatggaaatgccctttaggctaaacagttgtttttgttttgctttttcacagcccgaaccttggaggacgccgaaatagaggcgtcgaagatgataggtggtctgacaacggccgaattcgctcgcttgctccagcgccagaccgacgaccgaggtgaaccgagttcatgttggcgaattgccaagtcagtcgaacccctccagggccagggatgacgaagtcggcacttcgaagaaacgcaagcgtgcagtcgcgaaaggtggccaggttcgaactcgccgcggcgcgaagggtgcggttgaaagtgacggggaggaggaggaagaagaagatggggaggctggatctgaggatgatgggttccatggctacacccctagttcgactcctgtgaaatctggggcaggttctcatatttcacctacgcgcccgcaagatatcgttgtggcgaacaccctcctggcgatttctagtactgcggcgaaaccggggatgaccgccaggaggaagaaaaagaaagggaaggttgtgcaagtcgcccgcggcttttcgaacagcgaagggtccgacgggacgcctacttcgccgattctgcagcacggacctcctcgtggtaggcgcatgtccccgccacctgctagcgatgccgaagcggcgatgggtgggagtgcctcagcactagccgctaaggtgaatgtttctggggacgaacgggttgaggcaattccttcgccagcccgtcaacgggagggaaaagctccggcggtcgaagcgaccgtttcggacgtgacgctcactgcccacacttcgtccctgctgatttcgccatgcggccggagatcctccgttcgtggacggtgtgtgccatgttattgcaccgaccgacggccttgggctcttcaccgaactaaacgagttcggcaaaagctgcgcggctgcggagagcctgtttgtgcgggtatgagttttctgtgtgccgaactttgtcctttcgcttgtgtcctgccgtaacgtttttgtttctccttgtccagggcctcgccgcacacttaaacgcgaagaaatctgccttacagaggctagacgggtaccgccttcgccttcgaaaaaccaaagaagatcttcgccacaaggaagacgaaaggcgcgtcgtggcggagactttaaagaaggcgaatgctgaaaacaaggttcttttgggggacaacaagtctctccatgctgaccttgatgtggcgaacaagcgggatgccgaacgagaccgacaacttgcttcggccgaggagaaaatcaaatcccttgaagcgcgtcttgtctcggccgaagctgccgccacgaccttggttccggccacagtccgccaagcaggcctgttacactctccggctgccccttaatgaccttggggcgcgggcggaaggcgctctgggcgaaggcgggaccgtattcgacttctccgaatggacgcaggaagcagccggcttggtcgttgaagtggcgggtgcctacggggactgctgcgctcgtgtttcggcgggattcgtcctcagccttttgcacgcgcacggctgtgaccatatcgggaattttcccgacctcgtgaaagaagaatggctcagcaacacgcagtgttctggggcggcctttcgaaaagggttctgggaggatggcggtcgggactgtgcgaaaactcgactccgcgagaaccttgagaggatcgcgagagatgaggaagccgctgctggcaacaccgaagttgaccctgggccgtcggaacaggccgccgggtacgagggcaaaaacaacggaggccaagaccaccctgatgtgtgaggcccttcgccctctgtgcttttttctttatttttctttagtcctttcgggctttttggtagcctagccttgtatataagctctttgcatgttcggctttgagccgttttcaacttgtaaccaatatgaactttattctaccgatgaaatattatcctttcgctgatctaattgtttcgtttgaaagtgggattgatctcatctatatttccccttttttgcacttttttcttttgtgctttactagcaggcttgtggccgaaaggtatgcgttcgacctcctactgaaaaatggcgaaacaagaacgagaagtttgtggcgatgaaaggcctgccgaagattaagtgtccttttcggcctgtttaccatgagatgttgattaatggcaatagctataaggttgtaaacgttgctaaattgatgcgcgtgcatccaggccgaaccttagaggactacgatcgctatcgtgtgtcacgtcgtgaagatagttcgagcttttggtgaaactttaggagatggttcgccaagaggcgatcgctcgtcgccgttatagtttagtttgtgtttgtcctccatcccctttgagggttgtatatgatattagtagtgacgacgaacccgattcgccaaaccattccttagggggtgaggactgttgtgtgggcgaaggtgtaatttatctgtaagctcgtatcttagggggtgagcaccgttgctttcttcgcttgtatcatgttgtcagacttgtattcttcgattattttttcgaagctaataaagatatgctttatttccttttcgctatttctcgcattgtcactcttcgtgcttttgttaggtcggaacgtgtcggcccctttgcgtatcgtagcgaaataggtctgctgacttttcagcttttggcttccgttttcgatctgtagttttctgcgctgggaggcgcgcttgtgttttcatattgatcgagtgtaacggtgttcggttagttgtttcccgaaacaagctgttgcggtttcaacgttcggcgtgcgatacttcggccgatacgttttgccccccctggcatttttgctgatcaggcgtttgccttggggtttttccacaaattatcattcacacaaaaaggtgaaagacacaaatattttatgctggttcaggcctctagagtggataatagccctacatccagttttatttttcattttcctctcttttttttgcattttcgtgctgaagggcttacataatgccgaaaggcttacataacagtatgtacatttttacaagttggcgatttgagtgccacccattctacacatagaaacgcttaagggaagcagcgttccaggaatggtcgaactctttgccttccagcgtcgctaggcgaaaggagcctgtcctggacctgtgcttgatgaggtacgggccttcccacttcgattcaagcttcccgaccgccactgggtttgccttcttccttaggacaagatggccaggaaatagctctgtcggtcgaacttttttgttgtaagttgccgaagtgcttgtggcgtatttgcgcatgtgttctaaagcttcaactctcaccccctcgaggagttcgagtgacacctcacgcccttcttcgcctccagagaacatcacccttggcgaattagcccctagctctgttggggtcattgcttcgtcgccatggagcatgaacgggctgaactttgttggccttgtgggggtcgtccgaaaggcccagagaacagatagcatttcttccggccatttacccttcgccgccccctcaagccttttctttagcgcctctaggatcttaccatttgcgcgtttggccgccccatttgactgtgggtgtgcgaccgaagcgaacctgatttccaggtttagcccctcgcacatctctttgaacttatcagagtcgaattgcttgccgttgtcagtgatgaactcttttggtactccgaaacagcaaataatgtttttccatacaaacttctgtactgctgccgaagtgatcgcgccgagtggttcggcctcgatccatcgggagaagtattcgattgctacaattgcgaacttgtacccgttttgcgccacaaggaacgggccaatgatgtctagcccccatctagcgaaaggccagattggtgcgataggctgcagctcatattggggtgtagtttggcttcggctatgccgctgacagctttcgcacttttgggcttgctcgacacagactttcagcatggtgggccaatacacaccctgtcgaaacactttggaggcaactgttcttgcggcctggtgtgcgccgcagagcccttggtgtatctccttcgccatttcttcaccttcggcaaaggagatgcagcgaagcaagggttggagcaccccggagcgatatagctggcccgagactagcttgtattttttgcggctctgagctgtaggcgcttcgcttctgcttcatccttcgggagccagccgttcttgagatacttcacgaacggggttcgccaatcaccaatcctctgggtcttcacccagctctgcctggtcgattgccatgatgtttgggctctctatgggcacacttggtgcgtacaggacctcaaaaaagatgcctggcgaatgcgggcctccacaagcagcagattttgccagggcgtctgcttcctcgttctggcctctaggtaagtgttcgaccgttatgccgacgaagcacttttccatagatcgaacagcctccaaatatctcctcatcccttcttcttttgcctcaaaggatttgtcaacatgacttgccaccaatttgaagttagttcggatgagtaagcgccgaacccccaaagctttcgccttttttaggcccaacagtatagcttcgtattctgccgcgttgttggttgtgtcgaactgtaaccttgtggcgtaccgaatcggcacgccccctggcaaagtgaggactgccacagcgcccacccccttgtgcgaccacgagccgtcggagtacatcacccaaggttgttcgacaggcttgggttcaagggcgaatgctggtgtccatttggccacgaaatcagctaggacttgggacttgatggcagtacgggcgacaaaatgcaagtcaaagggagataactccgccgcccacttgctgagccggccagtaatttccttgccccggggcacttcgcccaaaggatactgcgatggcaccgtgactttgtggacctgaaagtagtgtttaagcttgcgcgaagccatcactagggcgtaagcgagcttctccatttcaatgtatcgtatctacgccccttgcaaacttcggagacgaaatacactggtttctggcctgactctgtttcttgaacgagggctgcactgactgctatcggcgaagctgctaggtagagtagcagttcgcttcccggtgctgggctgaccaaagcaggtgggctctgcagatattgcttcagctcgtcgaacgctgcttggcattcgggtgtccaagtaaactttcccgtgccccggagggtcttgaagaagggcaagcctctttcggctccctttgagaggaatcgactgagtgccgcaattcggcatgcgagcttttgtacttcacgtacgcttgacgggggcttcatttgctgaatggcatcaattttctcggggttcgcctcgatacctctttcagaaacaagaaaacccaacaacttgcccgcgcgaacaccaaaaacacacttctcaggatttaatttcatacccgccgcgtataagttgtcgaaggtctcctgtaagtcggacgcacggtcgaaagccttgcggctttttacgacgatatcgtcgacataagcctccacatttcgccccagctgcttgtaaaggaccttgtacaccagcctggcgaaggttgccccggcattccttaggccgaaaggcatcctgaggtggcaaaaggtgccgaatggtgtgatgaaggccgtcttggggatgtcggctggattcatgtggatttggtggtagccggagtacgcatccaaaaaactcatgagttcgcaaccagctgtcgaatccatgagctggtcgatccgcggcaaggggaaatcatcctttgagcatgccttgttgaggtctgtgaaatcgacacacatgcgccatttgccattcgatttctacaccagtaccgggttcgccagccactcgggtggtcgatctcctgaatcaccccggctagcagctttttcccttcggctttcgctgcttcttggcgatcagcgaacatcttgcgcagcttctatttccttggcttggcatccggcttgaccgccaggtgatgcatgatgaggtctgtcgaaacacctcccacctcgtcggggccccagacgaagatatcaatgtttttcttgagcacctacaggatgttctcaacttctctttcacccatgtcaccccccagcgatacaaatcttgtgggatcggcatcgtcgacttgcaccttgatcaccctgccgtggggggcgggcttcggcgtgtgcttcgcccggtcatgcggttcggcctcaacattgtgcaccgctctgttgattgcggccaaatcgccctttgatgtagccaaaagttgaagccccttgaccacgatcacccctgcaggtccagacatcttgagtttgagataattgttttgggaggtggcttcgaacttgttcaaggttgcgcggctgaagattgcattgtagttgtatggaatgtcgacaacgtcgaacagtatttgctcttcgcgtatgttttcacctgtgccgaaggctaccaccaactgtgcttggcctaggacttgaactgcttcttcgccaaaaccatgaagcgaggccagtgtttgggtaagggctagggtaggcaaccctatcttggcgtatgcttcggcgaagatgacatcggccgaactccctccgtcgactaagatttgccggacttcgaagccagctacctcggccgagatcaccagggagtcttgatgtgggaacatcactccttcggcatcttctggcccgaaaaagatctgttggttcaaatattgcgaggccccttcgcccgccgaagtgatgttgtgcaccattcgcagctgcatcttcttttgcctttttgacagttgattcggcgggtcggcccttataatcacttgcattactccgcgctgcacatcttggcgttgttcggccgggggtgcttgttcttgaacggcttcgcggggtgcttcagcagctgctccttgttgcggtcttggatcttgcgcgttgccacgctgccgaatgtttcggcattgctcggtggtgtgcgaagagcgttcgtggaaggcgcagtaaaagtcttttctgaccttcttgcgaacaggttgctcatggctgcttgcttgctgggcgtcgaactccttgtggagggcttgaacttcttcgacagctatcatagccttgcccgcacggtcggttttgaatttcctccaagtcatgggagcttggccttgccttggcggttgtccttggtgcaccggctgaggctggctaacagcgagaggggctggttcggcgacctgggcttgtatttgggcttgagcagcggtgacagaggctttatcatattcggcctggattgcttgccgttgcttggaatccttttcgccccttgcgtacccgtcaatgatgcgaagcaagtgctcaagtgtctgtggctccttgttggcgatttttcttgtgagttcgccctcgagcagcccggccgaagcggcgttgatgacggacgcctcagttatgtcctgaacttggcatcgggcttgcgagaagtgacgcatgtactcccttatcgactcccccggcctctagcgaatgtcgagtagatgttgctgcgtcttcggctcctcgtaggtgcctcgaaagttaagaacaaagacatcgcgcaattgctcccatgagttaatgctgttagctggtaaattgaagtaccaagaacgggcgatgccgtctagagcaagatgtattaccttcgccttggtattttcgtcgccatgagtggcttcgatcgcggactcgtagatggacaggaactcttttgggtccgttttgcccgaatagcacggaacgggagggaacttgaacttgggtaggattggatggatcttgattcccccgctcagtggtagccccttttcgcccctcgctttgttcgcagcaccttgctgcgaatatggcgttgcgaagggcaaagtcatggcttgcgcgtgaggttgagccacagtgttcggctgctcggctccgaacggcgatgcttggtgtgccgccatggatgggtcgaacgacggctgggtccatgccatggcggcctggtttggcgcctggttagctccgaagcctggtgtcggtgcctgtggtcgaatggttggtgcttgagcagcgttggtgaagtcgaactgcggtccttgactccaaggcgaagcccccagatcgggctggctcgatggcaaccaactgggcgcaccttgacttgtgttcccctccggtcaggccgaaggggctatacctgaaatgctgtggggttggttgagttgctgaaggaaagcttaaagctgtgcttgcaaagctgaagccccttccgccaatgcttgtgacatttggcccggtggtaaggggtgtacttgggcagcgatcggctgagcctgcagctgcacatgaggggtcgggtgtattgctgcggccgaaggctgcccggcgaagtacactggcgcttgcatggcttgtggcggaaggggttggattgatgcttgtgggtggacttggggtggaatgtaacctgtcgaatattggaggattggggccgaggcgaccttggcttgccgcgctgcctcatacacctgctgctgttcttgcatttgacgaagcatgtcttggagtcatgtcatgtttttgcgcatggcctccatgtcagcttcggcctgtgcttcgaggttggggttgacttatgcagcggcgagcgcggtcaaagctacagcctgttgcggtgaagcagcttggggcgccgctagttgacttgtcgaaaggatttctgccctagtctggagcgcccttgctgccgctgccgccttcgccgcatcgaccatattcggcgcctgccccgctgaagcggcaggagccgaaggtagtggttgcggcgtaggggccgacgtcgatggtaccacaccagcttcgacgccgagtgccgaaggctctgctccctctttggctgccatctccactcttgtttcactctccttatgtcttgcaaccttctcatttgcgaccttcttcggtggcattttctctcagtggtttcgctcggaggtccccacggtcggcgccagctgttgtcgaatggacaactgcgtcacgttgaaagacgtggttctctcaacagtggatgggaaataaaagaacaattgtattactttgttcaaattttttgggatccccctattacatagccctagggggctatttatagccccattacaggttttcactactagggtttagattatacaggggaatttacatggttacccttatgatagggacattatggagggcacactgtgtcctttacacatacgggcccctactgggcctaaatggctcggcccatctatctagcgaaatcccccgagggcgtagcggcccaccaggcctcccgacaacaaggttcggtactttcacgaaacccgtgcctgtgtgccgaggctttcggcgcatcatcttcgcccgtgccgccttctggcaaggactccactcggcgaagctggtgtaacccaagccacggctttcgcccgtatggctttactctcaaccttcgccgcttgcctccggagtgagcctgttgcttgaatttttggtttcggcaggtttggccgaaggccctttgtggtaagcctccaacaatatatacatatagttttacatattttataaaagtttttgaataagacgaatggtcaaacatatttaaaaaagtcaatggcgtcaaacatttagaagcggaagcggaggaagtatgatttattgctgcagcaatgatagctgcaaaacaagaggatatcttggtgacattgccttctgatactgtagatatataaaccctagtttactaaatgtgagagtattccctagatttggccaccagtcttatctcgtcctagtagaatctcaagcattttcccagcaatatttccagtcaatggagaagtgggtagctggtgcctggtggttgtttagggtaagcaccacagctggctcgaaagagtcagagagatttgtcaagtgattcttttcttatttatcgatcacatttttaaaactattatatatatcaacactcaacaactttatgaaaatctcataaagttggggctggggctggggctggggctctgggacattgagacatggggacagatttgaaaatctcatggtaaatttatgaacaaatttgagattgatcaaatgtatctatgtgcaaattgtggataaaaaattgtcagatgttctattttggagaagaaatgaaacaaatcatgttataatattggtgcatataccttttgtgcaaatatttaattaatttaccttttgtgtatatataagatgtgattaattgtccgtataaatttactactctctttgataaaaaattaaaacctatatgatttttgaattattttgtcttggggtgcgtgaccacgattttatgtttcaacaagtttataaaacacgatgggagttattgttttaatgctagatattgtagatcatttagcactcgaataaagacatgcatataggcttggatattcatacttttagacatatgtttttttgtttggttattatgatttgtattatcaaatatcaccctaaagatagtaaaaacagattactactacatgggtttataatacggggcctcctaccccgcgcgtgcgctccttgagattaactcgcgcgcgtgatcaacaatagggtagtgtttctcgcttttcttttctgttttttttctcactttttttttgaaaaaaataaccgcctgcacattttattccttttatttaggataggtatgaaaatttaagtcaatatttgaaaacttttaactcaaattttaaaactttcatctcaaaattcaaaatattcaatttaaatttgaaaactttcatctgaatttaaaattcagaacactcaacttaaatttttttaaaaactttcaactcaaactcaaaactctcacgtgaaaattggaggtgaaagattcaatttataaaatatagaaaaagaatcacgcatgtggagaaaaaatgaaagatttccaaaaaaaagaaaagaaagaagaaacagcgagaaaaagcgaaaaagaaaagaaaagaaagcgatagggtaatgggccgcgtgcgatatggtccagaaacacgcgttgatagcgcgtacgcgctgattaccaaattccttataatatcagtaataatatctacccgtgcaacacatgggtttacagcaataacaaattatagaacagaccggacgtcaacaccaaccgattccaaattcccaaatcttcttccttgtagctgccaagatcccaagaaggcaagaagtcaataacgtgccagaaacgccccttgttccctcgtgtccactcctgcccccagctttctccattccaccccatcctcgactcgcaagtacccagctaagatcagggagctcatctccaggagacggcaattaacaggtaacttctctagttctcctcgtctcttctgctccatctccggcgaccagtgattcttggtgtgccactacactactagtggtactccaacaagtctgacggccaatgccaactcaatcgctgcttttccccaaaggcgaatctatctgcatctggattaccaaggtatttttgggcttttcgcacatatgcacacatcttttactctgttgttctacaccggcgacctgtcgttaacttgttaatctgttcttgtacaaggacggctagtgaatagaagggggagagagagatggacggagcagcagttagtgctgccactggggtgatgggttccctccttgccaagctatctgccttgctgggagaggaatacaggcttctgaaaggtgtcaactctgacattaggttcttgagagatgagctgactgccatcaacaactttcttatcaacatgtcaaatatggaggagaacctgggtgagcaggagaaggagtggagaaacagggtccgagaaatcgaggattgcatcgatttattcatgcgcaaattcaatcatggggatgtggatgccaactttgtccgcaggacagcaaaaaagataggaatgttatggtcacgtcatgaaattgctagccagatccatcaacttaaggattgtgttaacgaagagagtgcccgtcgtttgaggtatagatttggtgaaagcaatgcccgcatagttgaaattgatcctggactaccagcactctatgtggaagcagagaaacttgttggcatccatggccctatggagaagatcattgatctgttgacaaaacaggatggatcctcacaacagctgaaagtggtttccattgtgggctttgggggccttggcaagactactcttgctaaccaagtacttaaaaaaatcaagcatcagtttgattgcacagctttagtatctatttcacggagtcctgacattaagaagatcttatttgttttgcttaaagatatgatcaacaaaaacaattctaatgatgagaagcacaaaaaagttgttgggatcaaggcagaaaaatcagatgatgagaaacaactaatcaataagctcagagaatacctaacaagtagaaggtgggcacaaaaataattggttctctttcatttactttcctgttaaagtcttcatcttaaatttttcaagtcgtttccatttgttgaggtccctttttcctttgctgtacaatttgatacaagccaattcaaaacccatgtaaatagaatcattactcatatttgtaattaattgttaaacttgataatataagactttgatgcacttgaccaaaatttcttaagaactgtttttgccttgtacatatttcttactaccattagaaattcaaccctcacaatgaaaatgttcatgttgttttggcatcatttggataatatatagtacttttctttgagaggatttgacaggtagctacttatacttttgcacatttagtattgaatttgttctccagaagcagtatactatgtttgcactgtatctcttcagtaaatttcatgttatttttaccaatatctgccttgttaaacttgactaattcactataacatctacataggtacttagtcgctgttgatgatatttgtgtaagatcaaagtgtgttttgattcttattctgtgatgaacaattggcatatgtgattattggttttgatatttggagattatcgtcgaagtggttttggagataatcaattttcaggtgatgattggattcactgttattttatgtgaccggtccgatcgggcggaggttgccggtcagaccggcgctatgtgtgcagtcagaccggctggcccgcggtctgaccggccgacactgtgtcggtttcggtttcgggttgtttatttggatatccgagtttatttcgtgattatgacttctaggtggatactatacgtatgtaatactattgtttgctgctaatgagtcaagttggagatagcttggtctcggaatatggtttctttgtttgttccatgtgtaggtgacttgatgtctcgggagagtatttgcggtgatggaccgggagtcggcttggggataagatgacgtctgtggtggtcagagatcatgcgggatacttaggctagaattgatgcacgtggttgatggagattccatatggcatatgatggaggtattgtgtgcatatgggatgcggagtcgaatttggaaggagtccaaatttggtacgattggttatgtaaagtttgtttcttgtactagagggtttcctaaggtgtttaggactcttagtatgagtttggttcgtggctttaggctgcctaccttatgtataaatagagggggagcgtgaggcttctcggaatcgcttttaagagcgtggagttgatagtttagttagggtttcgagtttagtcgagatttttgtaaggagtgttgttgttgcactttgtaaacacagagagaagcaataaagttgtcatctactttgagagttcttcgatttgtgtttcaccgggtttcggcggtctaaccggcaacacaccggcgatcagaccggcggcaaggcggcggtcagaccggcagcactagggcagtcagaccggcagcgtaagcaggcagcagcaggcagtctccgcgattcgaccgatcgatctacatcggtcagaccgacgttcatcaggcggtcagaccggcgcatccacttcggtcagaccgcgatccgtcgaatttgagggtaacttttatttccgctaaaagttttggtttttgggtatatcaaccattcaccccccctgtggttggcttagttcttgtgattcgatcctacaagtggtatcagagccttatttgcttctttggattttaatcgatctagagtttttgccatgcctgcttctaataagttttcaactaagcctcatgttttcgatcgaacggatttttctcattggtgtagttggatgcaatcttacattatggctgagaattatgatatttggaggaaagtttctcatccttatgtgattcctgaaggtattaatactgatgctgcaaaaactgagtttgaacaaaattgcaaagctcgcaatattcttttgagtgggatttctcgttcggattatgatcgtgttgctcatcttcaaactgctcatgagatttggattgctttgagtaattttcatcaaggaacaaataatattaaagaacttcgtcgtgatcttttcaaaaaggagtatattaaatttcagatgaaacctggagaagctttggatgactatctttctcggtttaataaaattttgaataatcttagatctgttgattcttcttatgatgctaattatccacaatctgagatttctcgtcactttttgaatggtcttgacatgtctatttgggagatgaaagttacatctattcaggagtctgttaatatgtctactttgactttggattcgctttacacaaaacttaaaacacatgagatgaatattcttactcgtaaagttggttctaagtctagtgctttagtttcttctttgacttctttggatgttggtacttcttcatcgaagtcttctgttcttcctttatttaatgccatgtccgatgatcaactcgaacagttcgaggaggaggacttggttttgttatctaacaaattttctcgagctatgaaaaatgttacgaacaggaaaagaggagaaccgaatcgttgttttgagtgtggagcacttgatcatcttcgctcgcattgtcctaagcttgggagaggaaagaaggaagatggtggtagagtcaaagatgatgacgtgaacaagaagaagaacatgaaggagaaagagaagaagaagcattgcatgcagtggttgatccaagaaatcataaaagcttttgatgaatcggaagatgaagatgagagcaaaggtaagcaagttgttgatctagcttttattgctcgtaatgcaagttctgatgttgatgaatctgatgatgataatgaagaaaagcttagttatgatcaattagaatatgctgcttataaatttgctaagaaacttcaaacatgttctattgtgcttgatgagaaggatcatacgattgagattcttaatgctgaaattgctagattaaaatctttgattcctaatgatgataactgtcaatcttgtgaagttttattttctgaaattaatgctttgcgagatgttaattctattaattgcaacaaattggaatttgagattgaaaaatctaaaaagttggagtcttcttttgctcttggatttgctttacatgctcgtatggttgatgagttgattttgacaaagaacgttttgaaaaaaatacaaagttgctttttgtgcgagttctttggtcaatgcttcatgtgcaaataaggcaaaacaaaacaatggtgctttgatttctcaagattgttcaaagtgtgttttgaatgaggtgaagttgaaagatgctttagagcgtgttaaacacatggaagagattgttaaacaagatgaggtgtcttcttgctcaacttgtagaaaacaaaaaggtcttttggatgcttgcaaaaattgtgctattcttactcaggaggtttcttatttgaaaagttctttgcaaagattttttgatggtaaaaagaacctcaacatgatttttgatcaatctaaagttagcacacataatcgtggtttaggctttgatccttatgctcatcatgctagacatcctcctactgttttgggtgttgctaggagaggtgaaattttgattgaaactgagcctaagaacactatgtttaaatctgctggcatcatgtcttctttgaatgcatcttcttcgaaatcaaatgttgtgaatgcaaaaccttctgttgatgcaaaaccatcaatttcaaaaccatctacttcacaaacttgtcgtgagaagtacacttgttcttttttggaaaagatggatatttggttgtttttgttttagacttgcccataaacagaaaaaggaaagagaaattgcttttgcaaaatgacgttagcaaaaatcgggttttaattcgaggaccacggttagaccgacactgaccagtcggtcagaccggtcagtggtcagaccacagttgaaccggcggtcagaccggttggcaggcccggtcagaccgcaggtacagcggcggttagaccggcctcggggcaattttgcgccaaattcaactcagacttttgtgaagcaaaaaggtaattagtctgattctgattttgtcagtgcatttgtacctactggttctactggtcgtgtgactcagtgttggattccaaaatttcttatttctaaccccaacacggaggcctcgacatcttctcgtttgtaggtatttttggcggtatactccccatgagtgttcaattttgagatgacgattgcttctcaaggtaacatcaatttacttttggattgacatatttttggttctactttcttaattattaattcttcatgtgctagtgtttgaggtagtagtttttgttaatacaagtgtatacatgtcaattcatgagaatcttggtgatatcattggcaattggatgtctttttcaaaatctttggtttcttcttgatttttgttcggggaaaattggaggttatattgagggggagttagtgcttattcgtgaatccttttggcatgttttgagggggagtttatacctcatggttttatcaagcaataatatgacaatgaaaaattgcaaaaagagagctttgttttatacatatggtattttcttgtgcatgctaacaatactttaaaggtttatttgtctctagcatagcttgtatggattctagtctttttatgagctttagattttgcttttaagggagatgatgcatgacacttaaattctacttgattaaagtaaatatgcaatgttgatgctagcatatggtttgatttataaatgctttatatatatatatatgctttattgacttgttattcctcaaatagctttaattgctcattgtgaaaaagagaataaaaaatataaaaatgaataccgaatccttggaaacagtcttgacgataaggacgtattcgatgtgagcaaaataatgggtgcc

SEQ ID NO: 21228 - DNA, 4524 bp, Oryza sativa
gagaatgttttttggttcaactgggaatttctttcttttaaaaagggggagaagttttcttttggatttttgagcacgatgtgtacatttgtacaaagtgtgctttttaccacttttgtttttatttttccaaacaccgaaacattttttatgaggtttgccaatgtgttcatcgaggagattgtaagatcaaagtatgttttgattcttattctgtgatgaacaattggcatctgtgattattggttttgatatttggagattattgtcgaagtggttttggagataatcaattttcaggtgatgatcggattcactgttattttatgtgaccggtccgaccgggcagaggttgccggtcagaccggcgctatgtgtgcggtcagaccggctggcccgcggtctgaccggccgacactgtgtcggtttcggtttcgggttgtttatttggatatccaagtttatttcgtgattatgacttctaagtggatactatacgtatgtaatactattgtttgctgctaatgagtcaagttggagataacttagtctcggaatatggtttctttgtttgttccatgtgtaggtgacttgatgtctcgggagagtatttgcggtgatggaccgggagtcggcttggggataagatgacgtctgtggtggtcagagatcttgcgggatacttaggctagagttgatgcacgtggttgatggagattccatatggcatacgatggaggtattgtgtgcgtatgggatgcggagtcgaatttggaaggagtccaaatttggtacgattggttatgtaaagtttatttcttgtactagagggtttcctaaggtgtttaggactcttagtatgagtttggttcgtggttttaggctgcctaccttatgtataaatagagggggagcgtgaggcttcccgaaatcgctttttagagcgtggagttgatagtttagttagggttttgagtttagtcgagatttttgtaaggagtgttgttgttgcactttgtaaacacagagagaagtaataaagttgtcatctactttgaaagttcttcgatttgtgtttcaccgggtttcggcggtctaaccggcaactcaccggtggttagaccggcagcaaggtggcggtcagaccggcggcactagggcagtcagaccggcggcgtaagcaggcagcagcaggcagtctccacggttcgaccgatcgatctacattggtcagaccgacgttcatcaggcggtcagaccagcgcatccacttcggtcagaccgcgatccgtcgaatttgagggtaacttttatttccgctaaaagttttggtttttgggtatatcaaccattcatccccctctggttggcttagtttttgtgattcgatcctacaatttggagtgcatctgcatgggaacatgtgaagttagctttccctgacaacaatctttgcagcagaataattgcaaccacgcggaatgctaatgtcgcaaaatcatgctgctctggttttcaacactatatttacaatattcaacctctagatgagcaagattcctataagctatttctcaaaaggctttctcacacggagtccgattttccttctcacctgggggaattatctcatgcaatcacaaagaagtgtcatggtttgccattagctatcatttgtgttgctagtctgctagctaataaaccagagacaaaagaccaatgggagcatgttcacaattctatcagttcggcatttagttcacagataatgaaggatatactgctgcttagctattatgaccttccatatcatctgaagacttgcttgctgtatcttagtatatttccagaggattactggattagtaaagtagatctgttattgagatggatagctgaaggattcattcctgaagtgaaggatcaggcattgtatcaagttgcagagaattactttaatgagcttataaacagaagcatgattcagccagtcaacatcgactatgatggtagcgcaaatgcatgtcgaatgcatgatgtaatgcttgagctgatcgtatccctgtctgaagatgagaacttcaatacattagtagatgggaaggtgtataaatgttcttctagcaatattcgcagactctccctccaatccagctgtgtggaaaatgatgtgatgcaggatttaatgaacaagtgctcacatattcgctctcttagcttctttcgggaaaataaagaaacacctcatctcccaaagttccgttatctgagagtattgatatttgaggattgtgatagcttaggaaaccaacatattaaatatctcagattcttttgccaattaaagtttttgagaatcaattctgaaggtatcactgagcttccggataaaattggcgacctgaaaaatttacaaacactgaacatacatggaagtaaaattggaaaacttccagcagccataggccatttacaaaatttgttgtatctacatgttaattctgatgttgaattacctgatgaggttggagatctacaagctttgcaggtgctgtcagatgctttctcttataactctattaaattcgtggaagagcttaggcggcttactaagctaaggtcgcttcacattggactacattccagtttaaaactttgttatcatgacatgagaacgtatgaggaagctttgaaatcctctctaactgtgttaggtaaacacagtcttcgatcactagtaatttcacgtgctgattgcctgggtgattacctgatggatctattatgtgacactgtccctgtctccaagtacttgtaatgtatggcccctggaatggcatgctttctgagaggatagcatctcttgataatctgtcttttcttgccatttgtgccagaagcattaaacagaaagatctttgggtgcttgggggcttgccctcactgctgaagcttgagctacatttactctatggccctgatgaaaggctgattatcagcagtcaactattccagtgcttgaagaagttcaaattgaaatatgaattgggtggtggactaagcatggtgtgtgaaaaggaagcaatgccaaagctccaaatgctacaccttcggtttaaagcaatggaaacgaagtccaatacgggtttcgagttgaggctcgagcacctttcaagcctgcggcacctcagtgtcacagttgattgtgatgatgccactagaaggagagttgaggctgccgaagccaccattcggaacacagtgagaatccaccctcgatgccccactctagaaatcaaaaggaagtgggaaagcgatatggtaaaggatgaggatgaggatgagatggagagacgggagtgcactatagaagaggaggaggttcagcatcaggatccataacagtttgtcttgcaagcattcagaagttctgcaaggtattggtttgtcctctatgaacatcgtctttctttgactgaatgtctggtgatgtctactactcttcccgtttcatattataagtcattttaacatttttttagtcaaacttctttaggtttgatcaaatttataaaaaaaattagcaacatctataacatcaaatttgtttcaaaaccatctgtgatggtctacttttacatatactccatctatcccgcatatattattaatcttgcaccagtcagtctactgatggtgactttcacttaaccaccttctcttcatagttttaatcctaggtatcttaaaagtttgtagcaacttgatacttggatggggaaacaagaaaaatcttggttaattatgttgttgtgttaagcattgtatatgaataatagtctctcctgactttgcagaactgtctactactctatccctaaaaaaaggtaaactctagctttgaatctagacacgctggtgtccaggttcgtagctaggattgtactttttttttttgggacagatggggtagactctagagtatttcatgactgatggaattgacagactgactcctaaaaggtaagaatttaaaaaactgttagtctgaaactgagtgttgatctagcatgacttacaacaaaatggaaaaagaaaattccctgcctgatggaacaaaaataatctatgttaaaaaaactaaaaaaaatcaagtgaaccccttctagaaaagtagttaatgacatgtataatgtttattcttggaaaacaaatcttgtttttcttccgaaattggagctttaatagtggtgaaactgctgattgtggttaagtgggatcaggtattcttggcacctaagtacagctggagtatgttgaaattatattatatatcatgatcaaggatgcagactaccctgtagtttgtttagcaaggatataccctgcttttattaattgaaatccataataagagagttttacttggggggagaaggtagggagacccaactatatatcagaatttgaacagaaacgaggtacagaacacatataggcatgaatcattagaagaacagagca

SEQ ID NO: 21229 - DNA, 13067 bp, Oryza sativa
  unsure (1)..(13067): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctacggtgacttgaaagaggtaacgctgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgcgttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaacaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaatcagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagttggctcctcagtcgaagaaacgtcgatcggctgacgcgaagggaccggcggaacctgtcgagggccggcagcagcacgggccgctggcggtgggggagctgggtagtggaaacggaacacggtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaacctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaatggagcggtctggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcacgcgggcggggaagggacgcggtgcacgtgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcgaagcgaaccacggcgatacgggcaatagcgagcacaccgggcggttgcacgtgacaagggggggcgagccaacggctcggattcgccggaggttgctcgacggcggcggattgcggcggcgacaaccggcggcgggagaagagggaaacggcgacgaggtcacgagaggtcgattcccggcggtgagagcatctgcgcggcgtcaggaactcgacgctagcgtcggattggacggaactacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacatgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgtagccaaagcggcggcaggaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcgatgacggcggggcgatttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgagagagagagagagagagagagagagagagagcgcccggggagagagggggccggggaagaggggaagatgggtcgagcgagattcggcccatcgacctcgggggaggcaaaatagacttttgcggaggaatttgattggaaggatttggattcggaattgaactcgatgatagatcggggattgagatcttgagatggcacggacactagacaacaagcaaagaaacaaatttcgcaattagggtttttaagagatgattttcccgctaggcgccacgacggaacgggcgctacaatacacctctccgtgggtggttgatcttgacggtggagatcaaccttattcctgcaagcaaatcgaagaaacaagtaagaacaagataaaagcaatttgaattacagataggaattgaatacaaatgataagttggggctccgtaacgagtaaaccggcaatctaaccgatcacgggattacacggcaaagtagcaaagctaaactttaatctaaacaaaacccaagaaaccctgaaggggtacctaactatttaaagaggtgggaggacgaccaaggggaccctagggtcgtgctccatctggttgggtcgcaccccacataggccccacttgggccggggtcccaaacgaagttacaagcccataggcccattacaggtgacgcaacaccttgtttcttcaattgcggatgattgggatggaatttgacgatgaggctggatccgttggaaagaggactccgagagctttctatcaagtactaggatgtgtcagatccctccgaaatcccgtatattatgggataaatggaatagtatctaagtcacatcttactactcacttggtgaatatatattgtgaatggcctaatgcggctatactggtgtcattgtgtatgtagatccctttctcctactaaggccattcacagtgctccgacatgctgttaggccaaccctcgacgcgtcagagatttgcggctagctaggtgtcgcgcgtgaccaaatgaggtccacggagtctagattgggcattcgttcttctgacaacccaaaggagcacggtgtgggggagaatggcgtggccgcgttgtggaggtcatggccttgccgcttcgagcctccgtgcgtgtgttcccctccccatccctcgagccggcggcagaagaaaaggaagacacaacggtggaggaagaggaggcggtagatcttgtgcctaccttgttgatatcccccctcccaccgtgccgccgctcgtcgtcgtgcctcgctctaagccgccgagcttgtcgtcatcctctgatgtgcgccgctgctcgttgtcgtcgtccactccaagcatggcagcctcctcgacccctccgtagcctcggtggcctccatgacccgtccagatcgaggcgccaccgaggagagtgtaaaggtcgtgccaccactcgttattgttgctctaaactacgggcaccggcgaggagaggggagaagggatttggcgccggcgaggagagtagagaagggagatccggcgagccccgggttggatttggccacgccactactctgcctggtgccgtcgctgcttgggtcatcgctccccgtcgcggcgcggtggactgaggagagcacaagcaacaagcaaggcaacaagcaaccaagaagtcacacatggagaaaatatgaggaaaagtcacaaaagcttgctgcaagcaaccaagaagtcacacccacgtggagaatatcaggtactaccgcacagtagcgtgctacatattaccaacctaaaaaaaatacatcaaaaaagtcaaaaacaatatgaaaaaaaattcgagatgtgaaacactatgacatttgccatcacacaaaacatcaactcaaaatacaatgtgcacaatgagaaaaagaaacaattttgttctccaatagtatttaaacaaatcagttttctattccactgagatttgtcattttttctatgtgtatatgttgtattttgagctgatttttttacatgtcataggtggtgtttggatacagggactgatcctgtcatatcagatgtttgaatactaatttaaaagattaaatataaactaataataaaactaattgcataaataagagctaattcgtgagataatttttttaagcctaattaattcataattagcacatgtttactgtggtatcacatggactaatcatggataaattatgctcaatatattcgtctcgcgaattagttcaggttatggattgtgttttttcattaatctacattttctacttctaatgaatcaaacatccgacggtaactaaaatttagtcctcccatcaaacagccttgcgcttgcacctctcaaaatttttctattctttttttttttgactttttcggtgtatttttcgataaggggactcatctctcaagtgcactgcttctcttcgtctcttcccccatctccggcgagccgtactggtccaactccggcggccaacgacccctcaactaccagctgccccaaaactggatccgtcactgagttagttaccaaggtatatctccccctcattcatatcggcggccggcgacggcgagggtgagaaactgaatctgtacaccctgttcttgcccagcggcggcggtgaagagaaggggcagatggacggagcagcagtgagcgtcgccactggggtgatgggatccctccttgccaagctctctgcattgctgggagaagaacgcgggcttctgaaaggtgtcaagggtgacatcaggttcttgagagatgagctgagcaccatgaacgtctttctgatgaatatggccagtgtggaggagaacatggatgtgcaggtgaaggactggaggaacaaggtccgggaactgagctatgatatcgaggattgcatcgatttattcatgcacaaattgaatcgcggggatgataaggtcaacattgttctcaagatggcaaagaagattagaatgttatggtcaaggcatcagattgctaaccagatccaagaacttaaggctcgtgtcaaggaagagagtgatcgccgtttgaggtactacttcagcgagtgcaatgcacatgtcgacgggactaaaattgatccccgcctaccggcgctttatgttgaagaagagaagcttgttggtatccatggccctatggaagagatcattgaattgttgatgaaagaggatggttcggggcaaaaactcaaagtggtatccattgtgggttttggcggactcggcaaaactactctggctaaccaagtatacaacaaaatcaaggatcaatttgattgctcagcttttatatctgtttcgcagagtcctaacataaagaaaattttatttgatatgcttaaagatgtgaccagccgagacaactctgatgatgataagcaaattaaagttgttggggtcaaaggagataaatccgatgatgagaggcaactcattggtaagctcagagtattcctagagaataagaggtacaaacaaatatcattagctatctctttgattcattgcacgttaatctttagatcctagaaattagtaaatgtgaccctatcatttggtaatgttgtccttttatctatggcataatttttgacatgctagtttaagaccttgcagttataagtattacctgaatttcctgtgcaacagcaaattcttttttggtgcaacagcagatttatatagtcctacatatgtttgttataaatagagcctatttggttgtacaaatgcaataactgtttatggtgattctgctgtagtaaatacgcgggaaaatttaacatacatccgtaacagatcgattatacatcttcatttgcagtgttctttaagtcagagccaacagaacaagttttgtaacttatagatatttcccttttttttcctccaattactgagggagccaatatatattagcatgattttgtattaaaatttctatagatgcaactcagaattaatttataggatgccagtaatgggagggtcagttgtggattagaagtgctgtggccgtgcagcttgaacagttgtcttgtcttggtgtcacagcatcctctgctattggttgtaattagcttcattgcaaataagcattcctttttgatgagcattatgggcttcgtctggtttgaggatgtaaatgaccttttgttctgatctgactaacagaaaggatagaaagaaatagtagggtatggaccagagtgttatttcacaacttcttttgattctaaatggcattctcctaactgtactgttttaacagccccaacagcagtgtacaccatcatttctaatactaagaatgccagttttactcgaaatttacaaagaaaaatggagatccatgcataataaccaaaaaactgtgatagcatctgcagtttggatgtaatgtaaaaggaaaatacatgcaacattgcaattgaatgtaatgaaaaaggaaaatacatgaaacattgaaaatgtttgctggcagagaaatctgaatgtagtgtactagtgtttcatgagtgtgagaggcaccaagtgttagatatagatggctgccctgcacatattatattttctttttaaagttcgaggtgaagaatacttgattaaaattgagcgataaaatgtggtaatattgtatttataacactatatatgtgtattaaatttgtcttccagaagcgttccggataattaaaagtggcataaatatctaatatatacttttagagtggcataatatcttctgcagtacttctcatgagatgtatactgcatttttaagttaaggcagactaataatctcctacatgtacataggtacttcatcattgttgatgatatctggagtgcatctgcatgggaacatgtgaggttagctttgcctgagaacagtctttgtagtagaataattacaaccacacggaatgtcaatgtggcaaaatcatgctgctctggttttcaaggttctgtttacaacattcaacctctaaatgagcaagactctaagaagctatttctgaaaaggcttttccactcagactccaattttcctactcacttggaagaagtttcacatgcaatcattaaaaagtgccatggctttccattagctattatctgtttagctagtctgctagctagtaaatctgatacaaaagaccaatgggagcaagtgcacaattctctcagttctgcgtttagttcacaagggatgagcgatatactgctgcttagctattatgatctaccctatcatctgaagacatgcttgttgtatcttagtgtatttccagaggattataagattgatagagatgaactgatatggagatggatagctgaaggtttcatcactgaagtgaagggtcaaacattggaccaagttggagggagttactttaatgagcttatcaacagaaacatgattcaaccaattgacatcaaatatgatggtaccgcaaatgcttgtcgagtacatgatatggtgcttaaccttatcatatccatttcatctgaggaaaattttctcaccgtagttgacgagcaagggtataaatatttgggtaataagattcgacggctctcattccagtccaactctgttgagaatgatgtgaatgtagttcaaaagatcatggacaacttgtcacaggttcgttcgctaagcttctttgaggtaccagagaaaatacctcctttcttaaaattccattcattgagtgtattggttttagtggattatgatttttgtcttggtaatggacacattaaataccttggaagttttttccaattgaagtatttgagagtcacttcttatggcattacccagctcccagatcaattcgggaacctccattatctacaaactctggatatacgtggcagtggaatcgaaaagtttccgccaaccgtggtccgtttgcataacttggctcgtctacttgttggcaataaagtgcaattgcctgatggtattggagatctgcaatccttacaggtgctgtcttctgctcggttgtataaacccctaaaacttgtggaagatctcaggagattgaccaaactaaggacgcttgagatagttcttcatggcagtgatacacttggtgctcatgagatgggaaggtatgaggaagctttggagtcttctcttactgtgttgggcaaacacaaaattcagtcactcgaaatttcatgttgtgattacttgagagataaattactggatttgttgtgctgcactgttccaaacattcagaagcttgtaatatctggcaattgcataaataggccttctcagcag

SEQ ID NO: 21230 - DNA, 12079 bp, Oryza sativa
ttcaaaaagtttgacttgaaaaattaagacgacttgtaatatgaaatagaggtagtaatagcaagtctggtgtgtgggcatctcaggcagggaatacatgctgtagctgcaacaaatgacaaactccaccttaattaaatattggtttcctttcacctaaatggccaatctattaaacttttacaatctagttctcaaaaggaattgatggtttttggagcagggcagcatggcatttgccaaaaatgactgcacaatatatagcttgttcattttaaactctatgatttattaaccagatcacattttctcaatgctaaccaggtacttggtcattgttgatgatatttggagcgcaaaagcatgggaagttgtcaaatgtgctctcccagagaacaatttatgcagtagagtaatttcaacgacaagaaatgcagatgttgcaacatcatgctgctcctgtttagcaggatatatccataacatgcagcccttaactgagcaggactctcagaagctattttttaagaggatttttggggacaagtcagcatgccctccttaccttgaacaagtctcccatggaatcattagcaagtgccatggattgccattagctcttatcagtatagctagcctgctagctggaaaatcacgtctgaaggagcaatgggagcaagtgtacaattctattggttttgcatttagtcaacaaggaattagagatatactgctgcttagctactatgatcttccgattcatctgaaaacttgcttgcgatatcttagtgtatttccagaggattacgagattgatagagaagagctaatatggagatggatagctgaaggcttcatcagtgaagtgaaaggtcaaacactggatcaagttgctgagaattacttcaatgatcttgtaaacagaagcatgatccatccagttgacatcaagtacgatggcagggcagatgcttgtaaactgcatgatatggtactcgaccttataatttccctgtcaacacaggacaatttcaccaccatagtagaaggggaacaatataaatgtcctcctaataagattcgtaggctctcaatacattcaaaatgtctggaagatgaagtaatgcaggagattatgacaaattgctcacaagttcgttccatcagcttctacggattgcaagatcaggaaattagtcttctcccaactcttaattctttgagattactagcttttgaaaactattggcaccgacatggtaacaaaaacattaaatatcttggaaggtttttccagctgacatatttgaagatcaaatctatcactgagcttccagagcaaatcggagacctgcgaaatctactgacactagacatacgtagcagtagggttgaaaaattgccatcaacaataggttgtttgaaaaatctggtgcgtctacttgtagattataatgtggaattgcccaatgagattggagatctacaagccttgcagcagctgtcacgtgcttccgtagtatttgttgaacagctgaagcggttgacaaacctaagggcgattgacatagacctgcgtggtagcgaacaacttggtgatcatgatacggcaaggtatatggaagctttgaagtcatctcttgctgtgatgggtaagcttcaaatattgcaaatatcctatggtaatgatacggtgataggagaaaaactcatggatttattatgctactcaccatgcgtccgaaagcttgtcatagataattgcatattcagtcggctatcaaagcagctggggttgcttgttaacctcaggcatcttgaaataggggttcgcaacattaagcaggacgatctctgcgttcttggaagcatacccactctgctcttcgtcaggttatttgtaaaaaatgaacctgatgaaaggcttgccatcggcagccatcaattccgatgcctcaagcagttcatcttcaaaaaccacggaggtgggctggagatgttgtttatgcaggaagcaatgcctgagctccgatggttgtctcttgaattcagagcgcgactaacagactgcaagatgggttttgagttcgacttcaagcaccttgcaagcctggagcacctcgaagtctcaatcaattgccatttcgccacctggagtggggtggaggctgcagaagctgcggtcaggaatgcagccagtgcccacccaggatgtcccacagtagaaatcaatagagtctgggaaagttacatggtagataatgagcaaggaggaggcgtgacatatgatcaataactgaaattgcagtttgcaacaacaccttatgtgagattccacttctactgctgcttataatttgcctgagactgaggctaaactgctagccacatgatcactattgatgcatggtaactaagtaatcagagcttccaactcagaatcatcatcatttggttttgtctaattactactggtatgtcaatactggagtagatcttccagattttgatttgtaaacacattgagctttaagatttcaaatgtgggtagcctgactgtcaatgagcacatcttgcttgagttgcactttactcaacgagtcgacgtacactgaaagtctgcaagacattattaatcacttctacaattactaaacttgtctaaatggatcaagacaagaaaatatgcactaatgatttattgctgcaacaattgtaaccgacaaaaaagaaaagatatatcttagagcttacaatggaacactggagcagttggtaacactttatatgacaatatcgattatcagggcagaatgaatatcttgcctgcaaatggagcgtcatgggtgttatcacagtattcagttgtgatgattgttgctcaatgttctttgtttcttatgtatggtacaagtcaaggtaaactagaccaaggtttaatttagtgctttctacttttaattggtgcgccacctgttgcatgttcctattgttgtcattcaacaaagacaaaaatgataaaaatgataattatctccgtaggttcgtttgggtcctagggggctgtcgaagtcaatcttactgaaagctgttcaacgtgtgacaaagagtgtaaaattatgatctttaaaaattttcctccctccgttcctgtatacatcatatttaaaatttaaccacttctattttaaaaacaaatttggagctatttaaaaatataacatattatccaagtatgttcgtgttaatataactgtacaattttggtttaacgaactacaataatttaaaattaattgttggtaaaagttcaaacctaactggttaatagttaatggtgacaagtaatgagagccttccgctgtgttcagaaaaaggttaacattatttttcagaacttctaaaggaaaaacatgatgttacgtggaaaataggtgacaatgccatgtgtgactatgaggtaaagcaaagggaggtgaatagagaactaataaatgattgaattggatggataagtagtttcttgatccaacggttgctatctttataccaatgtgatctgatggtttaaaattgttgatgatatggattcttgcatatctttctttatatgagtaaatgcgttttagtgggaatcaactatgtagtaagataggattcattagagaaatatttgtttgaaaatacattttctaaaaagaatttcttctgtggtaatacttttaaaacttatttgttaaaatattgaatttattcttaaatagataattcacggtaataatcctttcaataatatgaatcaaacggcccaaaactgaatagtccggattcttttgtgtcgttcaaccagaagaaaggttggtttgcgtttcttttttttagttattatatttggactttcttgctctagtcaatctaaaaagaaaataatctctactatttaaaaaatcgggattggtgatggtgaagccaacgtagaggtgtgatccaacctggaaaggtacatcgacacgaaaaaaaaaacggcggacgctcctccgcaacgcgagaaaaaaaaagaaaaaaccccgcacgcctccacaccattgccaccccccaatccatcacccaccgctgccgccgccgactcctccctcctctctcatcgcgccttcccctactcgtaccactgccgaaaccctagacccgcaccgccctcgaccgccacccctccaccgtcatcgcatcccgcctcctccccgagtccggcgacaactattcccaaggttggtgtactccccatcctcttggtcctaggtctctaaatctgcatattcacatgttagtctcatccgtatggtagtttttttttttttttggtttcattgccgtcattggatgaaatacttcacatcttgttgacatttatagtcaatctttcactgtaaaattgtgggtaagaaatggtgtgcctctgataattctttggtgtcaatttttctatgtgattgcttatatctaccaaactgacttaaccttttatttcaaaagatttaatctgtaggacaaaagttcagggtgtccaagcaaagctgacaggacaccatgcataatcgagatcaaattattatttgcatgtgtgacaaaatacttgctctttaattttctttccacccactatagcatacatcagtgatataattgaaatcaaatttttatgtgcatgtgtgtgatattatgggtaccccatacccatacggcatggttatccgactagtcataggggataacttatatctatggaatatgtaatagatcatgactcgggtattacgtttccttatatattacagaacagggtttgataatattgtaaagtagatttaggaaaccgataccgtattggttaaggtttctatcttgtaatcctgcccccgcaccctatataaggtgggcaggaggccctctagggggcatgacacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaattaacttcatgagtcgccgacttcgttttcgcttcgggagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaatttccgacgggacgtcagtcgtcaacttgatcgtttgacatgctgagtccatcatctgatgatgtcaaatctcctggcgatattcaattactaatctaaattggagtcgacatggaatctgagccaatcaataggagcaattttcacgcagggaagtgcagcactcatgcatgtattgcatgtctgtcacaagctaccgatatgatctcctgtccacccattaacacatatatacggaggacactgagaaaaaagctaagtgcctttatttttcctctttatgtgatattttccattgagcaatttttttatatccactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcctccgtcgccgccgattggtgcttccgcctacacggctggcctattatgccgccactgttgggcgtctatgacttcaccgccggcccgcctccgtcgccgccgagtggtgcctccgcctacacggctggcctattatgccgccgctgttaggcgtctacgacttcaccgccggcctgcctccgttgccgccgagtggtgcctccgcctacacggctggcctattatgccgccgctgttgggcgtctacgacttcaccgccggcctgcctccgttgccgccgagtggtgcctccgcctacacggctggcctattatgccgctgctgttgggcgtctacgacttcaccgccggcctgcctccgtcgccgccgagtggtgcctccgcctacacggctggcctattatgccgccgctgttgggcgtctacgacttcaccgccggcttgcctccgttgccgccgagtggtgcctccgcctacacggctggcctattatgccgccgcttttgggcgtctacgacttcaccgccggcctgcctccgtcgccgccgattggtgcttccgcttacacggctggcctattatgccgccgctgttgggcgtctacgacctcaccgccggcctgcctccgtcgccgccgagtggtgtcctcgccgatacggttggttggtcataccaccgttcatgggcgtccacgtcttcgccgaccggctggccttcgccgccgccgactggtgtttttgcctatacggttggcggacttcgccgctgttaatgggcttcatcatctacaccactggcttggttccactggcgccgactggtgtttttgtcaccattgatggactgcttcgttcccacatcggctacttttgctgtcaccgagggaatattacaaagctaagtcatcatttattttattctttatatgatattttgtcttttccttcgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccaatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcatcaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgctgccgactggtgtttccgcctgcacggctggcctttaatgccgccgttgttgggcgtctacgtcttcaccgaccggcttgccttcgccgccgccgactggtgtttccgcctgcacggctggcctttaatgccgccgttgttgggcgtctacgtcttcaccgactggcttgccttcgctgccgccgactggtgtttccgcctgcacggctggcctattatgccgccgttgttgggcgtctacgtcttcaccgaccggccgcctcgtcagccgccgactggtgtttccgcctgcacggctggcctattatgccgccgttgttgggcgtctacgtctttatcgaccggcttgccttcgctgccgccgactggtgtttccgcctgcacggctggcctattatgccgccgttgttgggcgtctacgtcttcaccgaccggccgcctcgtccaccgccgactggtgtttccgcctgcatagctggcctgttatgacgccgactgatgctatcttcttcacggttggctacgtcgccgtcaccgctaatatgcgtcatcatcttcaacgcaagctgtctacgtctgccgccgactggcgcttttatcgtcacaattgcgcgtcttcactaccagtttgctttttcacctcatcacggcaatgcaactttgtcatcatggatttctacttggacatcttcaacacttatcttcaatcaagcaatgactactcgatgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttacttcggagcagacaatctacttcaacaacatcaaatatttcggtttagacgagttggacaacagcatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccaatcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttgataaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatctatactacacccggcggattcaaatccccaaacaggagtagggtattacctctcattgagagggcctgacctgtctaaatcctttgtctctgcatccatccactttaggtctcgtacgctacccccttttattattgccgaattcatgtttcgacaatgtgtgacaaaaagaagttattatctgcacgcgtttctcaattttagatagcaggcctaatcttttatcgagctaggagaagccttgagtgccctggttaggaacaacctggagctatggttgatgaatcatgaataaagagttttcggttctgttgtagctgccagaatggaaaatgcctgaccatagctctgaagatgagtacatcttttgcaagtcttgatctgtgcacctcttcaactgatgaccagcatgaaaaaaatatgattatgattaggctttttgcaagtcttggatttgtgcactttttaattagggatggatggcaatatgccaatatgattgccgtagcttgaggctttgaggttgatgaagggtacagtgcttcttcctgacttttttttttttttcaaaatagctttctcagtgcctttttgtttgcttatgaatttatagcatctgtgtagagttaatgattttatatgtcataaaccagttctttcatgaccgaaataaaaatctaactctgaagctacaattttatcatcgttttttgtgaacctaaagagacaattacctacagatttgtatcaggaaaaacaatctcagtatccttaaaattagctaggtattcagtatgaaatttatatgtgaacaggatcatatgttcagattaatttcgtttaagtatacatactgatattaatttgatgatctactaataagttcgaatgccttagaagaaaataattatgccttttatttattcttctgacacagtccaagtctgtttggagaaggaaacatgctaggaaacaaagtgtggtcatggtccgccgcaagaaaagaggtgcatttcgtactatatatacttcttttctctattggatcatttagtgtgaaaatccaacattttttttggctctaagtgaacagatgtttttttgaagggctcgggtcatgaaaattgaactgtgattatccaatggttattgttattactgttgcaaccggacgccatttgatgttatgcttggacggatgaacacattcagatttattattacttggagacaagatgtcaaatatatgttctggtcatccatgggaactgtttgggagggttgtgtttgcacacgcttttgcttg

SEQ ID NO: 21231 - DNA, 19548 bp, Oryza sativa
  unsure (1)..(19548): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgtaaacccagatacaaatctttcactcactgaaaagttaaaacatcaggtactgggttttttctggattggaattgtatcaagataggactaatttgatcaaagtatcaccccagtctcactcctacaagtagtgatgtccttgagccaacttaggggcctgcgaggcaccatgatactgggatctgacgtgcaatcctttgctcatacccattcattgtctgttgccttggtccactggtcttcatcttctctgagcctggcatggttgccagtatctccaagacctactgttgccatggaaataggggcagcggtgagctggttagaccgttagagcaacagtttggtagaggaaggtggcagctgctggtacttgggactgttaattggatggaaaggtggcagtggcatgatggtggaaagcactgttgcctatgacacttggtgtttacgcagcaggcaagcgagccaatgtgtcctagatggtgcataggcaagcacatttttagggattgcggcaagcaacaatagcatgttatagcatatcagcttcacatgtggacccagtcagtgttgagtgttgggtggacaccaaaatctgatgtcatccaaacaagccttagtgttttacttactaagagtatgttttatttgatgatatatataatttttttatcaacaattacatgcatatcaggcgaatccctgaatcatctttttttagctcaactcagacactcaaatctgagttggactctgacatcagtgtcccagtaagactggacccagttagcaatcttaggctcttagtaagtaataatggtggtagcggcaagtaggcagttagccatgcagcaacagccaagaccacccaagcagcagaaaagagaaaacaaagaaggctaggagtgggctgcctggaagagatggtttggagcttgcaagcggtggctctgtttcaggtgttttaatgacattagtggtgacatcactagtttcagtatggcagtcgaattagcactgaatcatgtcttagtgaactatacacacatcttttgtgacttacatgattggctgatttgtaggtcacttcagcatagctaagcttactaggacaccatgtaactgaaaacaagccaaaaaactatagcggttttgggcgagtgggtgattcttctgcttttatggttgaaaggtgcctaatggtttgtttgtgattgggatttcatttgtagacctaggcaatagtttttttctttaggtgagagtgagtcccatggtcacgacagggagtccacagaagcacctctcacatatgtgtatctagtacatgtgggaggatgctttgttaagcttaaattttatttgatttgttttggattggcatggtcaacataacaaaagaacagttagagacagtgattgaaaattttttttggatgttgtaaatgtacatgcgcagatagttcacaatgcctaatgttgggatgctgtctaatatagatcaactaaaattgtcaactgcctccatcatccagacatgtagtatctcaggatctttcttagttgtttttactttttccaattttatagttttttaatgcgattgtattatcttttgaggatgcatttttgtgcttatatttaacatgttttttcatgcatttaaatttcttcattttaatcgcatggacctcatatttttacatcatagagtataactgtataagtaataactgaacactcatatggtttaactgagtctataacttcattatccatggaatggcatttcactttatctattttgtatttggttatccaaatatactctgatgcttgcaatatcaaaatcctatcctgtggcagagggtgttagctaaggagacagaactgcacttggcccagaaagagttaaataaatacaaggatcagctcaacaatgctgagacaaccagagtgcaagcgttatctgagctggagaaagctaagaaaactgttgaggacctgaccaataagctggatgctatcaacaagtccaaagagctggctattcaagcaacagaggatgcaaaaactcgaacaaagcagcttgaaggtggagactcgcttgaggctgttggaaaagatggccctttaaagcaggaattggatgttgcaagggaacagtatgttgttgctttggcagatcttgatgcagcaaaacaggagcttagaaagctcaagaaggattttgaagcttcattggatatgaggttggctgcagcacagcaggaagaggaatcattgcacttagctgaaacaaacaagcaaaaggctgatcagcttcgcaaggagattgctacaattcaagagtctcttacgcatgtgaaggcagccactgaacaagcacatgaagaagaggctcaaatccttgctgagaaagatgttactaggaaaacatacaaacaagctttggaagaagccgagaagaaattatcctctttgaaaaaggattttgatcctgctgtttataaaagcctcaaagaaaagctagatgagaccaatttggagatttcatctatgcagaaaaagattgaagatgctcgagctcaagatttggagtctattgctactgtcagcacagagttggatgatgctaaggaaatgttacagaaagtggcagaggaggaaagttctcttcggagtttagtagaatcacttaaacaagagttagaagctgttaaggaggagcatgatcaattgaaacagaaggatacagaaactgaatccatagttggagacctacatgtgaagcttcagaaatgcaaatctgagcttgaggcagccgtagctgctgaatcaaaagcaacgtcagcttctgatgacttgatgttggccctccaacagttgtcttccgagtcaaaaaatgccctgcaggaagctgaagtaatgcaaaagagtgctgcagatttaagggatgaagctgaagctgcacgagtagcattagcagaagctgaacaaaagttgcaatctgctttaaaagaagcagaagaggcaaaatcagctgaagcaaaggcccttgatcagatcaagcaactatcagaaagagcaagcgctgctcgggcctcaacatctgaatcaggtgcgaagataacaatatcaaaagaagagtttgaatctcttagccgaaaggtggaggagtcagagaaattgagtgagatgaaagttgctgccgctatggctcaagtggaggctgtcagagccagtgagaatgaggcgattaagaaattggaggcggctcggaaagagatggaagacatggaattggcaacagaggaagcactaaagagggcagagatggctgaagcagcaaagagagctgtagaaggtgagctcaggaggtggcgcgagaaggagcagaagaaagctgctgaagctcagcctgctccagaagcgcaagcacatggaactgcatcttcccctgtacagaaagcttctgctggaaaagccaatgagaagaatgatggacctccaagacagcagaacactattgaaaaagagctttatgctaccaaatattacaagcatgttccataagaagaagaatcatgccgacggcagttctccttcacatcttcctggggacaaatctgtataatctatctgaagctcacgtctgaatgatgtgattccaaacttggaatcatggctttatgtatgatattatatttgtagttgcttgtaatatataatgttatcctggtctatatctatgacttgcctgttcctgactatttgggctcctgtgataagtttttttcttttttgtacctctgaaattcgctgtggttatattgatctgagcagtttgtctgctatcaacagaaataaccacgttttattcatgtcgtgcattactttcagatataatgcaacgttgaagtgttaaattctggattattgaattgtgatttatagactgtcacagttgccaatgaacatgaagatctagatgtgttttgctggagtatcatatattcatctttgaagattagaaagtgttgcctcatcattggcataatcatgtgatcttaggggctaccttgaattttatttgggaggtaatttccccaattaaattatctttagtttcattttggggatagtttctacagttaaattcatatccaatatgtagttcagtattgtctaattcagccatacatcacattagtagtaatttaattggtaacatcatatctcagcagcacagaatacacaaatgttgtgagagcctgtcaggtgaggtgcccatacaagtacacacaacgtgttttctatatgcatgtgaaaattgcaaaactaaagaatgctaatgtcaatatacttcttttatttacaagacgtgcaaaaataaaatgctaggatacatgtaggcgcaaggtgggaggaacctggcaaggtcgctgctttccgatgattttgtcctgcatcattcatctcacataaccaaatggtctgtttcgtgagaattccacaggatcattttgtaagaaaataatgtcattttcccttattttccattggcaatccactgatccaaacagggcccaaaaccttaaaaagtttgcctttttggggagctactgtaagctcacaaaggaggttctgtatccgattgtgaaataagtaaagctgcctaatcaatcctttctagattatatttcaccatgttctcaagagtgcttctgaactcactccttggaagacactgcagactttggatagctatttcacccttctctcttgcaagctcatgagccctctttattccaccacttctatgaactagctctattgcagtagccaaggaatttgtttcactgaactcggaatcaatgatctccctgagctgtggttcatcttgcaaagcgaaaatgaccggggctgttagattaccctttgccaggtcacttcctgcaggtttcccaagttgttcagctgattgggtgaagtcaagaatgtcatcgactacctggaaggagagaccgagattccttccgtattcatacatttgttcacatatagcagtgctgacaccactaaatatggcagctgaccttgtgcttgctgcaatcagagaagcagtcttgtagtagctcttgagcaggtaatcatcaagggtgatgtcacagtcaaaaagtgttgatgcttgttttatttcaccactggcaaaatccttgattacctgttaaagaagcacctttctggatgcaaatcatgcatagttttaaataaggcacaaaaacttgctcaaactcttcattacctgactgatgagctttataacttcaatattttcaaggtttgcaagaaaccaagaagattgtgcaaacataaaatcaccagcaagtacagccacccgtgttccatatagctgatgaatagtttccttccctaaaaataataaatgtacctcagattaaacaggtaaatttcttgagtcccctatttcacaatgacaatagaaaggagttaagtaaaatcaaacaggattgccatataaataacgaaaacaaataacaaaacagtttcgtttttttcttttagagcgaaacagaacagtttctgtaatgcaacgacagcattttttgttttcaaactagatgaatgcatggaggcaaaattcagacaatgtatttctaagaatatgcaggagagtattctaagaagaataaacggtaggcacatgtgtcacaaaaatgaaataacaaagatcggtttttgttgacagttctgttggctaagagagaatggttattactgccagtactgctggccttccataaaaacaacataatacgtacctcttcgcatcccactatcatctatgacgtcgtcatgtattaaacttgcagtgtggatcatctctatgatctctgccaaacgttggtgttctgtagttagttccctgtaatccaaaaatcaaagatcttgagggaataattttaaaagactaaagtatatgataggtgtctaaacttgtgtggtgtcacctaggtgcttgaacttgagaactgcacattcatgtcctgggatttgtataaatgggttaacaaagtaccatatgccattttatggtaattagaaatgacatgtgacacccttagtccaaatcatagttttgttttccaattgaaatcaatagatattaatattttgcaattcgaaggaaaatttcacacgtcactaagatttttatttactttggtagaaattctttagtcaaacttgatttagcagggttaaagtgctgcctgaacattggtaacttattaagtttgggttggatagaagccaatttgcatttctgtaattcggtgacttaaataacacacatgttatggtttagggacctatgagatagtgcactctattccaaactgtcacaccctgattttcgtttcaggatttataaattatttaataaattattaatagaatttatattaaatgttcattaatttacaagtgaagttaaatgtggaaaataaaatttcctaaatacaaagcatggatggatttaatttttattaaattctccatggttaattatactctctggaattttctcggatttttcggagctcaattgttaattttaatcatacaaagagaagttcagcaattatttaaatattaaaataatcattaaatgatctaattataatttttaagagtttttcttgtttaaaaatccttaaattataaattgttgtttaaaaggaattattagaaataattttaaaagtttaaaagagaagatcttttttttaatttgctaaatctcaatataaaattgaactagataaaattttattaaatactatgcttgctcctctattttctagatttttctgggaattatttgagcaagggaagtatttttaataaatgaaacatcatttcacgaattattttaattgaaaaagttttaaaaatcccttcctaagccgttgggccgttttcggcccaactcttctcttccccgcgcggccgaaccggcccaagccggcccagccgacgccgcccgccctctcctcccctcagccgccgacaggtgggacccacctgtcgggtgtgtcttccacctccggccgagcccaagccggccgagatgccgagcccgagccgccttcttctcctctcaaatctgctccaatccgactctttttcttcgggatttttgaggggattttatcctcacatactcctctatcttttccctcaagaatcggagcaaatggttgagtatcttgcccgaatcaaattcgttttcgagtttatctccaaaaccgagttttgattatcttggatcgattcctctcgtttggagtccgatctctctaatccaatgctataaatagcatcccctagtcgtcctctaccgtttgccccaagtcccgagctctctcgtcgcccgtagcgttgccgccacgttgccctagccgctgccgtcgccggcgaccttccagccgcgtcgcgccgccacggtagtcgtcgccgttgccatccgtcgccgccgttaggtgcgcaaggaggtgaggaacctcggccgcccgtcccccttcgctgccgaccaccggagttcgccgtcgccgtccaacccgagccgccgccgcctcttgcgtcgtcgccggccgtcgtcggttgtcgttgggcgctttggtgagtaccatcgggttcgtctcgatgccctctacgcgtaggtgccctccttttccccggccaaggcccctatctccggcgagcttgctaaccctaatcggccgatcgtgggtgacgtcatgctgacgtcatcgtccctttttccttttccttttttcttttttttctaatagtttaaatctttggaaaatcataactaaataaccgtagatccgttttaggtggttcaagttgccaaatttttctaaaataaagatctacatattaaaattgtccataaattgaattaaatttatttagttttttttaaatgggctttaattagatttgatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcatcgggtggtgtgaacctattcctttgttatggccaatttgcattgaatgccctattccttgataccttgggtaataaattgattagcttgaaccttatatattggattggttcagctaaatgctatatgtaagtttgcttagctatgcttagaaacattagcctaactaaagggattaattataaactatgttacattattcttattaattatggttacatttaatggtagctcacgatggttaatcgtgtgatgataattaattgataattaaaacctggttaaggtgggttgtgagcatatggttttgatggttgtgctcatgacaattaaggaccggttcgcgagctactgttgtgaaacattttccgtgccaaccacaagccagcgtgggcaccggctttatctcttgtatagcatgatttattatagtgtgccagactgtgaagtggcgagaagtccatgggggtcgctggggagtccatgcctctggttgtagagggggtgattatgatccaggaatggtgcaccgtggtgagttgtgttatgcaggggataatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctggtttggagttagatctgtacagccgggtatggttgttcaggatggttgggcctgtgcagcatgggtgtgctgttcagtgttgattaaaatttctgattaattactccactgttttgtttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagaaaaaggatccagaaggagaagacgtttggcttatacccagttgagctgcctgtgggagtggagtcggagcttcgctagattttatttttccgctgcagctttcttcatgatgaggactaagtgcctcttaagtaagtatttatttgctttagttgttgatgaatctgtatattaaattgtcagtttgtgtacctcggctgattcctggacgaggattttatgcacaaataagttcggaaattactagtgaatttccgggcgtgacacaaacctactcacatcaatgataatgcagccaaaaggaacttacaataaaccagccaattcagcagttgctctggataccagaaaaactagtgccggtcttaatctttttccaccggcaccaaatatttgttcagccgcagaaactaaaactggattttctgcaccaacaagctattaaaattatgtcagctagttattgtaacaagaacgtacataagtacaatttcctcttgaaaaaagtttaggtactagtatttgatatgtcattctgtgatgtttgatgtcttgcttaagcagacattgatgatctatagaggaaggattggaaaaatgatagtattgtgcaatgtcactactcaagagcagaaaacatgtcaaagctcagcaattatagagaagttgcataaaatagcaaacatggaagaagttattgagtgtgcaaaagcactacataagagctactataaggcatttgctcattcagtctacttctgactcccaacttcccaagcctctttggctgtgtatatcccagggtttacaatttcgatttcggtgatttcggtaggaccgaaatttaatttcgtgattttcggcactttccagaaattttgaaagattttgactggatttgaaaaaactttgaccaaattccacaaaaaattgagaaaacccgaaaatttcggtcagtatattgattgccggtggggtccgaaatttcgaaccgaattgtaaacactggtatatccatttagagatatagaggccagatttctatccattatccaaaaaaacttcccaagcctccattcctcgataactggggtcattagttagttcaaaaggaatggaccattatgcgactctgcactgtttactcgctcctgcagtatattccagtaacactgcaaatgatgggcatatttctttccctttcaaccttcgttgcacattaatttccctcgacgaacgcaaggaactaagaatacattttatttttccagaagttacaaccattaacatattgttcaaccagccaaccaaccaagtacttaaattgtccacaactttatcactaagtgcaaattttttttattctaaaatttatggactaaaaactgtcacagttcgatacatttccaagcaaaatcagtgcaactttttttttttttgtattggactatgtcgtagcaaccgtgagccttgtaccaaatgtgctaggagaaagagaagctattcaatcatacttgtatcatgaacaagctgaacagaatgatgcaaactttgggaggaaaaggtgaagctcaccgatttgaggttgttgttaagcttgagcaagtcgtccgccacaacctccagcagcgacgacaccgaaatgcgctcggcgacgccgacgccggtcgccgccgcgtcaggaatcgtcgcggccggcacgtcaacagcagcaacacctacaccaaagcacacccaactgctcagcctcacccgcccaacaccgccgccgccgagagcaaggcaaaccagcagaggagccgcagagagagaacctggcttgctgggcgagaccacggagcaaacacctggcgcgcgccgcgtcggcggcgccgcgcgtccgacccagccgcaccggagccgctgcggaggaggagggggagaaggaggagggatcgacggcgacgccgcggcggtggcgcggcgggacaggtgcgaggacgacgcgagggaggacggcgccgccatggcttcgtggccgcttgctttgcttgcttgcttgctagcttccgctcccgctccgccgtgcgtcctcttctgggatctcgtgagcgcgacgcggcgggcaacgagaggcgaggggtggtgggtgggcgtgggcgtgggcgggggtgccctggcgtgcgcgcgcggcgacggctcgttttttgtatggcgccgcgtgcacctgccttatcggcgcgcacgagagattgggatagggggccaagcctcgtgctgcggattcgcccacgtcggcgcggcctaccacagcgtggcacatctcgactcttgctttgcggggggaaatatgtagtagtagtaaaaaaaattgcaaattataaatatataggaaaaagtctaaataaccccttaaactttgaatgtaagtccgtttagcaccctgaactttgaaacaggacattcaatcccctaaattttgtaaaaccatttatacaaccccctgaggtggttttgtatagtggtttttatctaatttatatataagttgtatgagtttgatcacatgtcatacactttatatatatatatatatatatatatatatatatatatatatatatatttatatatatatatatatatatatatatatatatttgacttaaatcattttctttgcttcttattagctctcacttacaaacaagtaccaacataataatggtatgatatgatatcactgtataaggataaactaatgacttataactggtgatatgcaaatatattatattagttattcaaaatttttcgtttaagcttccaaaatatgcaaaactatcatccaaaaccaccttaggatgtaatatagatggtatggcaaagttcaggggattggatgtccggttttaaagtttagggtgctagacggatttccatataaagtttaggggtttatttatacttcttccaaatatataaaacggtcaagatttgttcatgtcattataggtaaaacaaatttaatcatgactaaaaggtttacttatagcatagacgaatctcatacgttcatttttttttaattctgcgatagttttcaggttttcattgtatattttccgtctttccttgactagttattttaaacggctgtgcaaaaacacttgcaactttaacaatgaagtggtctgtgtgtgtgagaaaacatggaagcgtagtctattttggtggacctcatgaaattgggaaatttaactatttgccacccttataaatggcaactctccaaatgccatccttatggtggttcttacacaatttctcaaatgccatccaaatgccatccattttctcttattttttccttttcctgatttgtggggcctacaaggggtaaaatggatattttatatggcacatccaagctgacagcatgaggtggcatgccacattagcaaaagtggcaaattattaagaacttttctctctccgatggcaattgtgtacgaaccaccataaggatggcatatggagagtagccattcataagagtggcaaatagttaaattttccgacccatgaaattggtgaaactgtttcttgtttatctttccccgggtcttatgtggcatagttctacatcagtgaaatgttttaaatgcacataaacatttttgtgatatcaaagtaagggaacgcacaccatttttgtcttatatggttgttttttacaaaattattgtgggagcatatgcctgtagtttagagaaatctcccatgttatttgagcattaatctctacgctaagtaatgtaatactgtataatactagaggttggactttgaattgtcgttgtttaaattaaagataataactggaacaacattacaaactggttttcatgtcataaagtatttatatgtaccttacatgtcaaaaaatgattattttaagatattggattaaaccggcctctaaaaagaattatttatatgtatcttacgtatcagaaaataataactgtgtagtaccttgtttatgttccatatcataaaatatttatattacaaattggttttcatgtgacttagaaaaaaagatctactgaaatttactcattcttcattattgtccttagcttgactagcgcaggtgaaaatgtaagaaataaagagaaccagtgcaaagtgcaaaccaggttcttgttgaatccctgtgtcggcacagaagaagctaaaaacaatgagctacaaacattattgcaactgaaaattgtactagcaccgctgactctgttctggtttggacaaggctgtgtggctcaattctcatgttgttcttcacacactcttcattctccactctccagtgttacaatgccagcaattgccacaaattttgacaattttactctctgcaaaaactaattatacaaatgaacggtgcccaaaacttattttaaaaatgacccttttgtttagcgtcaaatcgtgtgccgctgaatttagacacctcagcgctaaatagcgtggcactgaatacacgttgggatgctgactcagactcccatccgcggtggcacgtcattcaacgctagttgacgtggcgttgaggtgtctaaggtcagcgccatacgatttggcgctgaacaaaagggttatttttaaaataagttttaggcacagttcatttatataattagtttttgcaaagggtcaaattgccaaaatttatgagcaattgctatgtaatctttgttttttttttgccaattataatcgatgcaacgatggaacaacatttccttctctcggatgagaagctaaataattgtagaagagatcaatcatggttttctgactttcaagtaaagtgcaactgaagagaggttctggcaggatcacaggctgtccacatctgaaaccttaaagcccattgcttttaataaatcagcagcttaaattcttgtatctgcccacgttctgttatgcatcacggccagtaagtacaaaagttaaatgattaaggttccgaattgaaatttcagacagtatggtacagttcaataacgaacgattacggccagcatttcagtttcagtttcagtcaataatcagcctagattcacactagaattttgtcaggagttttactgatagaatggtattgagaaatgcaactgcagttgttcaaaaataacaaaaagaaaatccatacctttgcagctcttcaggattctgcagaagtgaacctctgtagcggttatcattccacttgaacgatttcctcatgatcatccttatcctttatcatgtcgcgttcccaccttctgctgatctcaagcgcagggcgtccagggtgaatgctggctgcatccctcatagcagcttccgcagcctccaccctctgcctcgtggctcctcggcaatcgaccgtgacactaagttgctggaggcttgcgaggtgctcgaatccgaactcaaaaccgatcttggaccctgtttcctctgctctaatgtagaaacgcagccgtcggagatccggcattgctcacagcatctcaagcccgccaccgtgataatagcttccaaattcaaaccccttcaggcaccggatttgttgactgctgatgataagcctctcctcgggggcatgctgtgaattcaacttgatcaagagttcctcctgtttaatgctacaaacccatagcgaaagatgagtgagattagcaagacacgccatctgctctgggatatgactaatacgcactctgtatatgaccatcttccggagtgtcggaatagtgtgttgagttgtgatccaaattcatttgcacttaataaaggccaacttctgccgtgcacctgggtacgcccgggggtgcgggggcggagcccccgtgaaacggatcgtcattccttctagggttccaccatatatatacctcttgtaagccgccgtgcggcgttgtaacctcaccccagatatagtgaagatattttgctggctagtgcccgtggttttttctcttctgttttgggagggttttccacgctaaaatctcgtgtcttctgtgattgatctattgttttttatcgtttgtttgcctatcgtttcctaacacagtgcagcacaatatgtccatcagttttcctatcaggaatccattgcagccaatgtgtagtgactgaagcgcatgctcacccatcatagcgagagatgacttcaaagattcttcgaattttcggtgttgtgatcaccaagtttgttgctgtcatgcagcattatgcgaagcacacttagcctggtcaaccgcctcaactcttgcacaaattttatggagtcatattttccagcatccgatagctcctgtaaggcttgtagatccccaatctcatttggcaattctacatcattgccaacaagtagacgcgctaaattntgcaaacgacctatggtcggtggcaattttttaattccactatggcgtatatctagtgtctgcaaatacttcaggtccccaatttgctctggaagctcagtaataccatcagaactaatgctcaaatatgccagccggaagaagctctcaagatgtttaatgtgttgtgtaccgataccatggcaattttcaaataccagtactctcaaacaatgaagtgtttgcagatcaggtcccacatcttgtacaccatagtagttcagtgaacgaagctgtgaacacttacccataatctcctgcatcgctttattgcccagacagttggattggacagatcagggtttacgattccgacaggccctttcgtttcgggcactggcggaattcggaatttcgcgaaattcgatggaaaaccggtaaattctgaacaaatttcataaaccaaaatttaaatacaaattccctgagtttgccgacaagttctcgaaaaccggtcggttttagcgaaattccgatcgaaatcattgaaatttcgatcagtaatcttgcccatgtaagtgctttccttttttaaattctttattattttctttcctatgtaagtttcagtaaatacacacaatacatcatttttttcaaaaatttatatcccaataggttgtatgaatatcatagtatttataagattttatttgattttttttctttttttatcaattcaaatttgaatttggatgaaactcctcgaaatctcatacggtttctactttcgagccttgttgaaacgtcgaaatttcgcgaaatctgaccggatttcatcggaatcgtaaaccctgggacagatagcctacgaatcttgttagaacaattgtacccttccccttgcattagagtggtaaaattctcctccttcgacagggatacgataagatcaaggatcatgtcatgcactcgacaagcactcgctctgccatcatactggatgtcaattggttggatcatgcttctgtttacgagatcattgaagtagttctcagcaacttgatccaatgttagtcccttcactttactaatgaacccttcagctatccatctccatattagcacttctctttcaatcatgtaatcctctggaaacatactaagatatagcaagcaagtttttagataatgtgggagatcataatagctaagcaggagtatatccactacaacaaaaccattgttttaagacgttttacttaagtcattctataagtcgtctcttttttataagtgaaattgaaatagggacgatgtttgagacgctttattagttgaggacatagtttaagacgctttatatgttagcacaaaattaaatcgtttagagacgaatattgagacgtttttggaacgtctcatgtgtaagaaatgagttttgagacgtttttattatatccgtgtcatcgttattagataatatataattatttatatagaaaaagagaaaataaacacactgttcctaatcgtcatcatcaaataccattataataatattataattatttggaaaaaaataaatatttaatattcagtcttagattaaaaaagaagagtaccgctacaggacgcatgtttgcagagttgcaatataaaaaaaactatctatttaccttcaagattgtcacgttaatgacttggttagtgcatgaactttgcaacctgcaggtgctgtgttcgagcccagatgaaagcattaatatcaaatatattaagatgtgcgtgcctatataaaagtgtctctatattttatagagatgcaatttacacgtctctagcaacgtcttaaataatataggtacgctttaaaaagcgtctccataattctgagacggtgcaaacagagacgatcctacgacgctttataaaagcgtctcagttatctgtgcgagacaaaataaaacgtctctatcttacaaataagatgtctcctttggtttattttgttgtagtgatctgtcattccttgttgagtaaatgctgaaccaatagagttgtacacttcctcccattgctccacaatatttggttttccaacaagcaggctagctacactgataatagctaacggcaagccatggcactttctaattattccacaagagacttcctccaaataaggagggcatgcagacacatcacgaaaaaccctcttcaaaaatagctcccgagagtcctgttcacttagaggttgaatattgtgaatatgtcctgctacagtgtagcagcatgatgtggctacattagtatctcttgtcgttgtaattattctactgcataaattgttgtcaggtagagcagacttgacaaattcccatgcttttgtgctccaaatatcatcaacaatgatgaggtacctacaaatataagtctagcattaaaatttgtggaatatgatgattttatttggcactaaatatggtatttttttatttacttttttatttttttttatatccaaccggatatatgcaaccttttaaattgggaacttagccccctcaaacaacccaatatgaagttcgctcatatggagatttgaactcaagaccttcaggtgttactcaggtcactgccaccactaagactatatgccctttcacatatatggtacaactatttgagatgaacatgctattgtatggacatagtgtgtctaaagccacaatgctttgctcaatgccatcatgccattgcatctttctttatctatactaattaaacactcttgaaggatctttggtcaccgtaaccctgaaaggataaaaactagaaatgtctcatgttttcttttatacttttatgagaaaatttcgtataactacagatttaaacctcaaataaataaactatactttcaatactaactttatcacaaaactacacatttagtcaatcgtaaactatagaattagaatttatcagaaaattatagtttttaaatgttatccaaaatgcaagttgttcttggctaaatattgtcttcattacaaacatctctactactaatcagaggcttttccattccaaaaagacacctattgatcatatacttaaaaaaatccaagaaatgataagtatcataagatacaaaagaaaatagtagaatttatcatatatatctctatatcatatagcccaaaaatccatctactttagtggccgaacaaggattgtgctaagccccgggccaagaccaatggaggtatcaccagcaaaggatacccacaacactaagacatgaccaaaatagaaacataaattcattgtggtgtactggtgtgatatagacgtaaaacaccaaatcggtaataacattttcagtttttcaccagacgtagctgtagatcttcattccatcagtctgttcctgcaagactntnnttttttttttttttttttttttttttgcaaattgggttgcggtgttggtgcataaaaagatggcaatg

SEQ ID NO: 21232 - DNA, 4916 bp, Oryza sativa
acttattaatagataggatagttgtaatataatagcgactgctatatgttcactgcagttaattttttttttaacatagctagtgttaaccacagtatttttactaaatatatactgcattgtactatctccgtttcattcatattataagtcactttaacttttttaatgcataaaaaatatatacacacatacacaaagtttgtatacgtgtatagaaagtttgtatatgacgcgtatagaaagtttgtatacacgcatagaaagtttatatgcgcgtatagaaagttctatacgtacgaatacaaactttgtatttatacatcttaaaaaaaagggaaaaaatcgaacagaagataaaccggaaaaaaaaccgaacaggaaaaaccggagaaaaaaataaccaaacagaaacgaaaaaaccggagaaaaaacctcgaacagaaacggaaaaaagggggaaaaacgaaaaactcgctccctcgcggcgtgttcgccgccccctctccgcgtgcgacacgtgtccagtcacgtggggagggaggcgcgcgactgatcgcccagtagcaatctcggggttttcgttgttttaagaaaggctctcggtgagaaaaaagagtccgaaaggctctccttgtttaatggaatttaaacatggattacgtttaaattataatatttcgttaaactaaaattgaacagttatattaacatgaacataattggataatatgttttatttttaaataactccaaatttgtttttaaaatagaagtggttaaagtttaaatatgtatactgtctgatgatgtatacaggaacggagggaggaaattttttaaagatcataattttacactccttgttacacgttgaacagctttcagtaagattgactttgacagccccctaggacccaaaagaaccctactgagataagtaatactgcaaaagggaatttcaattatcatttttgtctctgttgaatgactacaaaaggaacatgcaacaggtggcgcaccaattaaaagtagaaagcactaaattaaaccttggtctagtttaacgtgacttgtaccatacacataagaaacaaaaacattgagcaacaatatataatcaaaactgaatactgagataacacacccatgacgctccatttgcaggcaagatcttcattctgccttgataatcgacagtgttatacataatgcagtgttaccaactgctccagtgttccatggcaagctctaagatatcttttctttttttgtcggttacaattgttgcagcaataaatcgtagacgtagtacacgttttcttatcttggtacatttaaacaagtttagaaattgtagaagtgattaataatatcttgcagactttccgtgcacctcgactcgttgagtaaagtgcaacgcaagcaaccctagcctccgcctccgtgagcgcctcggcctcggcctcccccgccaaaccctagctgtcgccgcctccgtctccgactccgtccccaaattctagcctggctgaggaatcagagtagaggtgggatctgtgacatcacagagagggttggaagagacctaggttttcttctataaaatctccagatctgctctgtcaacatggtttgtggtgctcgggctgtggaagaacctgtgttggaggaggtgcagccttgggaaattgcagttgaggagctcagggtgcacctgtaggatattcaacggaaggtggatgaagatgggaagttgtttcaagaacaactgtagaactaggccatacaagctcaagtccacaaagatgaggtaatgcagaatctgaaggtaatccaagatatgctcagtacttcatctagctgcaatggacaagaggttaagggaacacccagaactcctggagtagctcagtctgtaatggaggaaaaaaacctgaaacttttgctgctggtcctagtaaacacccactgtttgatttcagaaatatgtccaattcaccaaatcaggagaatattgagatgaccatgacacccagtttagttactacactacccttaccaccacctccaccaaaccacattcctacaacagaaagaaatacctcagtttttttcaacacaagcaccataccgccgccaccaccaccacactttccccaaccacctcagtacactccacttaaccaattctttccctatcagccacaatatccctatcaaccacatactccctttccggttccttgggactaccactactacccaaacccaccacctcatgtacctcctatatcatctacacctactcacttctgggaaggaggacatggtgctcatcctgaaccataccaccaaccatacaatccatattaccaccaagaaccattccacccaccccaccaccaccagtacaatcctgaaccacaccaccctcactatgaacatcggccacactatgcagaccctgcaaaacgctctcgaaatgtcgattttcctacctttgagggtgactatctggagtcttggatacgcaaggccgaaaaatatttctctttgtatcaaactcctgaggaagacaaagttttgctagctgaagtgcacatttcaggaagagctgatcagtggattgaaagtttagctattgccactgcttctctttcttggcctgaattcaaaaccatgttgtgtcaacgttttgcagccaaatccaagattgaaattactgaaactttcagaaatttgaaacagtatggctctgtcgacagttatattgataaatttgaggacaccatgaccttagttaaacgcagcaatcctacattgactaaggattacttcttggattattttatctctggactcaaggacaatattaaaagacctctgaaatctctctcaatttactccctggtgactgcttatgaacatgctcgcaactatgatgttatccctcgctctgccaacacctcttctgttccttccaacagaaagactcccaaaattccaccaaagcaacctatcaaagacaacaagcagtccgctgtcactcatacaaaattttctggcaagtatttccgttgcaacgaaccctgggtaccaggacatggcagagtctgtaaagctaccaagcaagtctatttggtcacaatggaagatgagtctgaaatcctagatgatgcagcttactctactcctgacagtccacagaagactgatcaacaggatacacatctgttattacactccttggagggcaccactcctgctgctactacctttacactatatgttctattgggtaccacataggccacagccttagttgatagtggtagtaccactacattcatctctccgaagatagcaagtaaagctgggttacatatggctaatcatgcacctataccagtcagagtggctaatggcagtattttgaatacagggaccgtctgctctcaggttccttattctattcataatgtctcttttatctcagatttcagattgttggatcttaagggctttgatatcatctttggctgtgattggatctatcagcatagcccaatcaccattgatctcaagaccagagcatttacaatacatcacaatgggatgcagtcaataacctttcctgatattacttttcctcggtccaatcttcttctcacagctgataacttgcagaagatgttgcacaaagatatattaggtgctgtggtgttccttccttatccacaatgttctgcgcttgctctaactgcaaccccaccagaggtaactcaagttttggacaaattttcagatgtttttgctgagcctactcagttgcctccctctcatgagtgtgatcatactgtaccattactcccaaatgctaaaccagtcaatgtaaggccatatcgtcttcctcaccacaagaaaaatgccttggaagagctagtgcagcaattgttgaattcccaaacaacagaccaagtatgagtccctactcttcccctgccattctggtaaaaaaaaaaggacggttcatagtgcctttgcattgattaccgtcaacttaatgctaccacggttaaaaacaagtatcccattccagtcattgaggatctcatagatgaattacatggggctcaatacttttctaagattgatttgcactcaggttatcaccaaatcaaaatgcacccagctcacatatataagatagcctttagcacacatatgggccactttgagtacttggtgatgccttttggactaacaaatgcaccaaccaccttccaagctctgatgaacagcattctggccccttatttgtgcaaatttgttttggttttctttgatgacattctcatatacaatccatccctatctatccctatctgaccatgtaactcatgtcgaattggttttgcaacttttgagacagcatcatctttcaaccaaaccaagcaagtgtgttttcggccagtcacaagtggaatatctcggctatattatcagtaatgaaggggtagcaattgatcctaccaaagtgcaagctgtgaaagattggcatgtatctaaatctgtcactgatctcagaggattcctaggtttggctggttactattgtcagagttatggataccacatacctaatagtaattgactaaatcttggcaggacccaccacataccatgtcttatacgggaacaacctcagatataggaggagttccgcataaggaaagacaaccagagttctacatagaaacgacaaggactactcggattgtatccatattggttttcctagttctacttggacaaggggacacctatgggtataaatacaaggccccctaggaggggaggggacatggaacaatagatcaacatacaaacctacatacgccaagacaaactac

SEQ ID NO: 21233 - DNA, 1891 bp, Oryza sativa
atgctgggggctcgctttattttcttatgcataaatcatgcttgtttgcggtttacataatgcctgatatttaatttgctcgttatattgtcgggtcccaaaactaatgattcggtaactgacttattaaaactgtatcaagccctggatcagtagattgatacaggttcaacaatctggatcttcatagcatacattttgagatgttattataaaataataggatatttacaagtttgtggctaactattacagtagaagctgtaggatgacccaattctaatgttttgctatagacttaaactatctatctaatatatgcttgagaactaagttagaatgagactaacttatacgattgaactcccagcttcggcaagactccaaattgactctgaaaagggggttgaggcaagggtgagtacaacgtacttagcaagctatattatattaatcaacaatgaatgcatgaaatggtaatatttgagtagagctaagtttacttgcagaaggctgagaatatagaggaagaaagcctgtaatgttttagatgcaacagtatttaataaagtttggaattaagtttctaaccaaataccatatgagtcccaaatgcttaaatccgtgagcacggctattcgaatagattcatttatactttactgcagtaaatgtacgctttacccatagcccacgacgtgccgataatcatcagctttagtcatggcccagcattaggttactaacaatagtggcacctgttccatgaactctagtccccatacgctctgaacataacgttaacagcaccgagaggagttctggcgttcccggggtatttagagaggactgattgtatgacaccatgtcatcgcaatcagggtttacaaaatcacatggccataatatagtcccctggactatcactcaaagtatatttacctgcgcctcggtaaatatcataactgccctgctcagcataagttttcctcctgcgcgaggacttaaaaagaaccactgtacataggtaccaccttgttaaataacataataactaggtctgttcccattctagaactgtggtcgtactcgtttgttcttcacaagtatttgggcagtcttatgtcggttggaacaatactagccacccagaaattaaccattttctaccgtactgttccaatcgtttgttcttcacaagtatttgggtagtcttatgtcggttggaacaatactagccacccggaaatcaaccattttctaccgtactgttccaatctaagttcgttatattttatgcaatctaactaggcagggctaagcaaaagctagcatatctggtttgctatattcagtttatacaattgaaatcatgtatgactaatgcatagaatagagatataagaatatatgatcattatgctcaaaggggaggaataataacttgccttgctccaacgcaaataaatccaagataagcaacctgattatccgctgctcgaaataccacgggttgtcatccaaatataatagactctactgaaaaagaggaagaaccaaattcaataaacgccataaaatagcaagaaagagataaacggttaggagggctagggtttaagatatagccgatctcctttatagagcattgggattattggactagtatttcatgtatgggttctaaagggttgaaggttaaggtggagagtggatcaagcaaactaaggttgctcataatttatgtgaaggctttgactggtgaggggataggatgtatattggatatttgaactggtttagatggtatatggctagtggtaggtttaggtagtataatacctaaggtttggttatatggaagttgaatgtggagtaggataacatatcg

SEQ ID NO: 21234 - DNA, 9684 bp, Oryza sativa
ctgcagccccggaatcggatctacggtttgggagatatgggcttctaaagattggattttgaattaaatctagaaaaatgcgaaaatgtactgttggggggcccacctgtcaggcaatctcctttttctttttatttttctttctcttcttcttcttctttttcttcttccttctttcttctcttctcctgtttcttcctcccgagcaacaagagagagggagagagagggggcgccggtgctttggtggtggaacggcctcgacggcggcggcaaagcgtgttcccagatgtttcatacctaggtaaggtggtggccggcagagagagtgagaagaatggttggaacgccggccgcaagagcttggttgaagtggccaaaaggagaggcgatggtggcctagctaggggtggagggagaggggaaagtggtgaaatggattcccctcgttgagacgaagctattggcgcaagggtttggccggtattgcttcggtgagggagatcgggcaatggccggcatgggaggagagagagagagagagctcggggctcggcttggtggggaggaaaggagaagtgctcgccggctatatatagacggcgaggggcggtgatcaatggcggttcaggaggcggacgacggcttggccacgacgacagtagcttggaggagaagaagacggcgccggcctcgttttccaattggtcgacgacggcggcgcgtgcacgtggcggccgcggcagggctgggcggcggcagtggacaggcacggcacggcgacggtggcggcgcgacttggcggcctcggcaaggtggcggcgacggcgcacaaagccgtgggcggcgacgccatggctgtgggcgacggtggcggcgccttgcgcgcccacagagaaggggaaggaggcggctcggctgggtgttgggccggcttgggctgaggaaagctaaaggaggaaaaggggaattcggcccaaacatagaaggaagaaagtctaatatttcatggagactaaataatttgatttagaggagaatttgtatttggaaggaatttgactagaaagttttgaaagaaaaatatatttggagataatttgaatagggaaggttgaaaggaaattatatttggatctaatttccaaaagagatattttctagtttgagtgcaatatttttagaagtggaatatggtggaatttaatgcactcaaatgagaggggaattaacaatctaattcctcaatatatatatgtttggaggggaatggttggaggtaaaataaataggatttgaatcctaaatttgatagtaggagtatttgaagaattatttgtggctaatagagaatcaatttggaagaggggaataaaataaaaatctattcttcttagcacaagagcaattattcacaatgtttataataatattattcttgtgctgagaagaaaatcaagtcacagaaattaaattggtagcttgatcaaaaagaggaatttggatattttgatcgagaatcaaaggatgggttaacacttaattctaatggaatcagaatttcggtggtttaggttcaagggtaatatgggaaggtttcttggaccataattcttaagagagtttttaaaggaattttgcaaaagaaggtttaaggtgcaaaatcaaatcaaagtaaataccttggtttaataagatcaattttagaataaaaaccacgaaagactttaaatagcaaagagagattctacgcaagttaatttttcgaggtctctctaattatattttcctaggtttaaaaagttaataagaacataagaatcagcatgatgcaagattagaaaatagtaaattttcaggatgttacatatatcatgataatactagaagatttatgcaagtttttgagtacatactcgatattctctgctatataacttgtcttctagaaaatatttttttcaggaacaattgagcactcgagtaggttatggtcgagcacaccccattatcgagaacgttctcgacaaatgcagagttgtcgcacccaacctaccaacgaagaccgacgacctatctcatagcgccaactatggctgggctattcgagaaaagggttgttaacggataattgcttgcgaacgatgtcggcttgatcactcgacatgattgcaggtggacatccggatatgctacgagttgggtatgtgagtcatgctagtcacatgagatgcacatgtaataaaccaactctagcgtccccatcggtgttcgagagataattctacttgctggttctcgaaccagtgaatcgtagcaatctctcacaccgcaacttccatcggtgttcgagagataattctacttgctggttctcgaaccagtgaatcgtagcaatctcccgcaccgcaacttccatcggcgttcgagagataattctactcgttggttctcgaaccagtgaatcgtagcaatctcccgcaccgcaacttccattggcgttcgagagataatcgagaactagtaaattgtagcaatctctcgcgccttaatttcagatggtcgaggtacgactacggcaatagcgtagcggtcctcgcaccacgacttcagatggttgaggtacgactacgactggtcttcaaccaacagcgtagtggtcctcgcaccacgacttcaatcggtcgagagataaggctactcctggttctcggaccagtaggccatagcgatctctcgtacatcgacatcaatcggccgagagatgagactactcatggttctcggaccagtaagctgtagcgatctctcgcacctctatttctagtggttgagttaaggctacacctggttttcgaccagcggtgtagcgatactcccactagctttacttctcgtggtcgagttaaggctacacctggtttttgaccaagtggtgtagcgatactcccactagctttacttctcgtgaacgttgtcggcttgatcacccgacatgattgcgagcaaacatccggatatgctataagttgggtatgtgagtcaggctggccacatgagatgcacatgtaacaaaccaacttaggcacccctataggtgattgagagactccttctcctggttctcaaaccagtaggacgtagcgacctctcgtgacttaacttctgatggtcgaggtacgactatggcaatagcgtagcggtcctcgtaccacgacttcagatggttgagggataactacgactggtcttcgactggcagcgtagcggccctcgaaccaactttaaatggtcgagagacacctactcactggttctcaaccagtcaatcgtagcgatctctcgtacatttacttctaatggccgagataaggctacacctggttctcgaccagcggtgtagcgattcttccactacttccacttcaggtggtcgagttaaggctacacttggttctcaaccagcggtgtagcgattctcccattatttccactttaagtggtcgagttgcgactactacctggttctccaccagcagtgtagcaattcctccgactacatccacttctagtggttgagttacgactactatatggtcctcgaccagaggtgcagtgattctcccactacctctactccaacaaagttgatatcaggtacacgatattgccaagtgttttacccagagatcccttgccacgacgacacctagagttgaaaccaatcctactgtccctttatgccgtcctggcaaggcctctgaggaacctaagggaacttcggctggggacgtccagagcggataaggccttgtcggatcatgcagagacaaactaccatgtaagatctggtcatgtaagagttctcaccgtgcgtattaaccaagccgtttaatcggaaattgggtttttcaacttcacggctgggggctagggtaagcgttttttcaaccaaggcaggtcaagggtccaagagccttatcctccgagaacgattctccgacgacaaggctgggggctagggagagtgtatgactatattgtctccatctcttttacctcaatctcgcatatactctggtatcaacgatccccatactatgcaaatactgaaatcacgatatcaaacgtcgacaagtatcgaaagttcaataaagattttggtcttattggcaaaccactatttactgccttgaagaaaactggattcacttggcaagatgagcagcaacaagcctttgcaacaatcaaggataaattggctcatgcgccagtccttgcaatgcctaattacactcagccttttatactgctagcagatgctagtggtaccggcctgggtgctgtcttgatgcagaacaacagacctttggcatattttagtaaagcaattggtcctaaagcagctggactctctacttatgacaaagaagcattggctatattggaagcagaaaaagtggaagcactatttcttgggcacttctctgattattcgaacagaccaagcaagcctcaaatacattaatgagcaacgccttacaaaagggattcaacataaattgctaatcaagctcctcaactacaattacaaaatagagtacaagaaaggcaaagaaaacaaggctgctgatgccttatctcgcataccttttgttgctcagtggttttctaccactattattgttcctacttggatcattgagatcctggcaagttatgcaacagacccgaaatgcacagcattggaatctcagttgagaatcactcctcagggccatccttcttatactctgactggtggcatcttgcgatataagaatcgtctctatgtgggtgctggtactgatttgagagcaaagttacaacaatctttccacgattctgctctggggggtcactcaggtgaaagagcaacctatcaacgtgctaagttacttttctattggccaggcatgaagaaggatattgcctcatatgtcaaactctgcccagtttgtcagaaaaacaagtctgaacataatctgcagcctgggttacttcaccctctgccagtccctgagatggcttggacacacatttctatggacttcattgaaggcctccctaaatctgataacaaggatgtcatttgggtcattgtggacaggtttaccaaatatgcccattttgttgcccttagccatccattcacagctgaccagatagttactcaatttgtggaaaattattacaagcaccatggtcttccggcagttattgtcagtgacagagatataattttcactagtcaaacttggaaggatgtttttgagaaagccggggtaaaactacattttagtagtggctatcacctccaaacagatggacagaccgaaagggtcaaccagtgcctggagaattatctttgttgtatgacattcactaaacccaagaagtggaaatcactgctggcctacgctgaatggtggtacaatacatccttccacactgccttgggcatgactccttaccaggcaatacatggggtcccacctcccttgctagctgaatctttgctatctccatctcttttcactgatgctcgtaacaaggaagaagcaaaatctgtaggatcgaatcacaagaactaaaccaaccagaggggggtgaatggttggtatacccaaaaaccgaaaacttttagcggaaataaaagttaccctcgaattcaacggagatcggtctgaccgagattgatttgtcggtctgaccgtgtggatgccgccagtctgaccggtatagatcacccggtctgaccgccgatgtcgcctgccgcgcctgtcgccgccgccggtctgaccgcccgtatgccgccagtctgaccgccgcttgccgccggtctgaccgccagtatattgccggttggaccgccgaaatccggtgaaacacaaatcgaagaactcttaaagtagataacgactttattacttctctctgtatttacaaagtgcaccaacagcactccttacaaaaatttcgactaaactcgaaaccctaactcaaaactcaactcaattgctctcaaaagcgataccgggaagcctcacgctccccctctatttatacatgaggtaggcagcctaaagccacgaatcaaactcatactaggaatcctaaacactttaggaaaccctctagtacaagaaagaaactttacataaccaatcgtaccaaatttggactccttccaaattcgactctgcaacccatacgcacacaatacctccatcgtatgctatatggaatctccatcaaccacgtgcatcaactctagcctaaatatcccgcatgatctctgaccaccacggacgtcgtcttatccccaagccgactcccggtccatcaccgcaaatactctctcgaggcatcgagtcacctacacatgcatgaaataaacaaagaaaccatattccgagaccaagctatctccaacttgactcattagtagcaaacaacagtattacatacgtatagtatccatctagaagccataatcatgaaacaatcacggatatccaaataaacaacccgaaaccgaaactgacacagagtcggtcggtcagaccgcgggctggccggtccaaccgctcgatcaccgccggtctgaccggcatacacagcccggtctgaccggtcacatgaaataacagcagtatcctgtagattcacctgtaaaatccaatcatctccaaaatccacttcgaaaataaattccaaataacaaaaccaataatctccaatgccaattgtttatcacagaataataataaaaaacacctttgattttacaaaatctgttattactgctgatatcaagtctagcctcctcaaagcacaagcacgtatgaagcactttgctgatatgaatcgtagtgaacgagtactgactgtcggcgatatggtttatctcaaaatgcagccttagtgtcacaattccttggggttacattcttccttgaaattgcattctaaatactatggcccgtttcgtgtcttggaacgcattggctcagtggcttacaaattgctgttaccggcatcttctcaaatccatccagtctttcatgtgagccaactgaagaaacacatcggtccaaaagtggttcctgaacctggcctccctctcactgatgatgacggtaacattctttctcagccaacggccgttttggaacgcaggctgattcctagaaacaatgcacctgtggttcaatggaaagtccaatgggggaatctacctccgtctgctgcaacttgggaagatgctgctttcatctccaaagtgtttcctgcttttaacccatgaggacatgggtgcttggggggggggggggcaatgtgagaactctgacgaagtgaagtcatgtttgaacgctggaagagaaggcaagttcagttatccaatggctgggattattcgataacgcttggggctggagattatgaagatcggacgatggagatgcgcctggaccgtctacagcacgcccctgttgccgtactgttgacatcatctcttttgtctcgttgtattagcgaccccctttataagctagcaccgccgcaatgtctgtatcgaacaattgaaccctaaattactttactcttgtcttgcggtgcccatctatttccttatactgtttactcttcaattcagtgcaaatccttcaatttaatcccactagggtagctacttagcctcttttctctgaaattgttcttgtcaagctctgaatctggctggggcttgacatctcacgctccgccgatgccgccaggtgccgtcgttcaagatcataccggcgaagtcccacgctgagtcaccgcgacgtgctcgatgtgcgccgtgatgtacctgccaaggtcgtcctcggcgattgatctgcagcagcaacctcatctccaccgcacagtcaggcatccacacaatcctcgccatgcgcgtcctctctgcgtcccgccctgtcctcacagtgccgttcagacgccgaaccaggttagttcatcactaattcatgcttcgatcccatgccattccatcgaaacattgatcaattggcttctcagataactgacttctcatataattgatgcaaaacaaatttcttgtttagatattacttgcctcgcctaaatgtagatcaaacgcaggatgctcaacaccgcaattgtccgccgggacaggtaaatactcaccaatattccttttgtagtgctaatacaaattcatatatagtgctaatacaactgcctttctattatactgctaatacaaattctgaagcaatcatgtagaacagaaaacacattttcgtatgcctctcactttttcccaaatcaatattttttttattactccaaattcatgatttgtcgcctattagagcatttcaatttattctctgaacagttaaaagattgcttatttactgcaaaaaattgggaaagctgaaaaggtctgcttggtgacattactatcatttaaaggcacaggaattaagaagaggaaaaaggattgggatcggcacttcgctcagctgagcagaaggcctctgtcctctctgaccgtgccacagcgtttgggcccttttgttgtgccgttttcctgctctcttgaacgtatgcaagctgttcgctgatttgcctacaccaggtcagctaaactgcaagtaacccacttattatgttatttggtactctcagaccacatatacattcttccatctatgtcggttcagccactgcttcatacttgctttgctttgagttttgtttgctctgatctgactttcacattgtttttgtgcattgaagactggggcttgcttctgtagctcaacttgattaagccacaaaattatgcgctttgtatggcaaaagcaaagcactttgttgtcaggggttgttttaaataataatggatctcctttttttccagccttgaatattgtcatgttgctggaattgtaaccggactcacaaattctccgctaatgaggtaatcatgcacttctcccccctattaatattttttaatcatttcaggaagagaaatagataattgttgcatgcatcctcagatatcaaagatcaggatcaaattttcatcctgctaacttaataacccttgtcctatcaatgggctatctttattgcaggaacgttggttgtgtttcagtcaaattttatagctcaccaagcaatccagatttctttaaagctcgtaatatattcaaaaatttataacttcttttcctgccgccgaacaggtgctttcctttatgcctaattgttcacttccgcgttatatatctctaggtattctgtgttcttacttgaacaagtaagttatgctgcagaatatttgggaatttgtggtacttgttatacctgaagtgacccttattatatagcttatcttcaggccacatcacattaagttcagccaaatatgagcataggtctaactttgtgccgccaccaccatctccaagccggcggcaaggtctcaatatcgggacgagtgcggcctttatgcaggtcacaagcagtgtagtaccgcctcggcggcagtcctatgcccgtcgggactggcatcttcccgattccgacgccaatggatgcgtccctgctcgcgattcg

SEQ ID NO: 21235 - DNA, 19630 bp, Oryza sativa
aatgtcatatacatatactccatgtcaattaccttgtgcaaaactatttcgtcccaatagtgtttttttcctgtgtatcattgatttcagttgattgtgatatcatgaggacacagccatgaaattcagctcacttggtataagtattcattcctgtttcttagagaaaatcaaatgtacatttattaaaaattgaaagctgggggcgagcaagccctacatttttagcttttaaccttatggctccagcaatttcgattgactgtaattttgtttagtttggtatatgtcctgattggatagcctctgccagctgagtacttctgacagaatcaaacattgatgcctgcaatttttgtggcttttgtcattccttgcatggttgacactcttccagtcagatggtaccgtggcttttctgtattttgtgatggtgaaagccccagtgggaatgtgggatgttcagtactagcattgtgtgtagtttgtattcatgctacaaaatgcctctcaaggttctatctgaaatttagatggagaaaatttatactggttacatttcctataggagtttcaaaaactgatatttgaccattgggcatattaattctctgtaggaatataaaatatctatctatatgaattttgattccagcggatccttgaatttgttgttttgcaatgtggagagtagataacagacttaataatcattggttgtacatcatagatcccaggaaatattggatcaattgtgaggacatgtgtgcagcattagcagttgggctgcatcttgtcggggtaaggttagtttatattgatagaacattgaattatatttcttcattttcctttttatgttattcatctggtacacatgttgtcttccagttagaacttacaagtgactgaatgtattttcggcacacgtgatctagctaggtgatactgggatgtgttttgccaactgatcatgtatgagttcaaagagtaaggtggatttgttaatcacaaatgaaaatttagggtgcatctcaagcattggcgtgataaaaaattcagagaagagtaaaactgatggtgagataggtaattttggttccctgtattgatctttcattactcaccgtaaaagacatgatggtaaaaatatagtttactcctaatggttcaaaaaagttctggatgcattgcatggcgcacaatcctttgattcggcctaataattgtcataggagttgactaatagtaatataacctaattttgcattatttgtactattattttagttttttaaataaatgttttcctttgatgggtctatttctaaatgcagagagtgcatgcttatccacagtcaatatatgcagagaacaggttgattatatatgaaattccagtggaaatttctcgagggaaatttgacaggccagaactatttgtatgcaaattgcgtggcgaaatttgaaagatgttatatacatgtggaattgttaaattaatttttattttgttaagcaacgtgagatttgttagatttatactactccctttggcaaaatcaatctactatattgggcaaaaattttgtgacgtttgaattattttgtcttcggggtgcaagtttaagcataatttttttatgctaaaattttacggtataatgaatttatttggtaaatcatttagcattcacacaaatacatataatatctttgcttgattatttggttttcaaatacatataatatttatttgattattcggttttcaaagaaatctgaacacttgtattgccaatgttatcttttttgggtcatttagtttgcaatacaaaatatcatcgtagcgttagtacggacacattactagtcattagtaaggaatccaaggcacttaatcaccattaggtggtagttgtgcatttatcatatgcagcacttttgctgtgaattacattctggactatatctcatgagttttttttttaccgtccttcgtatctactgatacctctcggtgcctgttatctcgtccgtccgttcagctggatccaagagcctaggatgcaaggtacctgtcggcacagctcctaacaggtacctataggacccacgtagtgctgtcatgtggcggcgcggcgctgctttcccgctttccccttctttttatgtatttttcctaattttgttcttcttttttttttatttttgttcctctcgtggtgcggtgtggcacagagaggcacgcattggcggccaaccattctggaaatccctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatgggcattcgccggcgataccaagtcagctttggtggatttctccgggaatagtaaaaatggaacaagggttgggagcagagttcattttcgcgattatatcagcgagatgctaaaaaaaatctacaaattcttactcttcttctactttggtctacagtaacgtattatgcaacccctcctgctataaagtagtcttaaagctgtgttcgctagttgaagttgggaacacttctctcattgcacgcaaaatgaaatgatggtttagcgcatgattaattagtattagctaaaaaatcttgaaaaatagaatgatatgatttttaaggtagcttttgtatacaaaacttttgaaagaaatgacaaaatttgctacaagacactcaaagaatatagtctttgttgcgggacaccttaagaatgtgaatttgctcaaggacactaaaaaaatatggtaatttgctggtagacactatacacattattttataatttcctgctatttaggagagaattttcacaaaatggcacctttgcccctgagacaaatcttcgctgacaggatcaaatccggtcgacttagcacaaaatatggcctcaccgcccgtcgctgtgcccatatccgtcatctgccacaaccgtttgtcgcggtgtgttctcgccgaggacggcaactccgtccattcgaggatggaggtctgtgttgacggttgttatcaaccaattttgaccgtcaatattattcaatcaaagaagaatagctatgtttgtaatgcataatttccaaataaaatatctacttccactatgtgctatgctactaacatatgtgcaggagaagcattcataaatggaggagaatcgacggaacataaccgaataattaatcgaaatccgtcagaggcagacttatgggtggatgggcctccaaacctattaagataacttcaattgggccaaaccaccgcaccacttgactgaggagtcattaggagacgcacctgccgtactataggccaattgggcaagtccaggtttcggccgaaccctgatctcagccgttggctctcccctttggcttggatgctccagatgcctccccaatgacggttgcagggtatttccgacatttccaaaccgctgtaaccgtcaatgggagtctataaaaggacctcacctcctcacttcatccacacactcaagaagaagatcaaagagctctctctcaagtttagttagtgctctagtgctagtggagtagaaatagaatagttttcttagtcctcgagtcttttggagaatccggatatggctctagaagcttctctctcttcttttgtaagacttatcaaattaatagaatattcttctttatacatctttggtattttattttctttatattatctgagtatcgattttattttatacttgtatcgatatagttgtgtagcatggatacagagtagtatttaataatgtaagcatggtgcttagatcattaagtatcattatctggatatatatgctgcgggacagtagaggtgggccactgatggtgacagctcagtacgagtattcctccacgttagtatatattcctaagaaactttcctaggaagggtactcctccgtatttaaccccggttggatagccatgacaggttatcataaggaactcgacaatcaggggtggcttctcaaaacactaggagggcactgttaggggtattggctgcatgactgtatactaggaagtgtaaactaaaaatgattgtatattagaagtacatgaataaattattttcttattctttctccacttagtttagattatattttagtgagagtatcttagttcttttttctgtgtgtcacctttatcctaccttttgaattatttaacccctgcatagtccttgatgtatacaagtaatatatataaattattagcatagttctctcttatcatatcttcccttgggattaaataaatacgataccttggaatacttctgggtgaaatgatacaatgttatatccgtgcgcttgcggatcatatctgtagccataaatataccaataatattttgacgtcattactgggaattatatttctactaatgtcgttaagaaatatcaacagtctggtcgagcggggagggggcatcgagcgcactgacgacagaaacgaggaacacatcgaagaggcacgtgggggtggcgggagatgcagacggcgatgaaggtggtacggtcgaaggtgacgcggagggggcgcactagcgcgcgtgacgtccggtcccaatggttgggcgcaatcatgaataacccgtggctgcacaccgccgcctttaggtcgaacgatgtgacattgggggagatcacgccgcccagcgagagctccagctccacggccgcgtgacgctacagtcgcgcagtcgctgccttctagagacggcatggtcggcgacggcagggatgccccctccccatgcgtgggcggtgtatggcggcgaagcggtgtaaaatggacaatttatgtggtttctttatcctcagctaactgaatattatattttaatgctcatggtgtactctggtaaattaccatgtttttcgagtgtcttcagacaaattcgcgtttttacgatgtctctcagcaaataccacatttttttagtgttctataacaaattctgccttgaaaaaaatatcgtttagcggtttgaaaaacgtgcgcgtgaaaaaaggaggtgagttgcgaagtaggggggaagaatacagcctaagagggattgcataattctacaagaattggagacacaagatgtgagagtgtgacaatattctcattcattctcttctctagcggggctacaatagtgactcgtcgaggaaagggggacagcggatccatcctcgtcgaagctcttgccgtcggcgaggagaggaggaggacgtggggaaggcgacagtgactgggtgggcagtggtgatgtgggtgcaggaagggcggctgcgacgtgggtgcgggacttgctcgtcgccactgcagtttggggagctcgaggacgggcgttcagcttcaatgacaggacaggatcctcccacaactatgcgctctcccatctatcgtgcgctcaaggagctatacctcattgatgctgttggttggcgccgatgctcgagttggagatggcgacagcattcacgaggcgtgggccacaaatggaagagaagatatggatctaactgcaatgattgaaaactgaacggcgatgatatggataaaattttgagtaaatttcacaaaactacatgagccaaagagcgttaaagggtgctaagcgtatccaattgctgtccagggacctcacctctactcttcatcccctccatccagggaaacaagaaatagagacgcagaagattgatgatctatcgatcgaaaggaatatgcctcggttagcaaggataaatcctgaacgacttgttctagccattggccggctctagtcaacttgaactagcaaagagaagctcatgtcgacccgtggcccagcgctacccaatggagacaaggcatggcccgaactatctttcgttttgttattcaataggcaagggcaagagtagtatgattgacgcagttacctagtgccatgaactcctcggttccttcctacccttaaggtaacagcggcatcccacctcttttgagggttcggcaatgattgaccaaactatcacaaaactacagatttaacaccaaatttatcacaaaactacagatttaaggccaaatatcacaaagctacatatttaatattgaatttaacataaaactacgtatttcagagtttgaatccctatcactattgttatgttggagctataaacattgtagttttgtcactaaattggttccagttttgtgttaattttattactaattatatagttttgtgacactccatcttaaatgtgtagttttctgataagtttgatgttaaatctatagttttattatacaacgagttaaatctgtagttttgtgataatttggtcatagtatgtgtagttttgtgaaatttactctaaaagtttagaaaatttcagtggtacccagccaaaattgcgtatactaatggtattttccaacatgacaaattcgcaatggttccaattaaacaaaaaaagtcttgctcaccttatggtgcacttcaattcttttaaatttcattgtaaccaaatttttaggtaacaaactaaaaattattaccatatcaaaatttagcatttcagaagcttccgctcacaaatactactgaagtttgaaaaggcatcaaactaatacacatccaaagctatcaaaatttgacaacgccaaaatgtgccaaaatttggcattaccaaattttactaaggttgattttggcaacaaagtgaaagagcccaaaagttcaacttttaaaccaactgagtgttgtggtgttttctgtttttcctgaaccagaaaaactcaatgagattaaactgtttatatttttgctttaattttatactataaatatgtttgtgtgttgcaatgggtaaaagtgttttttacagtgatacaatagctattaggtgatgagtaataaattaaaatattaggatcgctatatattataattgaaaaggtgtttgtctcctacctatctccctttgttcggccgatctctcttaacatccagaagacagtttgtgactgtacgatgcaggagccgatcatccccatcaaatctaggatcttccaaaatagattgagggattttgatccactcgatcttctctttccgttttcccaaaatcgaagtgaacccacaaaactcgggataaaaatggctgaggcaagatctttggccaaccatcattggcaactgttaaaaggagcttaaatctggcgaattaaagctgaattgaaaaagaaaatcatggggaaaaggatgagggggagtggagaatcgctttttgcaattaattagagaagaaaacacatgggaaggcaaatcaatatggtggcggcattaggtgcccgtgtggagccatggacgactcgagcacgagaaggagtcggaccacgaggaccaacggacgaacgagtttttttttgttggaagcaaattttgttttttactaggaaaagtgcccgtgcgttgcaccggatgattacggagtgtgtatagtgacaaaaaagtgttgctgagggacctagaacagactttttctcggcctggccggtcggcccacgacattttatgtacatgtgcgggcgcttcccacctccccaggctgcaacctgggcctgggccggggaagcagccccacgtgcgcctccacttgggccggattcagtccagccaatgccggccgtccgatcttagggtttcgatcggacgatcgggcggtgacgtcagagggacaaaccccatccctcccagccgctggtgaaaaccctagcctcttcaccccctcgccccctcgccagaaaagcgaaaaccgacgacgccggcgcatgccctctcgctagtgtgcgcactcgcccgtgggtgagtgcgccgccgtcgagtggccttgccccggcacccctccccgtcgtctccccttcgtgacctcgtcttccgcgcggcggcggcgctggactccccctgcccatcagcaacgaccggcggcgggaggtggcgtgcaggggcgattcctgccctccaccagatctagtgggagagaaggagaggcggtggcggcctggcggcccagcggcggcggcgtcctcccctccgccggatccagtgggaggggaggcagcggcgacctagcggaccaaatctggcgtcccagatgcgtctcggatccagcgagaggggagggaggcgatggcggcacggcctcccctccgtcggatccagcgggaggggagccggcggcggaccggcgtccctgcgacggcagcgacgacggcaccctctctttccgttatcaatttttcttcttgtgttcttgtgctcttgtctccgattcatacttcagttttatttgtgctctttcaattagttaagattgaaaggaccttaatgtcgcctagaggggggtgaataggcattcctaaaaattatcacaactccatagcatattagaatgatgagaacttttggttcaaataggaacttccgatatgagattggaagtttcggtctcaactgaaaagttaggcggataatggaataaaacactagctatgaacttgtagctcaaataaacaaaatatatatgaatcaaaaggtgacaaataaggtatctaaacaagatataaggtcaccaactaaatcaattaagcaagcaagtagatcgggtaaaaacaaactcaagcataatatgagagaatgcacaaatgggcaaaccaagagaggagacgcgtgatttgtttcccgaagttcagatccacggatcctatgtctccgttgaggagccacaagggccaggcctatttcaaccctattccaaactttgaactagagaaaagtttggaatgacgaatcctcaaacttttatattagaatctttttcaaaaatgcaatagatttttatttagggagatagatcattttgagcaaaagcaagatcataaaagataatattgagaccattttggctattttgtttcacaaatggaaatttttacttcaaaagccttgcaaaacatttgaaatgcatattgaagcacttttgagaggattttcacaaaatttggtctcttaaatgagttttttgaattttgaccaaagaggctatttgaaattgctataaatccaactttttgaaatctttcatattttgaaagcatgggatataaaaatatgattaagaccactcccaattgatgtatttaacacattaactccatgaggtcaaggtttggaagaaaagaccaagtttgagcaaaaaactacacaagcttctattttaaacatttttcttccaaaatgcaaacacaaataaatgagatggttttggagtgaaatgaatatgaatgaaagttatgtactcatttgagctagtatgatgcatttatgcaacccctacaatgagaagtcatctaagtgctaataggtggacatttatggtctagatagtattttggtcaagattggaatctaaatttcttttgattggttggccttttagagaaactttgaataccaaaaatgtttgaaatgaccaacactatcattttacttttaaaatcactttaaaattccttttagaattaattgtacaaaattttgaagttaaaagccaaaacaagatacttagaactacattttgggttgaaattcattttctttgaaacttagttcttctttgaaatacaaaagtattaagagacatttcaaacatactttaaaatcatttccaattagattctcatagaaaggctatacttttcaaaattttcacttttggctaaaaaggatattttgaaatttccaactagcacttagtcaacttgagcacatatgatggatgtgatatgcatgaatatgaatgagcactaaacactcacaccataacctatcttgctcaagaatgcataaatgaggtctttctcatatgcaaggaatacaattttttaaattctatgagaatgtaatgcagcctacacaaggttatataaaagataattcaatgtagatacatgttaccgagataacattgattcttgatgtgaattttgcaatggttggctccaaattccgaacttggtgagatccaccttttcttgcatgagccatacctccaatgcctctccatgtacctatattctcattttagcacattttagtccctaacaacattgggtccataaaggtaagtcacacgagacttaggcacccaaatggattttgtgctagtatgtggtgaactaatcagcctagtagcacaaatgtcctttttggccttcctaagcaaagcataatcaaatgaggagtttggcttaagaatgttaaccatgggacaatttgtaccaatatgtccctttgcacggcaattgtagcaaagtcgattcttgtctttacatggtgccttcttcaccacatcttgcatcttacttgctaccctgctattaagcttcttccttgatgacacaaagtcatccttcatgtggaagcatgatgcaacttcatgacccttctcattgcatccataacacttcctattgcttcttcttgttctcctctttggaagtgtggcttgctcatcaatcttgttggaacacatcaaggcatagtgtcccactttcttgcacatgaagcaagtaatgagatttttgattctactttgaatttgccccttactcttgttattggacttgttttcttgatagaacttagtgcaagctacggttgatcccttctcaagcttcttcaccatgctctcatggttatcttgagaaggttgagcattgcccataagtccatgatccatgtgcttctccctttttcctacacaatccaagtcacatgtagtgctcggggaaatgtttgctttggagcaacaagtgttagcacaagtaagatcaacttgaacataggctcataagattttaccgttgcaaacatcaccttattagctatctctaacctggcatgagaatctacaaggttcatcgtgtgtttcttgtaaatccacatacttgctagtgatctcctcaagttgagatttaagctcttgattttccttcttcaaagatgctacacaagcaatagaattagtggcacaagcaaattcattttccaattgttcatacctcataatcaatgaagaattatatcccttgagtttcttgtgttcatcggctagatccttgatttcttcattcttcttaatgaggcatgcttgttgcttctcaataaccctcatgagcttgatgaccattgttgtgtccttgttcaagtgatcaaccacggagtcgtcatcatcatcatcacccataaagacatgatcttcagcaatggaagatgaacaaatggatgatgtagattcttcatttaactattgatgttcattcacttcctccttcaaaaggttagtttcacaagtactataggaagtagtgcatccatccatatcatccacacgcacacatttaatgctaggtgatatgcatgagtcaacaacacaatcaaatatagcaatttcattatcggtgttgttggagtccaaagggagagttggaagatcatcaaccttattcaccaatttattaccttgctcatacttgcatgttggtgagatgaataatgaggtgataccttcttggtcggaggagataatcacttgggacttgtcatgatgagacgataaagtagagcaatcaccaaatgatgtttccctaagagcatcctctccatcacatttggacttgtcatatctttcctttaatgttgtccaaattagataagcatcttcaagtggcatgatggttttgaacacatcttcactcaaagcactaaacaaaacattagtagcttgagcattgagatgtgtgcatttctcttcctcttcaaatgatagctccatatcattaggaggagaaatactcacatctacaactcgctctatattaggacccatggccctaaacatattaagcacatgagtactccaagatatataatttgaaccatctagtaaaagaagttctaggaacatttcacctcttgtcgacatcttctctcaagacggtgaagcccggaatgagagaccttgctctgataccaattgaaaggaccttaatgtcgtctagagggagggatgaataggcgttcctaaaaattatcagaacttcatagcatattagaatgatgagaacttttggttcaaataggaacttccgatatgagattggaaattccggtctcaaccgaaaagttcggcggataatggaataaaacactagctatgaacttgtagctcaaataaacaaaatatatatgaatcaaaaggtgacaaataaggtatctaaacaagatataaggtcaccaactaaatcaattaagcaagcaagtagatcgggtaaaaacaagctcaagcacaatatgagagaatgcacaaataggcaaaccaagagaggagacgcgtgatttgtttcccgaagttcggatacacggatcctacgtctccggtgaggagccacaagggccgggcctatttcaaccctttcctcatgaggttacacaaatgcactcctcggttttactcttgatttcttcccttgcggaggcgaaatcgaagcctttacaaactttccgtggcacaccacaaccttgggtgctcaccggcgatgcctagccgtctaggagaccttagtccccaaaagtaacaaacacaatcgaagatttgcttgctatgaactcgagtgctcaaagtatggagtgaagctcactagctctcaacttctcaatcactcaatccaactctttccccttctcaaatccctctcacaaaaaggcaccacaaaggatggagtgaagctcactagctctcaactccttactctctcaatccaactctctccccttctcaaatccccctcacaaagaggcaccataaaggtagggaaatggggatggctatttggctttggatgtgtctaatactccccaagagcagcagccactcaaaggaggggtggaggagtttatatacccgagcccctcaaaaactagccattggaggccaagactgtaattttcggagtttccgaaaagcattttcggacaagttcgaaaacttatagaagcaaatctcagattcgtagccattttcggaatgtccgaaaatttttcggattttcggagtttccggtaatttttcggactttccaaaaagcacagagtaaaacgactataacttttcgctcgggagtccgttttttatgaacttggactctatggaaagctcactcagaggactacccaactcaatcaaaaacaaggtctaaaaccactcaaaggataggttaaagcttgggtttctctcaaggtagcactatgataggtcactttgagcaccgagacatacagaaacacctcgatgttgcatccctcttaatagtacggcattcctaaactcaaatgtaaataagaagataattataccatcaggaatgcatttttttcatctttctttcattgtcttgaggggcgccaatgccgataccgtttcaccatatattcttcaaatgattgatgcggttacttgtagcttcaaatggtctcgcacggtccatcatgacaaagccgtcactcgctcttcaccaccggatttggttcttcggcgccaagctccttgcttgcccttcaccgccgcatggtccatcgtgaccgagcatatcttgcccttcaccgtcttgtcataacagccacttcgtatcacacatcttcaatatcttcactttgtcattcttggtattgttaggtgtaatgatatcacttgagcatcaacacctttgtaatacttgggacctatttctttcattcaactcaataaaattattagtcccaatgatccggttgtcaacctccacatgttgaccaaccgatcgcatgtataaaaggatatgaataaatgatgagtattaatcaacaccacaagtgtcatgtactcaaatatatgttcaaatgtaaagatcccaattaaatgaaggtgaataacttggatcgattacatgcataactaaagtataggatttgctccccctaaatgtatgcatacaaaatatttgtgtgaagcaagagtatgcataacaagatattaaacattgagagcttatcctatataagaatagaaggcatttctcaaatatagatattaaagtaaaaacataccttcatcatctccacgttctcaatgtaaatagactaaataagagataatactcaaacaaaacattagtctcacatgcatatgccaatcacttggaaatattatatacgaacatatcaatatgtacatgaagagaaagagtgatacatatagtttgatctccatgcattttatccttgtgatttaggtccaccaacactccactttcatatccacatgagactaggcaaagaaatgcttataaaaacattagtctcacataattggatttgttattaatcatcaaaatcaaatcaatggcacttgaactttcaaagatgtgttcttgtgctcttgtctccgacggacaaaaaatcaccgcacggacgatgtgacaaaaggaaaaatacaaatattttaattagccaaaaaaaagaaaaaaagcggtgtaacctatatttgagactttttctagcgagcaaaagtaacaaaacagtgtgaaaataacttcggttaaaaacaaatatttttagttttgatacaccgtagcgaagcatgagcattttgctagaaataaacttcttttcttcggcccccccgagggacctaaactggacttccttcggccggcccatagcctctaagcgcgcgagcgcaccacctccccctttcccactcctcaacttgggcttgggccgggaaagtgggtgccgcgcgcctccctcttgggccgaattcggcccgaccaacaccggtcgtctgatctctagggcttcgatcggacggccagacatcgagatcggagggacaacccaccccacccccaccccggccgccgacaaaaaccctaggttttctcctcccttccctctctcacggcggagctgtggcgctcatcggcggcgccggcgcatgccctctcgccggtgcacgcactcgcccaagggggagtgcgccgccgtcgagtggccttgccccggcgcccctcccccgtcgtctccccgcggcggcatcggctacggccggcggaggcagagtactacccgctcgcgtcggcaacggccggcggcagcggtagatcttcccgcgcgcgccggcgacggccagcggcgacggcggactcctgcgcttgtcggcgatggcggtggactcccgcgcgcgtcggcgttggcctgcggcggtggtagatcttcccgcgcgcgtcggcgacggccggcggcggcggcggactcccgcgcggtgtctgtgacaaccagctgtggggaggttaggaattttcgcccctttttttgtttcattctctgtgaagcgtaaaattttcttttttcctttttccccttctatttgggttctctaagtaggacaatcgcaattggattttgtatcggtttcgattttaatctcaaatcgcgcggacggacgaacccgtgggcgaagaaaattcacgcggatggacgaacagacggaagaaacggattgtgacgaaaggaaaaatactaatcttttaattagttaagaagtagataaagacatgaggaaatgtctttcaagtatagaaatataggtagtataaacgtgcacgcaaaagcttcggtgatcatcacataatttatccctctgttttttaatatatgacgctgttgacatcatattttgaccattcgtcttattcaaaaattttacgtaaatattaaaaatactagttagctgcccgtgcgttgcagcgggaatcatttcaataatacactaagagctagattattacatgactgataaagccaccaaccatagtctacgcacaaacatgctttaaaaaacaatccatatcaaagtattgttaaaatggtgaagtatttattagaaaataagaattcacaacaatggttctcaaatgcattgaaacatatttatattaatttatagacagtaaaattgcattcgctatgtttataggaggccaaggcgatagaccaattttcagagaatctgacaagttaaaatcttaaagaaatgaaagctcagagttcgaacttcatttaaacaagcattcaacttccttcttcattagagcggacagaagaaacccctctacagagaactctgctcttgctatagagtttacagtcaaaacaggctgacaggctcacaaagggagtcaagctttcatgtatgtagtttcagtttattacacttggtcgaccatgaaaaatagaaatatcacttctggcaaacaaagattggcctaacaacaagaattcatggagagtttttgttccccttgtattatttttcgctctgaataattaagaaagcagaaatgttacctaaaacaacaggatgctaattgtactctactctggaatcttgccaaatgtcgcttttgctctcctctttacgaaggacctgatcggttagtcccatcaatatgggtttttacttttttttttcattgaagacaaactctttaactccttttgaaacaattcccccggagagacttgatcagcaacttgatattcagtcttgtcatctcatcaccagcgaaacatactcctgtctgagactctcagctgatactctgcggtaaccaataattccaaaggcaccttgtcagcctgtcatccagttttttgaaataacagcagcgataaaagaatagtatgactaacaaacctcaatattatgagcaaacaagagtaaaccaacaagtacattgcatctcagctattagttgatggagactttggtcagttcaacatcgttttctctattgccacatgtatatatcaaaaactaatttcttggtggtcaaaaaaagtacactattttgctctgacataatgaaaatattttcctgttgcaatgtaggtgaactgcaatgggacatcattagtgcagagataaacaatgcatgaaaatataaataatttcggttgcagacgtaactttcaaaagtaaacaagatttctaaatgattcggatttctctcatcctaaggcttagtccagaatagcggctaagaaagtccataacacctgtttatagatcacactatttgctctggtagagtgctaggtgctaaagactattccattggcaggccttcagcttctaagccatagctaaatttgaattttggaattaatttagaggttttctcgttgctttccctccttaaattttagattgcaagggtataactataaaagtctaatcctatgacaatgctagtttacttcactcagcttataagccgccagagtttaactaacgagacattaaattttgttcagagcaactatcttcgaagttttggacaaaattaaaaaaaaatgaattataacactcactgtcagtttagggatctttccgtttctgaaaaagagatgtgcttaagatttgaatggttggaaagatggggattaatcaagagacgcttgcataactcttaatttctataaataaaatagtggaaaactctaggtttccaggtttatgtaagggatgctaggtggaggaatacatgtggataaaaataggcaggaaatgtgcaggacaaaattaacacagcaagaagagaactttcatgtcttctcaaaagcccgtaagggtgttatcccttccttgcaatagagattttagattgcattgcattgaaacgagcacataacagtactccatggattttttgtaaactgagaaaaccagtaactaaaagcatgcttcgtcaagcatttcaattggatggcaagcatgtaagatgattttaaccaaagaaaaggcatatggagtggcttatttacagaaagttaaggaaaatgacttcatattggctgttctgtcctgtcagcaaatttaagtcatgtataataaaaactacccacaaaaacatcttgaaagcaaagtatatagacacaccttttgcttgctctatcacttcagattagcagtttctttcccttttccatattccacaccagatcacagcaaaaaatgaaacacatttcacaaacaactcagggacatcgctttggtgcaatcaaagcataacaaagcattatttgacctgtacagactcaataacacaagcaatacaaaaacacaaatttgtttggtcagcgtactggagattaattagtaacctgatttcagtccgagattgcaacaattggatcacatcgatccccagcaccactgcacccaccacgaatggcatgtatccaattaaccctatattctatagcactcaagagttaagattctcacctagagataatagcacgtgggttcacaaaatctgaataattggagttacaatccttaaagcatcaatctgagcacagaaaaaagcaaaagaagaattcgtaaggtgaaagcatgtgggtttgcagaagttgaaaatagaaaatatatacatcaatagaacaattctcaccggacactatgcacctgggacagtttcctgtcagccagcttgtaaactctgaaactcgaatcagaagaaattcattgtttgcagatacctgtggtcgtcgcgatgcaagatggatgggattgatgaatccacaatattgacatagcgttctcaaaatttggcatcacacattcaagaaaaacaggggaaaaagtagggtatcggtggaccagatgtaccaggatatgggcacaggaggtcaccgtcggcaccgtaaaagcggcaggattggtggggttgctgagcgtgagaaagatcgctgcaaaggcagcggagcggaaatgctgagggggacgtctgcctgccgccgagctcgcctcctcccaccgtcgccccagagtcgtgcgacggccagcggaggggttcgacggcgggagggcgacggatgagcagccgacagacatgccaccgtcggggtggagtgcgggtgatggcgtgcggcagatcgcacaggcggcggcggcccgtccgttgcggggtagtgcgggcagcgggcggatgcgggagtggaggtgggggtgggagcgcgtgc

SEQ ID NO: 21236 - DNA, 4310 bp, Oryza sativa
gtttcctccgctaatttcgttgctcctccagtttccttttattctccctttctcttttgttcgaaatacgtactgattcatcacatcaatatattggaaaaaggagatgcaaataacatgtagccgcgtctaattagtaattacctagaaatttccccaatcactagtgccctttgtgaaaaaaatgatatagtttccatgttctaaaatggtccttgaatgcaaaagatgaggagatctacatatggtttaactgattgtatcatatcatgtttggcagagtcgagggctatttgccgttacatctgtgaccagtacgccgacagcggtaacaagaccctcatgggcaggaaagaagatggggcggttggccgcgctgccattgagaaatggatagaagctgaaggccagagcttcaacccaccgagcttggcaatggcattccagctcgcatttgcgccgttcatgggtagggccactgacatggccgtggttgaacaaaatgaagcgaaacttgtgaaggtgctcgatgtttacgagcagtggctgggggagaaccagtattttgcaggtgatgagttctcgctggcggacctggtgcacatgcccaacacagatcttcttgtgcgcaagaccaacaaggcagggttgttcacggagagaaagaatctggcgaggtggtgggatgaggtatcagctcgtccttcatggaagaaggttgttgagttgcagaatgtaccacggccctcatgaggcttcttgttttttcccctctgagcgtcttgtgttagttgcgttaaagattcggtcttgttcagttgtttgtatcatttgacaaaatgtgcaagctcttcctatgggtccctaatattgtgctaccatctgtaccttttagtttggataaggttgaatctattttcaggttctcaagtttacttacctaacagttcccttaacaaggtaacaatggtatagacaaatagttgcaaatgccatactgtcggcactgaattcttgacagacatggtatcctaccacacattcataatatgcaactattagatttacatattcttgatatgtctgctagcaaaaagaactgcattgtcctgttccttttagtagattgttctagttcactattgaaatttaagttgcatatagcttctttttttaacgactcatataactttcaggctacagctgatcttggagttggttttttggtatgagattggaaaactggaaatgttttggctcctttgtttatccatacgttctctaattactagtgttgagattgagggtaaatgctttagagatttcaacgttagtaggctgtcagcaaaacagcactgctgagatacaaccattgagaactattctgagtttattgtgattattgggcattgcctcaggaattgtacagtgaaaaggccctaagcattccccgatattttgtgctgctagcaatccaagatgaggtggaaaacgaattgtcatgaatcatgattcccttgctcagaatgtcaataatattgtagatttccaattcatttttttttgctacatcatggtgcaattattacaagtaatatgcagagtcattttaagttcatcttgtagtattgcaggcgtaactcctgacagcccgctaatgttattctaagttaacaactagtagtccttgtttaaagttgaagaacatacaggtatgtcttttgctcaacattaaagattaagcacatgcagatgtatcgttggttaatcttctataggttaaacagctggattatatccaactctgtactagggacgttgcttttgttgaaaagcttattcttataccctggcggaagtcacaacatcttctttgtatgtctagtacttgattccaatcttcttcttactgtcctatataaattctcataaacaatataaaagaatcttgtagtactgtgtagcaagctccttctatgctatatttttcactctagtgctgaaggacttcatagatactaataaagaaggctgttttgtaggatttgtttttgttctagacaatatgattgttgcaagcaagaatccagatcttcctctttttctttacacttttccttttccatttttgtggtgcctggtagcaaggcaagcatagaacttctccttttgtttctataaatacctgattaagaatcctgctgtcatcatccctcgttgtcgttttaaacaacttgatcaggtgatcaatcaaatcaatagaaacgatggctgcaggcttgcaagtgtttggccagccagcatctactgatgttgccagggtcctgacatgcctctttgagaaggatctggaatttgaacttgtctgcattgatacattcaagagagagcacaagcttcctgagttcattaagctgcgggtacgatactatttatttatttttatttagattcattctctcgaatactaagttaagctgtgctctttttgaccttttcaggatcctaatgggcaagtgacatttaaacatggtgacaaaaccatcgtcggtaaggccaccatggatccacattacaatggctactttacgttattagttttactttctttttttgaggatttgaggacaacgtgaaccctatgtgcagattcaagggctatatgccggtacgtttgtactcagtttccagagggaaataagaccctttatggaacgggatctctagaacgggcatcaatagaacagtggcttcaagcagaagctcaaaatttcagccctcccagctcggccctcgtcttccatctcgcatttgctccccatctgaacattccccaggaccatgctgttattgcagaaaatgagaagaaacttcagcaagtcctcaatgtttatgatgagatactctcaaagaatgagtacctggctggtgatgagttcaccctggctgacctttctcaccttccaaactcacattacattgtgagttctgagagaggaaggaagctcttcactggcaggaagaatgtggcaaggtggtacgaccaaatctcaaagcgcgagacatggaagcaggtggtcaagatgcagagggagcatccgggtgcattcgagtaatggcctgatatattgcccaagttcatcgtgtccgttgtcgatcgatctggcttctgctgtcctgtgttgtcatcgtcgctagtttgcctgttccctgcttatattgtcgtgtgaccaaataatatgaagcctcttcttgttgtgacgtagtttcataccatgtacctcgttgctttacaggtcatttgttttctcccttgtttagtgattaaataaaattgttaatcgacctggcagttctaaatctgttgttttcttcgcctgaataatagtattcttttgtgcttggattgagcttttgagtggcacataaaacgagaagagtcattagactaattgaatactattataaactaaaataatgtattttttaaaaagaaacttatgcgtagacagatttttaaaacacacatcgtttagtagtgaagcgtgttcactaaaaataggaagcgtgttcactgaatatgggaaagcagttaaacccttaagcggaactgaaaacaaccttaatgaaatggaatgctgaataggtgaatgattgatgataattatttgaggctacaaacaaacgatgaaatgaattaccattatagataaatagatttacacacacacacacacacacaaaaaaaaaaaatcacatcgtttaggagctctagaagcgaaccatcattccatgcctaaggatcctaaggatcttggatgtaagaatgccacaacacaaatttgtaaggaattcattggtgaacgagtagatttgaatttagatagtgaagtactgctatgagttgagttgtgagcatatgactctatatctattagaatttaaattgttcataaatattacacagatgcatgtttttataggaatctagtaaagttagagatttgtgttggtcgtccgttttttagtgtgttaagagaccacttgcggatgtgtgtatagtattagtatggtcttgtatatcctgcaacggaaaaaaaattaaatggtatgcacaattaaggggagaaaggcagacagagtagaatcgtttaaagtcttgaaaccgctggcaactagacagggtcttgctgccgatttgccgaccattcgccaccagatcaaccgatcatctatagggtttgatgtgttgggccgaacggtcaggctcaggttatcccgaaaatgctctgggtcgtgcgaccggcgcg

SEQ ID NO: 21237 - DNA, 5560 bp, Oryza sativa
cgcgcgcccctcctcccacgtgaacccacccatttctctctctctttttttttaaaaaatgtttcacctaatttatctataatgtttcactatttatagatctaatgttgcagtgaattaaaatactcatttgcaacaaaaatcccacatattttggaaactctctattaagagaatttggtttattttttgttccataaaaaaatgtttcacatagtatactcataatgttttactatgtatagatctaatgttgcagtaaacgaaatattccagtgcaacaaaaaacccacatattttggaaacctcctattaagggaattcgttttattttttttccaccgaaaaatgtttcacctagtgtacttataatgtttcactatgtatggattaaatgttacaatgaactgaaacaattttttgctatttacttaaatattatttttatataaggtgaaacagcaccagatttaaacaagtgaaacattttcgatcaacttagtgaaacaattccaatatacctggtggaacatcgcaacatttaaaaataattcaataataagctaattttttttgtcggaatatatccatgtgtggtcttgttttgaagatttaattataacgaatttaatggtgcaattggatcatgatttggattagtaatttaagagaaaaatcagtttaaaatagttttgcacgtaaatcgggcgctgacgtcccgattttttcccacccacgatcgggcgcccgatttgtaggggtccaggttatccaggccaacccgttttaggaccggcctcatctttacttatgcttatacttgttagtcaaaatttgaatttttaacattaaatttagtattgattttgaaagttttttcatcatagtttatttttcagtttttgcttttagatcgctgagaacacgtatataaaaattttattcataaatttttttttgtttgtaaatataccgtttgtcttttttctgtgaataagccaaacaatgaccctgatttcgtgtcgtggttttatatctgacaaattttgatgagaaatttgatcaaaaaatgcatagcaaaatcgctcatatgatctgatgtatgtgagccacaactttgcaagtggtggacgagccgattgaagtcattgaactcgttccctcttctacggttctaccccaacactgtccttgcaactttatcggttagaatgctaagctaaatctgtgattgccgttgcatctagccacgtcgtcatacacgggtagcagtagcaccaaaaggcactctcgtacttcaagatatacttgttttctcggacggatcaaattccattgttctagaatgtcctgtttaacatcacactcgattggacattaccttttttctctctcaaaaacaatcggaatgaaacagctctaaagaacgtgctaagtgtacctactgaatccaaccttaaatccgtagcgtacgtaacccctgctccgttcatcatcccctgccagtatgccttgtgtaccttgttcgtttctttgcaatattcattccgacaaatgcacgcagcctcttttgtatcggttaccctattgataaaagatcacgccgagacacatgggggatcgtctcttttccttgccggagatgatagttgctccaagcaagaatcaggggctagctcttctttatctttgagctttctcttttcctcgccgtcctgtaatcctctgcagcaaggcaagcacctaatccatccctataaatacccatcggcgtctctgcctcctcacagcgagccacacaggttaagtcactttcacctgcaaatccacaagcacattgctcgatcaccgaggaagaaaactagctagcttaatcaccgggaagagttgagcaatggcggcaggattgcaggtgttcggccagccggcgtccaccgacgtcgcgagggtcctgacctgtctcttcgagaagaacctcgagttcgagctcatccgcatagacaccttcaagaaggagcacaagctccccgagttcatcaagctacgggtataaataaaatcatcatgccatttcaatccattcggttaattttaggctcttggaaatgaaacaatcacgcacgtacattggcttcattctgtcccctcccatgttcttttgcaggatccgaccgggcaggtgactttcaagcatggcgacaagactcttgttggtaattactgctttctaaattttcttaatcacctgaattattaacaaatggattcttgtttcttaatcttcttgttgttttgtggcatagattcaagagcgatatgccgatacctgagcactcagttcccagacgacgggaacaggacgatctacgggacggggtcgctggagcgggcgtcgatcgagcagtggctgcaggcggaggcgcagagcttcgacgcgccgagctcggagctggtgttccacctggcgttcgcgccgcagctcaacataccggccgacgaggcccgcatcgcggagaacgagcggaagctgcagcagatgctgaacgtgtacgacgagatcctggcgaagaacaagtacctcgccggcgacgagttcaccctggccgacctgtcccacctcccgaactcccactacatcgtcaacgcgcggtcgccgaggggcaagaagctcttcacctccaagaagcacgtcgcgaggtggtacgaggagatctccaaccgcgcctcctggaagcaggtggtcaagatgcagagcgagcaccctggcgcgttcgagtgatatgcgcacgcgcagctcaaaaactctcttgcattctgcggcgagctctgctttgtctcgtccacggctttaattcgtcgggcttcatgcagtgatgtggttgtcgtctacgttaattgtcgtttcggctaagaataatatgaagccttcttgaggtctcctctcagtgtattccttttgcaacgccatgtctttcgattcaataaatataaatgtgtcccagccttttttgctcatgtgcaggcagtatatgtagccctccgaaaaaactaattttactgcaagtctagctagcatgggccaacaattgagtacgtagtttgacctagctaacgcctaggtcaatacacaataatactttgggggatccattgtactgctgtctacttcctccatcccataaaaataaacatagtacatgatatggtatttccagtaatacaaatctggacaataatctattcagattcatagtactaaatatgtcatatttcatattagtttttgttttatatgggacgaaagaagtatgcaataagaaccacgcgcatgtggatagtcttggaaatgatagcatcaaaatccaacccatcatactacattgagtttatttttgtcatcatgttcttaaaaaaaactttttttttctaaagagtaaaatgcatgaagggttatttaacttgtttaggtgtatcatgtatatatcactttactttcaaaatacacattgagtcactaatataagttaagtgagccatgtgctcatctaattatccacgtgagtatatcatacatttggcattccacctaaaattaaaaaaaatacttctgaaaatgcgtagacctaacaatgaaagctgctagagtttgatgccaagtgagagaggactgggaactagaactcgtcaaaataggtacaagtgaaatgatttgattacactagtttcgtgtattgttaattggtagctgtcgatttctaagactggtaataaaatttatagagtacgctagatgctagaaagaaatggtgacatagtgatttatactagtttagactctcgggatgaggtaatactctagtccagttgtttggtggattacctatgtatgagtgttgaatgaagatagtgcgtaacccccaaggggtgctgtcgattccctttatatagcagcagggtgatcggcgacaaggaggatgcgatatcccttaaattctgggtacctgccatctgtcaagattggtgggataggtttttatctccctattcgccgccatttatagtaacagattacatgggcctgggcttgtatcacgctagagatctatacttcgagtactgtgatgggctaccccggtacgataactctcatagtaatgctatgtgaatcgaaaaatatatgttttctgcatatttctatatgcattttttttcaaggcagcgtatcgtatgcacacagctaggtagatgcactcatgcacacacccatcctgagcctttggatcaacatcctgcggccaagacctcgagtgtggtatttttgcaattagccgcccgcctcctccacttacttttacgaaagacccctccacaactctcttcttcactcatgcagttcattttgcaaaaaaaaaaaaagaagaagaagaagaagaagaagaagaaaagaaaaaaaatcgcccatttcattctggatcttgcacaagcactcccaccatcggcggagacagaaatctctagcaacggcttgtattcgtaggcagcgaaaataacatgctggccatcgatgacgacctcaatcgacggttcgccggcggagacagcaatctggagcaacgccgcatccggagaggctgccgcagtgctgctactcttgagtatcgctgtggcagagattctgttcaagtttagtggaaaaaaactttctcaactagttggcatgtagctaatggctaaatatcttctcacctatcagttgaggatgaactgatgattgatgagcagcacaacttactggttctgaaactctaccaaatacaactaaaagaacaaatttctctgcgaaaaaagtggactggcaattcagacttcatttcagacaagcacacaggtagccgaacccaaaagatgataaatctcaagctaaaaaaaccaatagaaccccataaaaggatacgatccaatcttgacaaaaaaaaacattgtagcgcccgttccgtcgtggcgcctagcaggaaaatttaaattctaaaaaaaaaccctaattgcgaaatctgtttctttgcttgttgtaagtctccatgccaatccctgatctcgaatccccgatctatcgtcaaattcaaatcccgaatccaaatccttcccaaatcaaattcctccgcaaaagtctattttccctccctcaggttcggtgggctgatttcctctctctctccctcagctctcccctcgctctgcccgcgcgccgcgtgcgcgtgcgcatgcgcgtgagccgatgccgagccgagctctccctctctctctcgttctcccgctctccctccccgctccatccccggaaaactctccgcgcgtcgttacctcgcgcgcgcgcccgcgcggtcgccgccgtcgtcagccgcctgctgcctgtgcctgcgccgtccggccacgcgccctgcggcactgcgccgcctgtgccgcgccctaccccacgagccagcgcgcgtgccctgccgcgcctgaacccgcgcctgccgccctgtagccgcgcccttccaaaccgcccccgccgtcatcg

SEQ ID NO: 21238 - DNA, 2373 bp, Oryza sativa
ggtcaagccgaccccggtcggccgctcccctttgcaccgctcgcgcgcgcagtccaccgcgagccgtgaggctgcgtgtggggccgccgcatccgcacccaccacgagccgcgcgcgtgcaccgcgccccgctccaaaccctagcgccgcgttgcgtgctcctcgctcacggtgagccgagccgccgacaagcgggtcccactcgggaccacgcgagatggacccggcccaccggctacctctctcctctcctcctgcgcgtgccttgggccgccttctcaggccggccggcccattaagctcggccgaccgcccctttctctcgggtcgtgccctagccacccgagggaagtctgtttcccctccctctttcttttcttttcaaaagggtttaattaaatcctttttcctttagaccaaaaatccaataatcttagaaattcaatatcttctcaaccgtatgtccgtttgactccgttcaacttgcaaaattcctcaaatctcgagatctatttaatggcacgtttagaggtcaacaatagggctttattttcgccgtttgttgagttgtcccgtttcgcgtgtagtttcgaagcccgaagacccgcagtgcgaggatttcgaggatcaagctcaagatctcgagcaaggcaagtcacctttgatcatcttgcacctataatcaaaactaagtatttcttttctgcaaatattgcatgaataggattaacacaagtaaatcggccgcggcttgcgagatagcctgccggtcgcaatcctaattgctgcaattaccctccttgaattattgaacacctaaacctcctttgtcaactgttgtgcttcgatgcacgggcctttgggcacgggcatcggaacacctcccctcaaatttaaaatatccaatgatgggtaaaacttggggttttacaaaagacttggaaaacccgacacctgggtcggtgcttgcgaactaaaatgaatttccaaaatcgcggaccgggggacgtaccgggagtacggtttcctgctcttgcacttaaggaccgtttccttggaatttcatccgaacataaggcaagtgcgaccacatgggtggaatgggacacccctggctgagtaactagctaatcgggggaaccatgatgccaagagacatgtcgattcaacggggtggtgttggggagaacccccgggcttcctggcacagtatggtctgggacctaacctgttgttggtctgggacccctctcgttggcatatggtaaccctgtgtcggctttcgaaatgccttgacgtgaaagccccaaagtcaccagacgtggctattctgcacaggctgggtgaccaaggctagtaatgtcatgtgggtaaagtgtaccccctctgcagaggttattaaactgttcgaacagccgtgcccacggtcatgggcggatgtgaggtgattcctagcgtagttttgtttgactactgcttgtgaaattactgttgtggaatgggttcgatgtttgaaaaatctgcggctgatgggatcagccaggcccgggtggccgtttgaaagctgttggccaggtgctaaccttgaatcaattcaaagactgatacgttgcacatactccgaccggacgagacacactgtctcatccgtgtcgtttgagaagcactcacttagttgtttcaaaaaggagtttaaataaaaccagttgcaaaaacaacagcctttcctttgaagcctgcattaaacacttaattcccatggcttgctgagtactcctgtactcacccttgctctatataaataatcccccccagttgctgaagaagatgaagtggatcccgctgacgaggagttcttccaggagcaagtcggctacgatgagttttagggtttcggtctagttcccaagtcgcgcctgtgatgattggtccaagtcttggcttccgctttccctttgtaatgcagttgtgagctcgagatctgtccgcagcccaacatgactgtactcctactctgtaataaagagacctctgttgctgtgatattctgtcttcctatgatactagcactgtttcctaggactggtatcgattaacaggttaatttggagcgtcacgggctagttccgtttggggctagttcggggcgtgacaaacatccagctccaatcttcaccaggcaccaaccgagctcagtttccactctcctcacaaactttacgacgatgagagcagcgacagcctctgaagatgagccgtcgctccaaatctctggctccaaaggctcaccgtcactgttccgtcggccacgctgattgaggtcgtcgtctccgccgatgcgttgtagtcgtcgccttcgaagtccgaatacgg

SEQ ID NO: 21239 - DNA, 24124 bp, Oryza sativa
tgccagatccagaatgggatgagttttctcttctttttttttcttttttttttgcaaaatggattgcgtgagtgaagaagagagttgtggaggggtctttcgtaaaaataagtggaggaggcgggcggctaattgcaaaaataccacactcggggtcttggccgcaggatgttgatccaaaggctccggatgggtgtgtgcatgagtgcatctaccttgctgtgtgcgtgcatacgatacactgccttttttcaaccctacgtgacatacctacaacatatgcacatatgcttgtatggatagttagattagtgactcaaatgtgtatttttaaagtagagtgatctgtatgactccgacacacctaataagttggatgatattccattcattttactcgtttttaaattaagatcctccaaaataaataactacactttggatgggtggtttttgacggacttgaaaagtaagtttcaacaatgttaaaacccatttaagtgcgaaccgttcacattgtaaaaactttcataaagtgcttatgacaaccaaatagtttcaccgtgtcttgttgtgtgtagttagacagaggcgggtgaaaagataaccgatttttcgttatggcgtgaaaactggactcagtcccgagttcatggacattttcatgtgaattaattaatctgcatgtcaactagaaaaaggcattgttaatatgatgaactgaaactctaccctcgcatcggctcgtaagttaaaaaggagtagtactccttaacatgaacaaactacgctgtaaatcgggtgttactttttaggtcaaataaaatgtttacactaaaatttcaaattaaatgcgataaattagggattgtttagttgatagccacactttaccacatttgtgttatccacttttgataagttagcctagtatttgattgttgctacaactatgttacacttcacttttttaagaaattaggcccacttatcatatatttttttcacaaaattaccacataatatgtggtttgccatattttgtcaaaacttttgtggtaaattgagggtgtcaaccaaacaaccctgatatttacgttttgagcctagcgcctcaataccttttttaatgtgtaatacggttaaaggcaaaagacagcacattcttaacgtgtctatgtgtatatgtgtatataaggtggtctctaatttaagacaacagatatgctaatgattaaagcttagacgatgtagtggggccaaatattcgtgtgttggcctgttgggaagggtgttgttgtaaatcgcctcacaattattgagattgtcaccaacctcaaaaacatgtaaagattctttttttgctacctccattatcgtagaatacagtaacctagtagacttatcctaatactacgaatgctcccatgtttttatattttgagatgagtttattatttgagtttaacactatacattaggtgttaaaaaaactgagaacaagtacaatagcagactataagtcaactataaatacatttcgaggagataaaggatgtgagagagcaccaacgggctatagatttgtagccagctgcagcacgaactccaagatatatgtgtatataataggtggaatcatatattaattgtgtttacaggtaactattgtatgaactagctattagattaactatagataatttagagctagtagttggctatactattaaacttgttgcgaggcggtattgcaacccttagcatatgacagtaacaagagttgaagagttaaattcatgaatccctgtatttcttttcagaagaacagagaataaaaaaaaagaagaaaaggataccctttattaaagcttgatgatatcagcttagtgtataattatttgagattgaggggaatgttccatgttttgttgaactcttttccctcctacttctttattaaacgagatttgtttgatgtatcagggtgtcacgttgtcatgttatgtttttgttctggagattcttcttttctttaaaaaatgatctggagactcttttaatctgatatatttcgtctgctgtagtatgttcactctctcaagatatttgcaacaacttaattaccttagcacatgagtagtagaattactaggagttattttgcactatactttctttctgaagatatttgcacttgacatatagtagtagaataatctgaaacttcctttggtaagcagatcttgaacaaatcaaggcgaaacagaatctttccctttcctttttttcaccctgaaatcttctcagaccttgctattttcgactagatcttgttaaagcacacaaattatgatgttttctaatgaacatcatcgcctggttgcttgcgggtgtgatgatgatatgatgcacaagacaaccttggcagcagagatgagccttgtctttccctttggcatccagcgctttgctctttagctcttttcccccctttgatttttgtctttagatttacctcttggcaagcaaagcgtgttatgctccccactttggcatgtatataagcacacccaagctatcctccaaacggcaggaacacaccaccatctgcataatacttccttctcaaatcccaaccaacagttgcagtagagtcactagccgcccactgcaactgaaatggcgccggcgagcgtgaaggttttcgggtcacccacctcggcggaggttgcccgcgtgctcatgtgcctcttcgagaaggacgtcgagttccagctcgtccgtgtcgacgcgtaccgcggcacgcagcgcatgccccaatatctcaagcttcaggtatactcatgctctgcataccacattgtcgttgtgcaattctcggactgacacgtctggggaaaattgtgcagccgctcggcgaggcgctcacgttcgaagatgacaacctcaccctgtccggtaattagcattgagatttgtagtacggattgacacttgaacgactgtaaataatggtgtggaatgcgtacatgcgtgcagagtcgagggggatccttcgccacatagcgcacaagtacgcgaggcagggaaacccggacctgatcggcacgggcgcgctggagcgcgcgtccatcgagcagtggctgcagacggaggcgcagagcttcgacgtgcccagcgccgagatggtctacagcctcgccttcctgccgcccaacatgcccaagcagaacgacaacgggaacgggaacggcaacggctacggcaacagcaatggcagggaggtccaggtggcgaacgcgtcgagcaagcgcgtggtggccggcgcgacggacgggaagacggcggcgagcggcgccaacggcaacaagcagcagcagaaggaggaggagatgcggaaggtgttcgagaagagcaagaaggacctggagaagctgctggacatctacgagcagcggctggaggaggcggcgtacctggccggcgacaagttcaccatcgccgacctgtcccacctccccaacgccgaccgcctcgcctccgacccgcgctcccgccgcatgttcgaggcgcgcaagaacgtgagcaggtggtggaacaacatctccagccgcgagtcgtgggagtacgtcaagagcctgcagcgcccgccgtccgccgcgcacgccggcaacgcccagcagcagcagcagcagcaatcgccgtccgccggcaacaactaccagcaccagcagggccagggccagggccagcagcactaccgcaacgagcaagtcgagaactacaacaactaaacatgggcatatcgacgatcgagctgcatgagttccaaggggttgtcacgtatgcttcctactgttactttacttgcgcctttgccatttgcgcgccgtgtcgattaatttgtcgcagattgtctggcccggcctccagtacgtcgtcactacgtgttttgttcggcatcgtggtttttctaccgttgtaacagtcgcagtttacctatcgtccttgtaataaaatgttggccagcccctttcatatgaaagtgaagttttgattgtgtcctttccatgagtttagtttgactgttttatccataagccgttttccttttagatcatgtggtaatgcactaattaatgcatgacaataaggaaaaccggttacgaaacagaggatttcatgatacaagttgactaagagcatcaccaacagattatctataattttcttttaaaaattcgtttttggtttcctaaactgaaaataggaagtgaaaaaacacctccgtccaatagatagcctaaattcaatccctaaaacttaaaagtgggcccttctgttaaactaccaagagaaaattctattttttttctttcacgcgcagaaagatcgctatctcccacgcgcgggaacgaaggagagaggcaggattgcgtgattgggagcgactttcgcgcccgcatataaacggagcgagcaaccgggggaagggaactccaaaactcgggtaggagagtagaggatctgttggagctgatttttggattaaaatccctcaaaattagttttggaaatcatataggtagcttgttgttgatgctctaattaacttgtgcaacatgaggggcacgacatagcctgggtgataaatgaaaacaaatcttaaagattgtacaactaaactacttccatataggtcaaataattcttcgggtcacaggatcaagttaatcaaaagaaaacaaaataaaatgggttattcccaaacgaaacagttaagcattttccacgggtaaaaaaaaccaaggacaacatatgaattacagatatttagaattacaaatccacgggaagttcatcacagcaacaggccaacagcccatgtcgatgttctcggcagcaacaaatgccaaacatcttaacttgatagatttccagaattattcaggcgacgtttatttcccacggtaacgtggtcgtgcactgcacacgtacggctttgatgatcagctcggcaagagctgcccttccttgggcttggtgagcatctgcctggcgcgcacgcgcatctgcagccgcaccatcgcctgcatgcagtggatcgccacctccgcctgccgccgcacgtacgccccccgcgccaccgcctgcagccgcaccaggctcttcagcgccttgaacgctcgcctcgcctgcaaaacacaagcaaaatcctcttaccaatggccgaaacaaacaggtctcggttagatataagtttttttgtttttctacgcgcgcaccaggtggcctcggaagtaggcttggatggtgaccgcggccacgtcctcgcgtgggaagccctgcctgcacagcagcgcgtactcgtcgttcgagctggtctcctcttcctttgttaccgactcctcggcggcggcctccacgaggccagtgttgtaaaccttgacgtcgccgccgttgccgacgtcgccacccgcgcgcgccgtgcggcgtggcgtctggcccgtggaccggagccagcggcgccgcctgcccagcttcgcgttgccctgagccgtgcccgtgccacggacgtagcacgcgcgctgcgtcgtgggagtccgcggcgtccttgcggcggcaggcgccgacgactggaagcagccgacctgcccgcggcgcggggtgcgggagcggacgccgcagagtcgcctggccgtgggcgtgcacggcgtcttgggtgtgcgcggcgtgcgcgcgctggtggtggtgctgctgcggccgcggaggttgttgtcaccgccgccgccgccgctgccgcagcagctggtgagaggcgctctcacgctgtggtcggcgtggggagcgaggcagggcacgcagccgccgccaccgccgacggcggacgacggcttgtggtgtgggccgatgcagcatatgcacgcggcgctgctgcggcgtgcgtcaccggcgtggcgcttgccgctgagcggcgacatgaggcaggaaagacctcgcgctctcggcatggtcaagcaagagtcgttcttggtgcaggcttacgtgttgcgagttagaggatggctgggtcgcctagccggcgaagtggtatatatgggagtcagtgcagagcaaatccaagcgatgtgcgcgcctctaactctaaagctggcgtagtggcgtcgggccgtcgcccgtcggtatggtcgttttatttgaggtttgcgcgtgagatcgaacagactgtagtttattcattcattgtttgtataagcaacgtgggaggatgtaacatgtgagccatggatgggtggtacagcataagttgtactagttctacttatccgcatatttgctttgatgcattatttctgaaatgaagggcggttgatcactagtacagaaaaataagagtaaataatcgtgatagatgaacttataatatagttgaactgatgtttggcaattagcgcaagcacactgcatataattgcaaccatttgtttgtcctaaaagacagatagtacatgaggcatggagcttagagtaatttgacaatatccatccaagggaaataagggcttgtttactttgctatcattttcaatcttaccaagttttgacattgccaaattttggtaaggttgtcaaaaattttagcaagatttcatatgtatttattaaaatttggcaacaaactaaacatagccaaaattttggtaactttacgaaaaaatggttgaaaataatattaaactgaacaggacctaagataacaaaagcacataacgatgatggaggggaaccggaaaactcacgaaggtacgaaatcagcggaacagccatgtccccttgctccttccaagaggattggcgtcaggcttgcgcacaatcccccactctttgacatggtgccacggccaaaactctgggtctgactacaacatcttgcaaccacacctggaacgactcaccgagtccaatgcccaaaaccctagatcacgccggctttcatgagcaatagagaaaaaaaaacgccgccaaagtagcagagactccttcctcctctcccctattttctgccttaatcccgggctcgggcgatctcttatctcccagcagtcggtcacgtacccgagctccggcgcaaggcgggcttgctgagtgaagggcgtggcgcggcgcgcgaggagtatctggagcggaagtgccgccggggcgtcgacgcgtggtggaagcgtcggtgaggactagggcgtattggataactagaggatgccccgcacgttgctgcgggacttggttaacaacaatttgttagataggaggtacaatctcaagaagaaacaaatagattttttggagaaattctttttaacagccctattcaaaatttgtagataatttagatagcacatgtcaactgaaggggtgttcagccataaagctcttttatacggattaacgggctggatacatgtagatgtgtgtggagatgggccaatgtgtttatgtgggctacatttggtactgaggaggcgaagagactcacccggtgactaatgggttgggctatatgttacatttcatccaacgtctaagaagcgatctaatacattcatccaacggttacaatttaatgatggcgtggaagcacgaggttaactttattgatagaagggattagatctggggactgcttcgttttcgatcgatttggtttgtgccgcgttggcgtgtcggtgatggtcgcctcgacggtgatgtagtgggcctcgacgggaagcccgtattactgattctagaataggccggcctctgggatttcggcccatcttccttgtggagaataataacaacagattccctgagttatgagtaccgcgcgttatgatcttctctgcctgatgcgaatgggggtgcgaatgaagctgaacttcggtacagactgaaggtaattgatgctgaggtcaactaatttcagctttggcactacttttttcccccgaaatacggtacagacgcggatgttattatacacacgcatacttgcatttataaacgtacacacgcacacccttatctctattagcacctctaaaaattaagccagcatataaatatattttaatattgacgaaatcatcatagaccgacgtcttattattcagcatattttaatattgacgaaatcatcgtagaccgacgttttattatctagcatatcttaaaattaacaatatgtatatcttgaaattaacaaagttagcataagcatctcgttgtacgatatatcttcatattgatgaagttgatacaagcgtgtcgctgtcgatgcatatgtcacctaccaagctaccactgaaataataattagccgcaaatataaatgcatgtgtctagaacttaaactggatggctcagattcaatcataaggcggggtttttttcctggtggttgggaactaatttgcggtgcatgtaaaacggagcgactaattaatgcataattaattaatagtttttttaaaaaaagattaatatgagtttttcaaacaactttcctatagatttttttttgaaaaaacgcatcgttaatagtttggggagtgtacacacgtaaaacgagaaggaatgagttaggaacttcaagcaacgaacacaaactaagagcaagtttaatagtatagtcaactggtagcttcaaattatctatagccaatttaataatctattcatgcaatagttatctataaatatatactgcatcattaatacatagtgccacatctcgtacacacataacattttgaagttcgtgccgaagttggttataaatctgtagcccaatttccttttctctcttctctgatctcatccacgtgtttatagctaacttgtaacctgctacctaaccagcttagcattgcgctttggtactactttggatcttttttttttctcattgaaacaatgtacattacatttgtatagagattattagtgtttttacacgtaatagtcaaataagaacaactaccaaaacgaaataaagatagtctgcttgctagaataacataagagatacgagctgatgagcgtagccacagttttgatcaactcctgtacaaacaaaaatatagaagtatacaaacgaaatcgatcaccatcttataaatcctcaaacaacgtcatcaaacacaccggtgatctgaacgataaagccgatgctgccaattgaataatgggcaacccgacatcaaagaccttacaaatgcgatagccaccgatcaccaaagagaatgagaagaccaaagaatcaacaaatctaacattaaaactagctattagatctattgaacaatttacgtggaataaacccttaaacttatacaaagcagggctccaaatcagagacagagatggacctgcttaactgctccatctgcaattcaattctacagagcgcttttgcatctcagttgacgaaatatgaagtctaagtcaatagctaccattgccaggcaagtctccctctcaaaagtgaagtctagtcaagtcacgcgatgatcgatcagttggaccttgcacgagtccactaccaccgccagacaacggctcggctgactgaccacgacgtcgctgtgaggattcagatgcggtcttctccccggccgcgcgagatgattcccacgcacaagtgcacaactacacggcagcaacagcaagaattcgctccatttcccctccattccagccagattgttttgcctttttctttttagcccgcgaatttcatggtgatttgcctttttcggtcgttgcccatgcactggaggaacaaattctttgctgcagattatgtgagatattatagattatagtatggaagttcttaagaagtttactgccacagttgaaaactcacaaatatgcatgaatgatttttttttagcagcatactgatcatggatgaatttttcactagaatatatttgagttacatgtaaattattactggtacaacactacaactggttcttctagcccggatttttttttagcaacgtgtgagatgtagattaacagaggtaattgcctctgaaattttctgtatgtttagccataaaggatgcaaccaaaaacaatggataaccttctgctagctgaaaaggaattcaggtgatgcttgaattcagggactaaattctaatctcacatcggatgtttggacattattttaactaattacataaataagagctaattcacgtgacaatttttttaagcctcattaatccataattagcacatgtttactgtagcatcacataggttaattgtgaattaattatgctcaatagattcgtctcgcgaattagtccagggttatggattaggttttatcaataatctacatttaatacttctaataattagtgtcccaacatccaatgtgataagaattaaaaattagtccatccaaacagcccctaaagccgtttaggggcatatgcgtgtgctacgtctgaactgaactccccagattttttttttgttttgaaaaatgtgatctctccagatacattgttcgaatcaatgccacggtgataagcaaaatcaaatcaagtgtgggcgtgtggcttggcgtgtccatagcgcttcataatcatatccatgagttcaaacaatcatactgttcgatcggttattagaccctgtttagatgggactaaaacttttaagtacctatcacatcagatgtttggatactaattataaatgttaaacgtagactattaataaaatccatccataatcttagactaattcgcgagacgaatctattgagcctaattaatacatgattagcctatatgatgctacagtaaacattctctaattatggattaattaggcttaaaaaatttgtctcgcgaattagctttcatttatgtaattagtttttgtaaatagtctatatttaatactctaaattagtgtctagagacagggattaaagttaagtccctggatccaaacaccaccttaatttactacagattgcattcaatggagatgattggcaacagaaaaggaggctttcacactggatcctgaaatatcttgaggctcaatctgaaccatgcaaactttagtgtgatctactgatcttgcatatgcttctatgtataatatatgctaagagcctatgggccagtgacaggagcatagtgaaataaacacttttcaagtaggtgtagtgttggcattgctatatcttattgagcacatataactgattataaggctttggtactagttgtatttggatcaatcaaaagccacattctgtgtgatcattaactagcttgaaagattattgtagcaaggcaacttttgaggagaacagctaaagattagtaagtggtgctatgtgtaagagcacctctttgtttttataaaacgtcggcgtcctttgttttcactagagtggatttgtaggcaacaacacgaagacctaagaatacatggcctgattgatggataatttggattgggtcgttgagctataataactgtgaaaaaagttcaggaagattattccatttgtattgtatacaaagtggttcattaacttattgtatggatcatagagtagatcaaacgtaacaggagagaggaagtgggctatacatgcagcagcaacagaaaattgctccgcaagtgtgcagaaacaggaaagttcgattctgccaaatataaaatgagtgccagatcgaatcaattctattcaattcaaaaatatttatacagacaaattggccctaagaaaggatttgctttcgatttatcatcgaaaaagctgcgtatatcagaatcgcatgcccgtcttttcactttcgactttttggcagttagggttctccactgacaaatggatatctccttgcattgctgaggacaaaatcatcagttagttgcgcatctggtcctgatattgacaagtcaaagcaatggatcatcgcattggccaaggagcaggaatcaaatttaaccataaatgtcgcttttgcgaagcccgtgcgtgcactggcttgcctcgatcagatttactttgctcgcttaaatctttgatcgaatccaattctatccgaattttgacccctaaaacgtatagagcggagaattgtttatatgtattctgaagtagctagaatcaggggagctagtctgcactggagcttagctcagcaaattaggttaggcacagtgtctcaccatctgcagggaagatgcccctatttccctgcgtgcagcactatgtatagccagtcaatataccctgcaacaactactgataacaactaggagtaatatatcgtacttgatctttttttctgattgcatgcgtgcaatgatgatgatccattgaatcattgcgatgtgccgaaccatgtgtatcacgctcacaaattgcaagcgtacgatctgtattcagaggccaaactacccatcttattaaggatccgtggttagctaggctcagtgcactgaactgaagtacaaaaccataagaaggattcagacaaacggaagtccgcttgcagagaattggggtcgctgtaaagccaaatctggcgtaagagcatctccaacagacttcttatcccactcttcaagttaaattttggtaattttggataaaaacacactccaatagcctagctaactggctagccaagccatccgactggccaaacttcttctcgcgctggccaactttggccagccaaaatcgcctctccaattgtaggccccacgcgttttccccaccccccccatcccgtacactctccccctccccagatcacgacttcctcctcatcacgcaacttctctacccatcccctagattcggcgcccctctagcctccgccgcgccggcgccctccctctgccggcactgcccctccgccccactgccgaagccaccgtcatctacaaccgagggcgtcgtcgaggtcgtcaggggcggcgtcgtcgtcgtcgtcggggtcgtcgtcgaggtcgttgggggcgccgtcgtcatcgttgaggtcgtcgtcgaggtcgtcgggcgccatcgcttaccgcctcccacctcgtctgccgccgtcgcctcgtcaccgcaaagccagcggcggcctctagatccggcagcctccccgcaccgcctcccgcctcctcgcgtcatcgcaccaccgcacgccatgcgtcggccgccgtcggcaacagcgtggtcgacacctcgataggaaggaaggaaaggggaaaagaaggaaaaagaaagaagaaggggggagagaggctgacatgtgggtccgattttattttggagagtattaatacacagtttgttggagtaagcatgtagtttgactagctaagagcatctccaacagcctctccaacactcatatagccaactctctatctaatttggctaccccccacccactctctattaatactctccaacaccacacggcacccccatttcagtctccactcctcttcttcccatctctctctcttctccttccttcgttttctttttctctttccttccttctcatcgtcgcacggagggcgcggcgccggcaaaggatgacaatggaggaggggcggccccggcggcgtcggcaaagcagagggcagcgccgtggaggggcggcgttgtggaggggcggcgcggaggggcagcggcgcggaggggcggcggcggcgtaggggcggcgaggagaggcgacggcgcggaggggcggagctggcggacgggcggcgccagcgtggatgggcggtggcgcgaagcggcgaagatgcggcgccggcgttcatctgacgagagagagaggggggaaagcggtgggacccacgatttggctaggctattttggctggccaaatttggccggcgggaggagtagtttggctagccggatggcttggccatccagttagctagtctgttggagcacgattttgctttaaaattgctaaaatttaacttaaagagttgaataaggagactgttggagatgctctaaatcagatggagagttggctatatgagtgtttggagagtttgatttggagaggctggtagagatgctcttggacgatcccactttcgtatcgtgatggagttgcggtagtacgtagtacgtaccatcacggccacctcacccaacctgcgatcgattcgggccgcttggctgcgtaacctacgtgtgcgcgcgtttcccgcacacacggatgcgcgcccgattttttttactctgagcaggatgagaaatatattttttttgttttagcatcatagaaattaaattagattaataagcaggacgttgtggtcatgtagcgtcctgttgttttcatggggatgctaccctttgccagcgcctaacttggacgcctggtgtttaccgtgtccttgaacgggaacctggacgcggaaacataatagcggccttgcccgagcaactgcacacacgcaacaaagataacgaaacggatcggaattgcacgctgctgagttctggtacctggcctattgctgtctttcttcattatcctacagttcatatccctaatcttctctcctaattttctcttactggagaactaataatgcccaaatcttacattagatgatcagaattcaagtggggatcgcagattatttgctctaaggtatttcttttggttgtttcgaattgattagacatcagtactaatcaagtagcggatttttagatttattctatttatatcctgcaatggttgcagcgctagatggagattatgattaaaaactttagtgcatcgatcaaataactatcatcatcaccgatgctgctagatgcagatgtactcctttgtaatatgcacagtagtcctttgcattgagtatacatcgcttatacttatagactgcacatatatacccattccacccatctaagcaacttgataaaatccaagcctcttcaatagcggctcacataaataaatggtatagaatgctaccaacacgtacggtgaaacctgacactcttacacaccatcattagcctgcatacatagggtaaaaattagtcaatcattttattttattttttggaaacaagtatacgaaacaagctataacttacatttttctaaacttttgagattttgagctggcaatggggcatccacagcagtgctactgaaacgttctgaaacactttgttcagtttgctgaactaaagtttgatctccatctaataagcctagctctccatcacttcttgcactccatcacttcttgcagctgaccgacttagcccatcttgagtagccctcatcttactagttaccttaaaaaaattaatagagcgtgtcaaacaatttacaattggtatatttttttctgcaactcaaaaattaggattgtatggtgattggtcctacagtaaaactaaatcatttttccagattatgtgcacactattgtctattgtctccttaatcatcttgctatgttgagaaaacaggccagaatggacagacaaattagcttacaagcacttgctacgatggctgttgctcatatttcggtcattgtcctctaaaacataagcacgaaacagctatcgcctgaggcagtatcagtgcaatgtatgaataaagaaaagaataccacacgggatttactcatttactcttgaatgcaaaaatcgaaaagaggtaatcatacaaccagtacatggccgtgtaagaggatgactaattaaccagatggccggacgccgcgcgtgaggccgagagactcagtctcgtggatgcgcacccagaacggccacgggcacacactccaaggctcgatcgtgatgaactagcgccactggtagccgccaccgccgcggccgccgaggctcatgatcggtgcttcaatggtgggtttctaattgggtaatttagaaccatgccattataattttacaaagtttgagatatgccatcgatatctcaatgacatataggacccacatgagtcaatgacatgtgggtcaggatggcatatcttaaattttgcaaaattataatggcatggtttcaattttccctttctgatttggggtactgtgagcagatgaatgtgtttttagaaaccttggacgctataacaacgtcgcgtccgctggaagactggacgctccagataaaccgcgtctaagagaatcttttacccctatgtcattaaaaaagttggaggttacgtgtgtgccataaaaaaaatttgagtcacctgtatgccatgacacaaactttcgtttaactgtgcgccactttggatggaatcagcactaatggagactaacggaggtttgaaagatctattttgccattgttctatttcagccacttttgcgtcggtggcggcggcgtgccggcgaggcaaggcggcggcaacggcgacgaccggcagcagcgtgcgggcgacggcgacgaccggcagcagcgtgcgggcgactgcgacgactggcggcggcggcagctagagaggcggcggtggatagacgaggcgcgctgccggatagacgaggcgaggcggcgtgctggcgacggcaacgaccgtcggcggcggctgctagagaggcggcagcggatagacgaggtggtgacggcggcgtgccggcgacaaccggcggcggataaacgaggcgaggcggcggcaccgtgccggcgacggcgacgaacggcagcagcggctagggttcgaggcgcactggaggagaggagtagtagagatgaaaatgcttcaagggcaatttagtcattttcatacgtgggtcccacatgtcagagctcattctctaacagatggtggatggaatggcacacgggtaaacgaaagtttgtgtcatggtaatacatgtaactcaaaactttttttggcacacgcgtaacctccaactttcttaatggcataggggtaaaagactccgtctaagagcaggtacaatagcagactattagccagctataaatatattttagtgagataaaagatgagagagaaaaacagcgggctacagatctatagccagctgcaacacagactgtaagatacaatgcatatatgacaagggaccatatattaatagtataggaagtaactattatataaattgactattagatttgctatatataaattagagctagtagtgagttatactattaaacttgctctaattaggctaacgggacgctaccaaatcacgccgtcctgtttataaataaaaattcacaccgccctgcttagataaaaaaaattatttcttgttttgctcagataaaaaaatggggatgcgcgcggatgttgacgaggagttcgctggaaagtggcgtcctgtcacgtagtagcggccgcattttcattccgccgggcgcgtggtaccggcgctccggcagaatgagagcgtcgcggcgggtgcatttcggtggcggatcacgcgcggaagccgcccgatagatgtgtttgtggcggcgggagcgctgtccatgcgcgcgatggtgttggcaccaggggcgttatgttaggcgcgcggttgtccccgcgtacttcccaaggagttaggcaacagtcgcggcctcgcgggtcagctctttcagcttccagagaagtataatagtgagatataaatctactataaacctataaacttaaacttatgtggagaagagaggtaacaaaaaaaaatcaaggggattgacactcatgcaaagactaacttaacacaatctcaagacaaatgcattaaatgtatgaaaactcaagacaaatgcattaaatgtatgagagatagagagaggagaagaaaattatagccaaacttatatctaatctattatatatatgttagctttaagataagctaagagcacccacaatagtaaaataaggtgctatctataaaacatgtacatctcagcaatagactagattaataggaaaccacttaaatggtatatatacatgggtatctatagctctctaatccattgcctcgtttttctctataaactatctccaggttaatagatagcttttatctctctcttcatttaatctcttccaagtaggaaaatatgttgacatagatctcttggagagagcctatagatagtaagtgagctatactagtatccttgctctcaggtggttgtgcgccgtgcgcgtgcgttccagtatatagtggcggatccaatgcaagacagtaggacatgtggtgtactgacttactacatgtttttaatagatgacgtgttgattttttatatatatcacacatttaatcattcatcttatttaaaaattttacgtaattataagttatttttgttgtaaattgttttatcacttttattgatttatatctaatataaatttttaaataagacgaatagttaaagatatgtttaaaagtcagcggctttatttattaaaaaaatgaagggagtacttccttaagacaaagtcattgatatgtggttctgctcggtagagggttcacattttagtcagagtatttcaatcctaattgtactaggttcagttcggtgttttggatttttttttttaagtggatccgctgtttatgcatgtagaactgcagcagctaaacacctaaacggcacgaaacgaagttatttggttcgatgaaacaatgggcgcagacgatttgcggaactaaccacgtactcaatccactttagattccgcccgcccaattgtgttttggtaaacttatagctgaattaccttccgattgtgttgaatgatttaaaacagtcttaatttgaactccatccgtcttagaatataagtacttttagagttagatacagatattaagaaagttggtaggattaaataggagatcgagtgttgcggttggaggagaagtgaagttaggtgggaaaattgaatggtggggaattgtgattgattaaaaagagaatgttggtgaagaaattgttatattttaggacaaattttaaaagcgagaagttgttatattttcataaggagagaatgcattaatttcatttgtttttgctctcgtgttcctgataagttcctgcgcaactgctcacacattgcacaggtgatactatacgtacatgtgcatacataaagtttggccagttgtacttgtacatatccctgcctgcagggatggggacattatcatagaagattttgcggggtgacgaaattactcccacatacgtactgctaatgacgaggctaagcaagtcagtgtaattaatcttttggtccatccaataatggtactatagttagtgtataattaactactctgacaggtacatgcgctaccgctgactgatcctagtgtaggacagttcatgcataaagcataaaaaccaagcaagcatgcatgtgtaacatgaaaggggcctaactaactcctattgtgttccacaccaactgatgcacaatataaaattttagttagcacctgcatgcgcagtcgttgcgtcttgcgtgaatgtcctcatgacgccctaaacaaagcatgtgaaaacaaactctgtcgagaaaacaagcagccgcaacgctctctcaacgactctacacccacaatatagtgagatctatatatcagcaacacgtaagctgcaattgcagacttattgggctatggtttgttggtaccccaggcttctcataatttaggacttgccaaaaatgtatggttagcaggagtacaggtgtcgcgaattgaagctagactaatctgaagaacgtacgtgtggccagttaggattgcgacagaataaaagttggagaccaagtagtagtacaacacaggagttgtaccgtataccgctcgttgaacctttcacttagcagatactgagaccaatttctcctcgatttccatgcagtttacatacactagctaggctggtttgattattttctctaaactgaactacctggtcagtgatcacctgaatggaaaaacagaggaaccaggaccactgtactggactatactcaacggtgcactgcaaagtcttctttattgccaatgattgtaactgaatcatctttgccaggagacaccggaggaggaatgacggaatgttcgctccaaaactcctataaatacagctccccgagctgcagctcagagcacacagaacttcacagcagcagcacagtgcaatattgcaaatggagagctcagcagctgagaactggtgggtgctgccactgaccttcctcccgcccatctcagggcaaaatgagagcgctgccacactgtcagccatggccacgagcttcgtctacctcgcgatctttgcatgccttgcatgggcaggcactgctctgctctactgggctcacccgggtggccctgcatggggcaagtaccggagggcgagggggcagagcccgaggtgttcgatcccagggccgaaagggctcccggtcgtcggaagcctcggcctcatgtccgggctggcgcactgctcgctggccgccgaggcggcgcgccggccgggtgccaagaggctcatggcgctgtcgctcggcccggtacgcgcggtcgtcacgtcgcacccggacgtggccaaggagatcctcgacaacccggcgttcgccgaccggccgctcaaccacgccgcgtacggcctcatgttccaccgctccatcggcttcgcggagcacggcccgtactggcgcgcgctccggcgcgtcgccgcgggccacctgttcggcccgaggcaggtggacgcgttcgccccgtaccgcgcgcgcgtcgcggggggcgtggtcgccgcgctgcgcggcgcgggcggggaggccgcggtgcaggtgcgcggcgtcctccggcgcgcgtcgctctactacatcatgcggttcgtgttcggcaaggagtacgacgtgtcgcgcggcgcgccggagtccggggaggaggtggaggagctgctcgagatggtgcacgaagggtacgacctcctcgggaaggagaactgtgcgactacttcccggggctcgccgccgttgacccgcagggcgtcggagcacggtgcgccgagctcatgccacgggtgaaccgcttcgtgcgaggcatcatccaggagcaccgtggcaaggcgatcgccggaggagaggcacgtgacttcgtcgacatattgctctcgctgcaggagagcgaggggctcgccgacgccgacatcgccgccgtgctttgggtacgatccgtgtgctttgatattttggcgtgcttggattaatatggcatcaaacagttctataaaagaggtgtaaacacatcatgcaaaactaacttttgttgtgatcaaatctgaaaaacaaaataaaacctttttttagaaaaagctacccccatgcaaaattccaccaactttttccctatttctttcagattttatatgtagaaagaatcatacaaacggatggtagcagttactccctgacgtacgtattacataaccaaatgagtaaataataaaaccgtggttacattaaattatcaggagatgatctttcgaggaactgacgccatggccgtgctgatggagtggacactagctcgcgtcgtcctccaccccgacgtccaagccaacgtgcaccgtgagctcgacgcggtggtcgggcggagcaacacggtcgccgagtccgccgtgccgtcgctgccttacctgcaggcgctgctcaaggaggctctccggatgcacccgccgggcccgctcctctcgtggcgccacagggccatatccgacacctacgtcgacggccacctcgtcccggccggcaccaccgccatggtgaaccagtgggcgatgagccgcgacgccgacgtgtgggacgcgccgctcgagttccagccggagcggttcctccccggcggcaaggcgcacggcgtgtccgtgctcggcgccgacggccgcctcgtgccgttcgggtccggcaggaggagctgccccggcaagtcactggccatgacgaccgtgaccgcctggatggcaacgctgctgcacgagttcgagtggacgccggcgtccggcgccgtcgacttgtcggaggtgctccgcctgtcgtgcgagatggcagtgccgctcgaggtccgggtaagcgcacggcgaaatgtgtgaggctctgcacgtctgcagctaaaggcgtgatgcaccatgacttgatcgtgtagtttgtagccgtgaccctcgtgcttgccgatagtaaataagcagctgggagaaaatgtgcaccagctctgctctgaatttggttcagtttttaaacagtttttattgtgtgtgcgccatcagtgactgagtgagtataaggcttccaattgtgtaaaaatatgcaaaaatctatcaaagataatatgtgtgcagtattatgtaaactgtttgtcatgtctacactatacctgcacgtgcaaagggtcgccatctcatattggattactttttcatggaacttaaattctgaaagcaatatcatcatgtatatggtaggtgttctgtctctgctctatcaatttgaccatgaaaattgccgtgcaaagcaaatgtacagatgtgtctgtaaatactggcaatattcaagacaagtaaaaagaaaggaggaaaggaacttgacaagaaaaattagaattggtaatttggaattcccttatcatcccagatccagcaccaagagcaaatttggtgtcaaactcttccatagtaaccccgggtcaaccccaaaaggataaagatagcaggagccttgcatcataggaggcggacagatttgctacggggtggaattacaccatccatctttattgcagaaagcccaatttattcagcgtcacgcaagaaaaggtacaattcatacgcacacctatccaacaaggcaataaggtctcacaattatatcaacaggtacataaagggtatttcaacccatatgcttgtcaaaggtataactagacgagcacaatgtacgatggcacagaccaaaatttcctctcaaataagcaccgcagacacttcaaacgagagctcatttctgattatggttgtagtatacttcagcgagcataagtaaaccgatgctaaaagggtcattgacagagaagtatggcagacttcacaccaagtcacaaccccagctccgaaagtagtttgcgccatctaggagtttcctcatcaaatatgtaggtcagctttgtcaccaagactccactgccaccaatctgcagttacaagttaatgagtacacattaaaacaattggatttatcaatggaactaagccatacacgttcaaaaaatatatagcaagggccatatatgttctgacaataagttctattatgagctcccatatcagatttatcttttgcgctgacagcagtgagaatagcacagaaacatcttttgataattactcatataagcacataaatataccttttactacaacattagaaaatttctaaagataagagacaattgcccacatgaaacagaaaaggaaaagggagaataaggggagataggcacacatttccgtttaaaagtattgaggtaaaatatcttacagatctcagctgttgaatggacttgtaaagagacttctgtggaactactacattaatcgcataatattccacagcaaccttcccatcacgtgagcggtagactggacttatggttgggccctgtttaaatcaaaatgagtgaatcaactcataagctttagtgattttccacatcagtatttcaaactacagtggttccagtcagataatcatgagcaaagcttttgctataagtttgaaatgcaaaactagttttatttcaaaggacctaaaagctttaaattgcccagattatgatgaagattaatcaggtctagatattagagcagctacaatacaattatatttccagttcaagattatagagtgctaatttatgaatgtggaaaataatattatttttaaagagatattttagcatctgccacataagtgcacatattc

SEQ ID NO: 21240 - DNA, 1594 bp, Oryza sativa
atgtgtgcgcgcgtgagaggaagggagggagaggttaggcttacctggctttccaaaactactccaccatcaatttccttcaaattattctcacgtaaggttgttccactactcacaagatccacgataacatcagccatacccatcttcacaggaggaaaaaagaattcttagcatttgttaaccttgataggctaattgtgtattatgtaagaacacacaagttcacatatcaagaatcaagacaaacatgccaatatagaataaagaagtaaagacaaatttcagttcagatctattacaattcaaattcaaattacagtaaagtatggtattggtatacttaaattccatgcagctttgtaacatactaacatcataataaaatagaaataacaaacaatactacagcggtacagacaataccatgcaaataccaatcttgtaagctgaaatattgggacagaaatatgcaaatttggttttactaggatctaaatataactattatggaggaacagaattgtgccatcaatatatcaactagataaacaaagaagtacaaaaaagaaaggaagtttaagttacaaagaaacctaagtaagttattagagaagtgcaatctcacagcgggatatgattcaagagctccatctccagctaaaaacgaaacatgattgaaaccattttctctcataaacttttctcctagctgcaatacaataaaataactaggtaaatgaacagcaaattaatgtccaagagggggggagcacttgaacaactttgagtttattcacgaccatacatatccaaatcctgtaacaacacgcaatggtctctcttgtgtccattcaggcatatttgccaaatcctccagagtatttatattctcgaaaatgccttccttaggaacctgatcatgcaatttgacagtttcagacagatacaaacttcaaccaagtaacaactagtacgcatggatgcaattctagaacaccataccgcaagggacaaacgacaatgtccaaactcgagagcatcatgaacaactactaaatcatcactaccctgccacaggaaatctcagataagtacaagtataaatctattaaagccttgctaagaaagtcaaataaatattaaattaagaacattatgtatgctataaataagtatagaagaaacttagtatgaaactagaggtatgcggtatgcactgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatctggtatcaga

SEQ ID NO: 21241 - DNA, 9918 bp, Oryza sativa
ccttccccctctccacacagcagccccccggaggtgcgccatgtccgacgctcggtctcagcgttcggtcgcctcgagcactcggcgtcagcaggacgccaagctcgccgcagcagaagagcgcaggcgagcaacggctcagaccgctgcagcagcagcgaaggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagggaccgcgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcaaaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagtgtgggacagctggatgagaacggctcacgcgtgttggtcgaggacggactcatgaggatttgggatcgccgtcgtcgccttcttgccaaggtaaccagaggcactaatcgactctacatcctcagcgcgcaagtcgcacatccagtttgcctcgccgctcgtcgggacgacgaggcgtggcagtggcacgagcgcttcgggcacctccactttgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgcagcagaggcggagtgcggccgcaagctgcgcgtgctgcgcaccgacaacggcggcgaattcacggcggctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaagggcgagggtgggtatgggacaaggcggtggatgatggttcgactccgacgtacgacgacttcaccatcgagtacgtccacttcgagggagctgggggagtaggcagctcttcttcaccgagcgtgtctaccccagtccccgagcctccaccgactccaacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggagttcgttactccgctctcccacgacggggagcgcatcgacgcgtaccatgacggcgagcagctacggtaccgtacgatggaggatcttctcggcgaccagccggtgccgggactggtgcctcgcaacctggaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacggccggacttggccttctccgtcggctacgtcagtcggttcatgcagtgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcgagtgcctcgttagctggcagtcaatcaagcagcaggtggtggccctgtccagctgcgaggccgagtacatggcggcatccgccgcttcgacccaggcgctctggcttgctcgactgcttagtgatctcctcggcagagatactggagcggtggagctcagggtggatagcaagtccgctctggccctggcaaaaaaccccgtttttcacgaacggagcaagcacatccgagtgaggtatcatttcatccgaagctacttggaggaagggagcatcaaggcgagctacatcaacaccaaggaccagcttgcggatttgctcaccaaaccccttaggaggatcaagttccttgagctttgctcccggatcgggatggctcaactctcccacaagacagcgcacaagacttagggggagaatgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatgcacaacccgagctaaaacattgagcattaattcccaaaatatacctgcccatattcactgactatgtcaaaaccaacaatgccaaggtcaagatccccagattgtagtttgcggacaatatctttgggcctctgaaaccaaacctccaagtttgggacctgcataaaggaaagaaaaaaatcaaaacatgtgatttaaatagcactgcgactttttaccttagctatctcctacaccgttatattccaatactaattttctaaacaggcagccacatttccacaaatagctgcagatcatgcagggacaaagtcataggaaggtaaagctgctaatgctacccatattaaatgaaataaattaactaaaatctctccaaactttaaaaccatatgcaagtgtggaaaaggtacaataactatgctaggtttcattaaaaatgactactgtttctaaaaggacatctccttgtattgtgaacacacaatgtgatcgatggggtattaaattgacaaggatgcttgaatcattttaagggacaaattttctgttgcttcatccatcagtgcaccagaagttcagacaaaattcgaattgttgaagggaagaaataaactaaaaatataatattgtataagatggcagtatttcactcatactgtcgaagggataaagtaactttagggtgtgtatagttccacgctaaaattggaggtttgattgaaattggaacgatgtgacggaaaagttggaaatttgtgtgtgtagaaaagttcaatgtgacgtttttggggttcaaactttggaactaaaccgggccttagtttggaattgctattgcgtatttattcaaccatcaaaagggcattcatactaacaatagtgcatatacaggaaatggtaaactgcaatgctttgaaaatggactagcccatacgtatacttatcaatgaatcagagagcctaagtggcctactaattcgatagtaggccaatttccagtacagaaatgacgaactgatagaagacaatgaatggagatggaaacctcacctgcgggatatctgcggtgtactgccgcgggttgaggtgcctgactgacaattggcaactctgcaccacgaggcatgaacagcataataacaacacaaagtcaacaaaatcaccacgtaaatacagaattcgatagatggaagcaggaacggagacgatgtgcgagaccttaaggaggcttagggtttgctcggacatgcggcccttgctggggagcccgatacggacgaccgtgcggtccgcgtacagcggcgccaccgccgccggcttcgcggagacggcggaggccgccgaagccgccgcccgcggagcgagaaagcgcgtcctcgccatccccatccccacagccgccggcgcgcggaggccggacggcggcgaggccgacggggagtggaggacggccgtgacgtccggcagcgtcgccagcatcggcgacattctcgcttgctcctctcggctctctctctctctctctctctctctctctctcccgcgcgcgcgccgctctctccgcctttcgctgcggcgaagcgtcagggagggggaagtggcggcggcgagagggagggccgtggatgcgggggaaagggagggttttagaggggacaaaatagacggtgggtggtgggacacgttggcgaggggaaccgaagaggagaaatctgacgcagcgcggcgcgccacagatgcaaagcagctgcggatattcgcgatttattttcggtgggttgctgtttggtggactgtgagcactcgcggagtcgacggtgggaggatatggatggctatgttttactccaaccaaaatctaccctataattaaataaatggttttacttattaatcgtgtgacacatccaacgatcgaaaatcatctgatgacgtcgatccaacggctccccacctccctcccgatccgacctcgcctcccctcccctcccccagtaaaatcaccgcgccctccctcctctttctatcgcgcctccctccagatcggatcgccttcaccggcggccatcccagattcacctcgaccgacggctgtccctgaaccctttggttgtacgcagccagatggccgcccactcgctcagtctcctgccaccacggtcgccggcaagactcccagcgccgacgtgacaaccggaacggacgagcttgcagccatccaagaatgggaggtgtccacctacggcggccaaaacacatggaggcaagtaacacatgtgagcatttcgatttgctgctccctgattgattggtatatcttcattgtcttggcccgagcatggctcagtttttcatttgttttgattagaacacgagataaaaatcagtgcacagcttggactctttccctagcccaaataagtccgagatgattgtttgcatcactgcatctgcaacagtaccaagaagtgcttcggaagtgtttgtggaatgacttcaaacaaaataatcaaacttgttcgtggtggcttgctgcatatgtatttaaggtaatagttgttcggctactatactctctatacgatggtggacgccctgatgcaggatgagcacaatttttaccacaatactatgtgaatccttctcatgtttttgcctttcctacaggtttgaaccttttggcattggcgaaaaaaaaaaggtttgaacttttcgtatttctgaaaggtattgccctactttgactaatatatatatgcttcttctaaacaaattgatggaaaggaactaaatttttttcatgcagaattttagtaagttgtttcctatcgacaatattccccataaaattgttacaccaatcctttttctgatgaagtggaagaaaggctcttgatatttctcaggttagtgctgccttattattgccatgttttagcactaatccttcatccttttttgcatgactcatttctcacagtcagattactactgtgaccacaacctaatccttttattagaactcatgtattggttaatttcttttgaggtgcctggatttaaccttctagccactttgaaaaaggaagttgaagtaaagtgggatttttaggagagcagagtcaacaactgcacttttctgtggtccttacatagggatatgaacacggaagttttggagtgctttccgataagatttgaatatttttggagtgcttctatagagtatagagtttctgatgacgacaatccaacggctcctcgcctccctcccgatcaattaatctctaacaggtttggttctaggtgatgattaatctcttccacagtttaatttgctgcattgattatttagttgatatttggttacagagctttttcatagctgcacgcaatggcatctatggcagcatatacattagtctaaccataataacatgaaaatggttcgaatgggcataatgcttggggctagcggcagctcaattgtgaccaacaacagtcaacgattattggaagggtctagccaccatgattacttaataccatgcattttattttccgttgcaaattatttctgtaatttgaggataatgaaactttggccagacttctataatgcatgagtcctatgtaaattctgaatttgatgtgagacaatatccccgcctctccctgttatccaaacaatcacaatcccacagtggagggcaattgggtggtgggagggaatctcccctgagaaatctatgcttgccgatcaagccctaagtgtcctgtaaatatatatcatcccttcaattaatatacttcaatatcatgaaagaaatcaaaaattgatatttgttttatgtcattctttgtcacaattagctaaagtcatctgttaatcaaaatattttaactcttgccggtttaaccattacctcttgcatggagtccctggcttaattcacatgattctaatatgttaatttgattcaaaaccctggcatggtgatttcagatatcaaagtaaatggataatatggacttcaggctcactatggtttggcattttgcaacacatgggaggagcaggcttacattggtccgatttagagaaaaaaaaaacatgcatgatctgatggatgatgtcgagcgctgctaggaaatgacaatgtaagggtttaaattcctgctgttgcttgtgtgagtttctactttcattgctaacgtacttgttggtggacagaaagtattaaggcatatctctggattactcaatgcagtgtgcgactggtgagaccatggagaagctgttcgaattggcacagttgacacttatttgatatactaagattttggtgtcatttatatgatggggttctcatgcttagtattttggaatctatatcctatttattgtatactgtaaagctcatggataacgaagttatgtctgcgatgaatggagttgatgggagagcatagcgatgaagcaccggcaaagctgcctttgatatgttattgtcaaaagacgcgaatattatggctttgatatcttattgtcaaaaagatgcggatattagggtaggacctaatatcaaatacttagaagtggtgaggcttctagcccaccaccctgtggagctagccggaataccctgggcaccggcgtttgtcatatactttctccgtttcacaatgtaagtcattct

SEQ ID NO: 21242 - DNA, 4277 bp, Oryza sativa
atgttattgtctattgagccgcattgtgaagtagttccttgtgatctaattgtgcttatgcgcttcacaagctccatggcaaggaaaaccttagtttaattaatttggcccatgtgcatggatatggcaaaaagtgatgatttacatgacaaatcaagatgtatcatggtaaatctttttgtgaagtttgttttccttaagtaggaaacattttcaaaatttgatgtatgttgtttacaattgaactcagaaatgtaattaaagtatgaattcgctttgtcctatatcttatttttacatcttgaatgtaattatttttcttataatattgtaaataatgtgttgtacgcatgcacgttactataaattctatctcattatatgcttggcaaaacatatatcttattttggttgtttgatttgtattattaaatatttccgtagcgttagcacgggcagattactagtatcatctaggacgtttactgtatgtcatcgatttttaatgttcctcgtatgccacatagacaaagaaccttacaaacctcatactccagtgtaagtagccttgagtagggtcgatgtgaaacaacttttcctctctctccccaagcttttccttcctctctcctcaagagacgtgcctttcccccctctctttctcccctctactcaacaaggcgggcgacgaacggcggaagggtcgaggaggccaagcggcgacggtggcgggcaggaagccaccgtctccggggccggaagccgccatcgatgtcgttgccgagctcgcccgatctggtggcggcgtcgcggagccgaggaccgccacggggagagggatggcggcgcacgacgattccccgcgggcctgccccctcctctcctcccactgcggccgtcgacctccacccaccccaccgacggcgcggaacgaggacgacgacgaggttaggcgccaaattcactgccgccttttccttcgccgcctcctcttccaccgccgctgccttctcttctctccaggacgtcgacgctgcaccgtcgacctcgcttgatctgtctagcgcaatctttgggggcgatgaagcacggggccatgccctctcccaacacgtcgtgcatcccgttcctcgtctttcctcacctctcgctctgacgcatgcctgccaagcctaggaagaacgtatgatatcccgagccagggcttaataggattaatagaatactcatatcaacaagttgcaacttattttccagaagccgatctcgaaagaactctgaggttaagcatacttggcctggagcaatttcgggatgggtaaccaatcaggaaattcttcctgagtgcacacgagtgaggacaaagtgtgcagaaaagacttgtgttgatctgtgagggcagtctatgacatataagagcagctagatgtaagtgggtccggcctgggagaggcggtctatgacatataagagcagttagatgtaagtgggtccggcctgggagaggcgggccgttacagaacgcgtgcccaaagttagctccgtggtcttcaatagtctatgacatataagagcagctagatgtaagtgggtccggcctgggagaggcgggccgttacagaacgcgtgcccaaagttggctccgcggtcttcacttggctacgccaaatgcatgcgtggcatggaatctccgatgtggtgagttgaggcagaagccacgacgacacatataagagcagctagatgtaagtgggtccggcctgagagaggcgggctgttacagaacgcgtgcccaaagttggctccgcggtcttcacttggctacgccaaatgcatgcgtggcatggaatctccgatgtggtgaacatataagagcagctagatgtaagtgggtccggcctgagagaggcgggccgttacagaacgcgtgcccaaagttggctccgcggtcttcacttggctacgccaaatgcatgcgtggcatggaatctccgatgtagtgagtcgaggcagaagccacgacgacacactgtgaacgcccttagggatggaaggagtagtaatattgttcttttcttgttatcataccgatttcatcacgattttgattagcacgtttttaaacttatgtttcatgtgaaaattttctacgtggtttaaaatatcaaataaatatattgtttaattttataataactaaaacttttgtgaaatatatacaactatatgtatatataaaagtatatttaacaataaatcaaatgataggaaaaaactaataattacttaattttttaataagacgaacggtaaacatatttaaaaaagtcgataacgtcaaatatttagaaacggagtgattattaattaagtattagctattataaatttaaaaactaacttatttatttgttttaaaaaatattatataaaaaattttacggaatatgctgttaagtatgatctgttgggcacggttccagctagagctccatcttttctggagatgaagcccggtaaaacatttcagctccaactaaaatgggaatagagttgactgaagcgctttcgtaaaattaactaggagtgaagctaagtttaggctgcttcatgtacgatttgacttttggagttagttttaaatgttagagttatatcaaacggacctacagtttgggaaacgttattataggaagctacggtgtagccattttcatttgcggtttgaaagtgacccttagagcaagtttaatattatagccaagtactagctccaattcatatatagctaatctaatagcttattaatatctgatcctacctgttatacacacactacgttttggagtccgtgctacagctggctacaaatctgtagcccgattcacttctctctccacatttatcttcttaaaatatgtttgcagctggtttatactctgctattgtatatgctgttaaagataaacttgaataaccaatccgaaaataaactaccctaggaagtaggatcttctttggtcaataatttttgattgctgacctcaggaacaggattgacactggtgcgcgaatttcatgcgtggcatgaccaattgaccagtcgcatccgaagggaaaacttgccatgactgacgagagtatccacaccacacggtccacaccgggaaatttaactatttgccactcttatgagtgccaactctccatatgccactattagatttggcctaacatatttgccactagagagagattacatcctaattttttgccactttcgctgagttggagcgccacatcatcatgccaatgtggactggcctggcgaaattacctttgtgcccttgtgcagaaacgagaaaacagggggaaacagaaacgcatcggcatccatctctttctctcgaccacagctgctcaaaccctaccgtcgccgccctgaaactctaccgccgccgccgctgcgcctgaaacccccgccgcctccgccgccgcctggatccctattggcgccgccgcctgaaccctactgccgccgccgcctggaacccacacgcgccggccggccggcgaggccgctactgcgtgacgcagagcgagtcccgtcgcggccggcgggagcctcacgcggccgccccgctgccggccctgacgccactgcgtcgcggccggctctcacgacccagccggcagcggcagggcgagtccccccgctagctcctcccctccaccgcgcctgcacgcgacgccaacgcatcggccggtcatccgggacgtatagctggcggaggtgaagtggatctgatcgtgatgaagccctcggagtgtcctccttggtaaattcattccccttctctgtattccccttctcttgactttgtgtgaggtgtgcagcatgctgttagaattgatcctggctccattttttttgtcaggattgatcctggcaatgctgttagagttgttgttaaatgtgcttcatatgtagcaaacttagagtatggattgctatcaatgtcagagcaagagcatgattggtgggttgataaatgcaaaggttatagtttagataaattctgtgatgatatgactagcaaggtaatatgggggcctagccaagaaattgtagtgtggggattagactttgatagtgggactgaatggaaggtaaccaacaatgaacagtttgagaagtggtttcagtctgggtggaaagagaaagtggtatatcttggggtagaagtggttactaaaaagggatacaagcctgctga

SEQ ID NO: 21243 - DNA, 1078 bp, Oryza sativa
atgtacactcatgtctgcccatcgcagaaagaaaaaaataggaaaaacagagactcatatctgtccaaaatcctgtattgggtctgatcagttcggtgatcaccagctttctttgccttgatgggcctccagcctgtaatggcgtatcaggacgaccttgtttttggatagtttcaggcagaccttagtttttttttctcaataacgaaatagaacatcccggtctttactcaaaagagttagagttacagccaagacagaccttagttagggcagcgattctaaggtttgagcaattttgtttgcctatacagaacacaacttgttacagttgtttgaggtggattgatctacttgttctaatttggaggcgttcacacaattattgagtttttaattgccaacaactcgaccgttagtctactaatgacctatatattcacttgaaaatggtacggatgatggtaggtggtcgacacagccgcctgcatttgatttgtccgtgagaaatgccaaacgggaaaataagaaagaaaaagcatcagacctgagctaaggagtacattgaatattagccggccctgaccgatgctttgctgctccaatcacgcaaattctatggcccaaacattcttcgcactacaataggatgatgggctgagcatatatcgcacgcatgtctgcttctgcttttgagccttttttctgttcccattctccgaccaagataaaaggtgaaatcgattgggacggatctcttctagagaggcggttaaagtggcctctaggatgtcgacgcagagcaacctttggaacagcgaggaaaatgacttgataaaggcgttaaagcaggggagaggcattataggattcggtgacagggacaaacaagaccacaattcgaattgttcatcagtcagcccattaagatctcgtcggatcaaggagatggaataaaggatcaaactcggtacatgtgtgcataaaaggtacaaataatgttctgtgcaacgagccagagaaggcgtaacattttatttgacagttgataggagtatatttcaatgctagtagacgg

SEQ ID NO: 21244 - DNA, 11149 bp, Oryza sativa
ggtgtataaaaccagtcgtcacgcacacgaatccacctcggtctctctcttctccgaagcgacccacactccccgtgcccgagccagagagtatggccgtctctgtccgttgctgcttcggctcctcctccctttcgcaccacgcgcgactactcctcgtcatcgttgcgttgctcgcgcctcggctcgcttccggctgcgaccgctgcgtgcgccgctccagagcggcttactacacctcctcgctcacgctgactggtatgtcgacacgacggctctgtttttgttcgtggttttgcgtgcagagggagcggccggattatggatcgactgattgattctgttcgtttgttcttgcgtggcacagccggttcttgcgggtatggcacggcggccgcgaccttcaacggcggcggattcctcgccgccgcgggccccgcgctgtaccggggcggcgtcggctgcggcgcgtgctaccaggtaatcaagctcgatcgagaaggagaacacaaccgaagataggcaactagcttagctgcatatgccatgtccatggcttccccatcctgaccgattcgctgctgcaggtgagatgcaaggacaagaagctgtgcagcaacgcgggcgcccgtgtcgtcgtcacggaccgcgccaggacgaaccgcaccggcctcgttctgagcagcccggcgttcgccgccatggcccgccccggcatggccgcgtcgctcaccgagctcgccgccgtggacgtcgagtacaagaggtaagcaaagctcaccaagctttactttttacccagctcgctttcttttcaccaaccgcaccttagctcgtgttccacacatatatagataaatattaactttaccactgttcaacagagagagtttcaccggtccgttgctgtagtttaccagttgcaaagcgtacgtacgaaatgtttggcaagtgctaggcgaggcaatagatagtgaacacgtacgattgtcctaagccggaattggaagtcaggctcaaattcgtcagcgatgtgcatgtgcagggtaccgtgcgagtacaggcacaggagcctctctgtcagagtcgacgagagaagtcgcggacccaacgagctcaccatcagcttcctctaccaaggcggccaaaccgacatcgtcgccgtcgacgtcgcccaggtaaaaacacagcacagcacagaacaatcattaacaatctgcaagtgtttgtgtcgcagaatctaacaatcgtgtgttgggagctgcaggttgggtcgtcgagctggaagttcatgacgagggagcacggaccgtcgtggagcatggcgaacgcgccgccggggccgctgcagatgaggctggtggtgaccggcggctacgacgggaagtgggtgtgggccgaccgggaggtcctgccgaggcggtggcgcgccggcgaggtctacgacacgggggtccagatcactgacatcgcccaggaaggctgcttcccctgcgacacgcacgagtggaagtagaagcccagccacacgtacttctcctgtcgtcacggccattttggttgggctttgatgagaaagaagacgtctctcggctcgcctccagtagagatttcactgacccgatttagagtcctcctaatccctcggcaacttcagaatttcctcctccgtttcttcttcttcttttccaactttgtacatgagctactaactaatgtgtaaagataaaattaaagcaagttacaaaccgtcccgtcccattgggagcctaaacaactaacgaaaaacgaaccgaattggcgccgccgtgaagcaacaactctcctgagaacgtttgcaacaaccaacgtatcgcagtttcaaagggctcacatgctgttgctgcctctggcctgggtgtgttgcttccggcaacattcctctctaccctgagtccctgacacatggcttgctcggctgcctctgcctacggtgtgcttggtcatgttgccaggtgcggagctaaaacgaaatggaggatggtaccacttgcttaatttactttagtttagatcgaatttaagctgatgcggatgtctaagtttatattgagagggtacatacatgataagaatagataagatatagctaaaataattttcttaaccgggttactggcaccctcctaatatacagcccctgcacgttgctcgttgctgttggtggtcagacttgctgacggagctggtcgttaaaccttatcagaattctgcatgaaatgtgaggtgattaccgaaccgtttccattatctgaaaaaaaatgtgaggttgattacttacacgagaacaattacgagggatattgcaattcagagtttcagacatgtatgtggtgggcatcagggcacggtaggtgagtgggccataaatggcagtcacagccatcatggacaccgcaactccacaagtccatggtgcgaggtatgatggccagttgcccgactgaactgaatgtgccggtgaaagtgagcttttaaagtgagatttccctcgcattacgttgccagtgatcgtgtctacgtgatggtacagggttggatcaacacagcatcttctgcctttcgatctgaaactaggtactagctgcaagtgaaccagtgattcagacttcgaagcacttcatttcttcatttctgctgcccaaattgtccattttctttttcaaaacttggctgtccacgctccacggcctaggaccaggtcatggcttctaatcaaacagctcatgaacgcatataaaacgatacgtttgaactaattttttcacaaacaacaaaaccggtggtagttgaaatcaaattaaaatggagtacttgaaaccgagggttctgcaattctgctcagcgccaaagcaatcaaacatccgagcaacttagcaactagcacttgagaaggttaggtggtcaaccgtacaccatgcgtgcagcagcatggatcaatcgatttgcagcaccagcagccaacaatctgatccgatcactgaggctccaacatttgtaggcaagcaacacgatgatcactaaagcaagtatgtcatgtgtgagagcctcgagtgagacagagcggccggcccggcggtataattcactgtccccttgtgcttagcttgcagtaggaattcagtaacctccaacacttggcattttgctgccgtataatcaatcatcatacgagccgaccagcacaagaaagaggactcgaatctagtggttaggagaactccaaatgaacaactgaattttaatcacgaagggtagttttgaatagttcttgttactgtctctgtttgcttgtttccacacatgagcctttggtttgaggtccatgttcttgcccaattagattcagaagtacaattctggttaggtgtttcagatggttgctcatttaggtgcacagaaatactagtgacagtagtattgaagagctgttgccaagttagcagaggcaagtcttgtacttagtagatatatattaagtcttatcatgcattcagacattaggataatcctaagagccgaagctaataatgttctcgtttggttcagtgaacaaaaaaatggacagctgatttgtaatattctgattctgtttcggataacagaaatcacaggtcagaatcatgagtactgtgcatagttctgagcttcttatccattagtaggacagggcgttcttattattatttttctttatctaaaaatattaggacgcaactagtgaaacagatggggcaagtacgcatcagcttcatgagtggatttatttgggagccatgaactccatcttgtgacttgtgaagagaaattggtggcctacctaaaccaacggtatctccattgtagttttgtaattgtgctaacaccaatgtgacagttattaggtgacatttttgttttgatcatgacaagatagaaatatatatcatgcaaccccaatcgaatataactactacgaacagagccaagtgacaaaatggttgcaatatttctttttcactttgttggctaacgaatcaccagcataaaactgatagtttatttcatctgccgacgtaggttgctagcccaagtattcaagctgaagtttgcaaagatgctacttaaatgatgacgatagcaactctatattagattattgagacgatgtttcagagaaatcggtgatgttactttctgaaggatgcggtgtcacacaatcacgaataagtgggtcactgttgttcaagcaggaggagttggtggcgactgtattaacaaaacctgaagagaaaatatgaacagagagcctcttaatttgactgaagacaatatttagttttaaaaaattgactgaagtgtgaagacataaataacgatctgacgtttgcagaaattttatgtgtatgcatgatatcagtaaatactatgttgttatggcgacacatgttgtttcatcttcagtatgacttgggttcagattctcgggaccccaaccagtgttcatagcttgactaggtaatacttgggccagcaaaaacaaagtaacagtgaatagggcaatgattgattttaggtggtgtttatattgtaaaacatagtgataagtcaggctcagacgtgttacctcaagatgacatagccacatcatgataaatctcgcttaacctagacgctcggaaagaaagctttggtgtcgttgatcagcacgcaactaccttgcagaagatgctctcagatcacatcgactatagcctttgtgcatatatcggcctactatcagccacatggcagggaacaatttgccaactcagatgaaatttatatggaacagttcagttacctgttaccgcatatatatgaaacaaaatataaataccatgttctagacagtgcatgaatctccatttggaacacctaatttcagatgaagcagtttaatcagcagaagaatctggaaaaatattattgatctaaaccggaatctggaaaaaaaaaaccgggcttaggtttttctgggccttaatctacggattacagcctgcagccaggaggatacaaacgttttgacgtcagtgggccaagatataacagtaccattgagaggccaagaatccaatacttatccggcctttcaagatccttgtccgtttatgtgttgaggtttgaaaatgactggttttggctgtagcctgtacgcagttacttaccaccgatatgattcatccaaatttggcttgctcacgttagtaggaaatcagacaaaataagagtacaggaacaaaaagatcaattaaaaacaaagggatcaagatcaactatactaattacccatttgatttttgtgatgattttcggcaagtcagtcacgcatactttggcatgttgaacttttcaaaattcaaatatgacggacctgactcctcatggacaagttcgacccatcttgatgcattcgacatgccaagctactgatatgtgtcatcattgcctctattatgcacatttgggagtagtgagacgacagcaacaggcatcacatcaagaggaggaatgtgtgcgttcactccaggaggatttgaaatatttgaatcacttttcaccaacccagcatttccttctgttatcagttgaacgcccgaaggtgcagaatcatcccagcatagagcgaatggtgtgtcgagatcacccttggtgtaggttctaacttggtggaggtccagacccggccgtgcgcctcctaagccggcccctcgtcatccgaatagcctcctggatgagcgtatcttcgtctggtattgatgactgacgtgcgttgcttgttgatggaccagatggatcaatctgcatagcttcagtgttctgagggccgtcgctggcgttagcttgaggaggaccagcatgtgcctgtggctgggcaagagactctgcaccaggaggaggaacaggaactggagttgtatcctgcgtttggttccttggtggagcagaaggagcttgggtgggttgtggtggcagtggaggcaccgaaggtgcaggaacaggctgaggtgcagggttcacttgccgagtctgtgctggtggtgggcgctgctgctgttcacgtgcctgcagaatagaagggttgcagtgaagtcagtatgtcagtcacacaaatataaactgtcacacatgctcgctactccctccgtcccataatataagggattttggagagatgtgacacaatacatggtcctaggatgtatcacatcccttcaaaatcctttatattatgagacggagggagtaataaatatatagaggtgcaaacaatcttttgaatcctacaactggtaaacaggacattaatactagaacagtaaacatcacaatgtgctcaaataacaactctatcgtgcactaacaaacaaaaattgttgacaccgccttataaatggcatggttaaagagtgcaacatttagtaattcaataaggaggtaatccaagcttctcaagtcacctactgtagtaaaagatcataacaagaatgaggctagtgttaatataaaaaaaataccatgaacagatcaaactatactagaagcaaaaatacataaatggactggggagtaacatcaacgttttaaaagatacctgtgggcgagatgtttgggtttgtgactgtgaagcaacatattgcaagatttcataaagccttgtctgaccatagttggaaaccttctggaagtaaagaaccgccatgtcgcaagctctagtcctcaactcaagcagattgtgatcgatatcagcttcgtattttgcaatccacggtttaaagaatgattcatacacataggcagtcccctgaaatcaacctgtgttaccaacaaacaagagatagattcttctagcagtttgaaatactagagtaccataccagtgttttgggataccacaaaaatacgacaaatgccagctttgcttcactgtacattggcaacctacacgcaaacaaaattatcatcagcaagcaggtaagatttcccctttactgttacacctgaaaaaaatacaattccaaatggtcaacttaccatgatacaaaattatccccaactctatcaaaaacagttagaacagcaagtaaaatcctgcaaaagccatgatcacacagctgagatcaagcataagaaatccaagaatgatagtccaaaataaaacaaaagggcataaaaagcataccagtactgacaccagaaccgcaacttctcgatctcaggcttgttcagttccaccgtcttgtagcaatcataggctgggtatgcatatccaagaataagcctgcaaaataggtaataacaaacatgtagcagaccaaaaccattacctactgcagtacttttgtacaaaaactgctgctacttacattaaagccccagtaatgaatgagccagccatattgactgttgaggcctaaaggttaagaaaacaaacatttgttagaaacactgtttaacagccaataacagcatccataaacaaggatgtcctatgagcatcgaatctacagcagcagttacacataaaccctcatcaagctccttcacaacacaaaacatagataagcagatcattataccgctttggcagttttcaacttttgctccccttattaatacagtcatcatgcgttttaaaaaatagtattcaatcatgactgcatcgtagattcatagtagcttttcggacccttaatttatagatttcagattctctataccagatccgttccaaataaaaaaaaaactgctataccaaaggatgaagagagtgggggggaatctatatgaacaacctacttagtaaacactagtgctaatttgaggagtttgataacggatcgacttgaatccccaaataaaaaatcaaacgagctgccaaaattgcttcgctaaattgaggaactacctagacagtaaagcaaccccctacaaaggcaatcactacgtttgtctcgcaaatctctccaaaatccaaatgcaagctgcttacaccaacatggaaacagagtgcagaacatacagcaaaaggatcacatctcaactgcaacagcagcctaatcccatatctgacaaacaacctgatgatactcgtagcgtgtatggaaagttggaaacacttctaacgggccgcgaagctacggcaacaaatcgaaacgagggagtatacctttcctccggccacaagcaacggctcgatcgagcgagcgagcgagacggcggcgtcggtgctgaccgaaggacaagagggcggagaagctcgtgtcccctgggcccggggctccgacgaggatggcgcggtcccgcagcgaactcgagggaggaggatgcgaggctagtattccggcgtctcccgtactcccagccgccgccgccgcccgcggctcgccggcgtagtgcgcgagcaaccgcactgtttgcgcacgagaagtcggcgacggtgggtgtttcggccggcggctggcggcttgggctgctttatattgggccgttagtgggtcgttatcttgggccgttttagattgggctcttacttctgagacctcttgttgctcgtgttcaagcccacctgttctccgctgcttgcaccaatgccaatttcagtctcagaaattcagaatccacacacaagtatgttgtcatgttcagattactgaaaatgcaggtgtgcaattagccactaagctttaaataaatactaaatttgatactggtattagttaattctttgcactcatgcagattagtattgtcggttacaattgtttgcactcatgcagatctggcgatctcctgctataccgggataccagttctctagtattgtcaagcttgatagctgcagcacatggctgcattcatcgatagatttttccgctagacgaacatgctcacattctagagacagatgccgcagccgtgattaactaactcagccgaccaaatcggcggccggtggcgtttgacataaaagaatctgcatattcattctagtcgctctcgagaaatgcccaggggttttccggctagctttacaaggtggtgggctagacgacctgggttcaaagcctcacccctcctaattatttgatattaggttcttccctaatattctagtttttattctagtcgctctctcacagtcacgtactgcttctcaaactacatgcaacgacattcacgaaccccaaccaagtcaatttggcttcactgcaaacgatggacgatacgattggatttcttgtcgactactactgcagacttcaacgttcaggttggagattctatccactaagagtgtgtttatttcacactaaaattagaaatttggttgaaattggaacaatgtgaaagaaaagttgaaagtttgaagaaaatatttagaactaaacaaggcgtaaatgatctgaagctagaagctggtctggataataatcttcagtcatgtcagtaacttctgcggttttggctacgaaaagcatttgcaacttgaggtgtgtttagtttacatcaaaattaaaattttggttgaattggaatgatgtgacgaaaaatttgaaagtttgtgtatagaaaaattttgatgtgatggaaaagttgaaagtttgaagaaaaattttacaactaaacacggcctaagctttaattcgtgcacaatataaagtactagtactatgtattagtacataaattttgaaaagaagggtgtgtttagttcacgttaaaattaaaagttttattaaaattaaaatgatgtgatggaaaaattagaagtttgtgtgtagaaaagttttgatgtaatggaaaagttaaaagtttgaagaaaaagttgggactaaaccaggccgaagtagtacataaattatccggtctctagaatgctttacatcagcatctcgtgatccttaatgtgcgtaaagagggtgtcattaattaacaggtcgttcagctgatcatgctgaccaatttgatcaatgatcaatcgatgatgatgatgaagatagtatgtcacctgctaagtgacaaggatggatggcactgctggcaggaggacacgtcgcatgctagcttttaacatcgagagccccactctacaaaaacacctcgagatttgtagattaatcagagcacagttagcgttcattaaattatttgcagtgcaatgcatctgatacacggttattgtaccgcctgttatgctcttcattgtccctggtaggccatggtgcggcaattcttttgttgcacgctttcatgtgtgtagatctatctgtttatctggagtatctcattggaatccctaaacaaaggtgtgatgcaggcaagtactaaaaatcacgagcataggttgtagacttgtagtagcacaaaatcgtagtggtataatataatttgatccatacataagagcaaacggcctttgtgttggtatatcagccgtagtctgcaaacactaacatgtggtcatggattcttccttccagattcagggggagtcaaatgcatcgtcagtaataagcaggacataggaaaacctggaaaatcttagtgcggacgtgcaaacggacgaaaaggatcgtgacagggcaacgggagatgatcagctatctagatactccaaccaccctgcatgcaggggagcttggaaacaagcctgcagcgaactaattctgcacaaataacaccaaaggaaagaacaccaaaggtcttgatctatagagttgatcacatcgacccagccaaataacaccaaaggaaaataatagtactacgcgagatgcatggattcagaaagggacaccaacccaaacccaatgattgatttcatcgtctcacagtccgatcgatcaatcgatccatgtagggatgaaccccacatggaactatcgaggacggtatggagtagcagcaaggccagtgccagcggctggcaagtcgatcgcaatgatttgctgctcgtacggccccgcccccctccatttgcattgcaccagacgaagatgagcattgaagtcgcgagatatcgcgatcgatcgatccctctccttgcagcgcaggccaaccggtgtcaaacgtcccaatcgcacga

SEQ ID NO: 21245 - DNA, 5320 bp, Oryza sativa
gggacagcggagcggaggggccccggtgcggaggaggaggagggaactaggggagcgaccgagcgaggaggcgttgtggcgcgcgacgccgacgcgcgcgcgcggccatgacggcattgaatgtgggacgggggagtgagctgtgatgagcgaggtgggccggcgcgcgcgagggggcgcgggtcccgaggcacgcaccggcgcatgcacgtgtccgcgcgttgcgccgtggggcgccacacgccaggtgctcccacaccgggtggcagggcccgcgccacaggtactggccctaaactaactttactctccgtgcaatgcaagaagagatgtgctgccaatttgcacctgtatactactacctgtgtaatccaaacaagagtccaagacgcttggagcgagtttgaatttgttattggcctttgcgaatttgaatttatataaaaatatttagtccaaaaacgaaaatgacctatcaattcaagcatggcgcaagcgtggatctgaaatattttgaagtccggacaaacctcactataactagtactactatttaatataggaattctatttgaaaatttctaattatatgatattttaatggattatccctcgataagcccgggcatctgctcggggtggccggatggtaggattatcctacttcctcatataggagaatcatttacatctatggtagtattttctagtacatgtgagcaatttttacatgggatattttttatgttacatgtgatattttggtacataagagttactccatgtgctaatatagtaggagtatgtcggtcgtgaaaaaaaaaaggagttactccatctaagtagctaaaaaacggcattactgtttgcaagccacaggacgttggcactgacttttcaattttcactctccattcagttcaaaaaaattttcactctccataatgtactaccctgctgcacaagcaaaggaaatgaggccacagcaaatggttcgttaaacgagaaaatttaccctagaaagaaacaaataaacttattgaagtggcccagaacagtagtacgaaaaacaggcacagtacactatcttgtcctaactggccagattaccagaagaatcctgtagtccgctgctctccctagcttgttgaacacggtggttataccccttcaggacggacttcagaaccttgtatcgtaagctgatgctgcccaaagctcatggggggagtgaaaaatccaactcctactcgcgccactccgccactggcgcctggctagctgccgaacacagtatacaagaccacaccccctcccacccgtgcgggctctaccaatccacaccacaccaccctataaaaacgcccgcgatccacttgccacaccacggccaccaccaccaactcgatcgcacagcaaaaagcccatactgccaccgcgagcgccgggaagaacacaacagcttctcgagcaagccggaggtgcacgacgcagcaaatggcagcgggattccgccgacggctcaccgcgctcaccatccccaaggcatcgtcctacctccgccggacgaggcacaagaagttatcgtactcccgcgcccgctccgctagcctccccggccgcttccacccggtcgtcaccggcctgcacgagtcggcgagtgctctcctcgggtggactgatgaggcgccggcgcaggctggcacgcagtggatcggcgaaggggtcggccacctggcgcggctcttggcgggcttgacggagctgctccaccacccgcaggcgcaggacccgctccggccgccgcgcaaggcggcgccgtggacggagcggctgctcgacgacctcctcctcctcgccgacgcgcacgggtgcttccgcgaggcgctcctggcgctcaagcagctcctcgccgaggcccacgccgcgctccgccgccgcgacgcgacccgcctcgccgccgcgctgcgcgcgcgccgccgctcggaccgcgacctctcccgcctcgcctccacattgcgtgacctctcctaccgctcctcttccgccgcagcgacgtccgactccggcgaggccgcgctagccgaggccgtcgggaccgccacgtgcgcggcggcggccgcgtccgcctccttcttcgcgggcctcgcgtccgcctccgcctcctctgcctcgcggtcgttggcgtccccgaccgcagcctctcccgcaaaggtagcggtcgcgccggtgtggtgggtgcccgacctcctgcggtggcggcggcgcacggtgtcggtcgctgcctgcgagtccggcgcaggcgcaaaggagacgccattggacgaatgcatcgatgaggaagaggaggaaaggaaggcggccatggatcggctgctcaggctggaggagtgcgtcgtggcggcggaagacggctgcgagcaggtgtaccgggcgctcgtgaacgcgagggtgtcactgctcaacgtactgacgccgtgcttttgatcttctctggagggaaattcctggaagattagtgatcaggacaatgcggatttgtttgacatcattcttcttagtttttggtaggttgcgtacatgatgtatagggatcgtttcacaatggaatggaattgtgtttaggtgaaatattcagtaaaatttagttattagctttcaaatcaaatgtctacacaacctcactttcatggattacctccaaattcagaggttgctttcctgttcttaagcgacaagcagcaaccatataaacttatgttaattagaccttgatttggatgcgagttaatgtcaattgctaaaataccaaatggtatctggattcagctgcaattttattcccgtctcatttttcagctatacgcagccatgcagggtttggctctgaactgaaagataaccgttaagctgagcatgtgaggcctctgctttttattcacatgcatttttcaatcgcaaagatgaatctttgttaaatcgcgtaagccgttcggtcggtttggcatcacatggaattgggtcaaggagttaatgtatcacgttggaatcgaacttaccaaattgtctttctatttaagctggcgtttaggtcctttgatgcaggctttgcggctgcattctatagttatgtcttttcagttatttttagcacttaatactaatatactgaaaggagcattgaacatttaactatgacattgtctcagtgcttaaagtagtagcagagtataatgtactagcttcggtttgcaaagaagaaacacaaatgcaggcaccgttcactgttcggaaacgcagaatcagttcctctttcatcttgttagatctttcagataagttgggtggttgtgaaggttaatgcacctaaagccagaatcaagatcgtcagtcaagagaagctgcacttttaagccggatctttactttgcaaccaaaccaatacagtgtacatgccccagctttagcgtgctcatcaaacctgtgcaacctataatttatctagctagaaggtcgcgatctaaactagaatcggaagcatgcacggatccgtataatttggcgcatctgaacactgaacttgcgtcggctctgtactgaaaatctgaaacccaacatctctaaagaactagtcatggttggtcactagttgtgttatcagaacttagaactagtacaattatttattttggtgactaattctccaatcattttgcaccacttagggtcgaaatggacaagctaacggatcggttgtgttgtccttcttcccaaagaaacaacaatgtcatcgctcgtttctgtcgtcgtgcatggaagcttggtgctactttcgttttcggtactattgggccccagcaagatgggcctggaagccccacttattggagcccactacgatccaatgaaccatcacgagatgcagggagattttctgcacgttgttagcgttagttcgaggacgtgacacggtgatcatttgggagttagtaggacggacaccggtgcctatctaatcggatcactcttaattttcgatgtgatcgttcaggcaaacaggacagctaaagatcggaaacgtatttcttatgtgattcgtactcaaccgtgtaagggggtaaagttttaacgtgttacatcagatatacagacacatattcgaaggattaaacgtagtctaataacaaaacaaattacagaatccgcttgtaaaccgcgagaagaatttgttaagccgaattaatccatcattagcaatgtttactgtagcactacattgtcaaatcatgattcaattagttttaaaagattcgtctcgcaatttacacgcaatctgtataactagttatttttttcgtctatatttaatacttcatacatgtatccaaacattcgatatgacatggtgtaaaattttatcaggggatctaaaaaaggcctaattcaactaactctcattttttttaattagcatattttaaaactactaaacggtatatttcgtgtaaaaaaatttctatataaaaggtacttaaaaattaaataatatattttttttaattagcatattttaaaactactaaacggtatatttcgtgtaaaaaaatttctatataaaaggtacttaaaaattaaataatatatttgtcaaaattttaataattaatagtcatttaattatatactaaccacttttttcgtttgtgagccgctaatcagcccaaattcatgtaccacaaagaacacattataattatttttttcattggtaggcaaggtatcaatcaagagtaaatcaattgtggtggctttatcaatttcaatatatcggttcggacatactcataaagataaggatgagcgcacgtgttgtgaacgtttgtatttgtgccaatggtatttttttaaaaaaggagaagaacacgccctttgctgctttgcataacttcgtgcagttttgagctaccaagaaaaggcccatgggctaaacctaccttgttagccgaagaggaacggaacccagaggtgacggcccacgaaacagaggagccagctgggacgacgccgatgatagtacaggtacagcacgatgtccgcagccgcaaggctggcggtacacagcacagctcagcgccaccgaggcaggggtcgtgtcgcgccgtccgactagcgctggcactgccagtctgccaccgcagcaggtacggcgcctcgtccggccatctggccaagttccccaccaccacccgtcttcacctgcacgctgcacgtacggccgcggcgtctctctctctcgcgcgcgcgccgtctcgtgtaaact

SEQ ID NO: 21246 - DNA, 9133 bp, Oryza sativa
gtctcgcggaaacgtgtccaaccaaacgcacccaggggagggggaggggcacgcaatgatcgaaagcgcaaagcggcagcgaatcccgcgtgggatgagcacctggagccgcaactttttcgccttatttcttccggccaatggagtagtactgtactactactattgtgcggcaggtgaagcatccatatgctaatctgtacttcgatgcatccgtgcgtgtgcgatcgatcgatggttcggttcatgtcgttatcatgataaccggattattcccctcttttctgctttaataatgattaacttgaattggtgctaaatgctaatcccgtgctcttccggtgtgtacgtatatgtatgtacgtagctagtaatgatttgggcatatgctttaataaggttttcgtgggaaaagaagaaaaaatggtatcgcaaatttcccaacttgtcttttgcacgggaatagtaatcgcgatggcgatggagaattggggatgctggtgtataaacattgcacatttttatactgataatgaccctatgagagtgacagcagctagccattatactattatctactagcactatccaacgatttcgttggcagttaacgcgatgtaatcttctgccacatcaggttattttatcctggtaagctgtcagtgcacgtgaggaggattatcttaactatgagttcgagaaaaatcttttgatggctctaaggcaggagaggagagctagacaatgcactggcgccgcagacgatgaattgataaacgaattacagtggcaccagcacagtagcacgtcataagtcatgtacttttagcagtaacaaaagctacatgtccccgttaagcagcagtaaattgtttggaactggctgagtgattagtaaacgacacggtgtcgtcgttgcccgggtgcgtgccagatcagccacaaaaaaaatggacagggtaagttgccaacttggccactttattgtcctctcttgctgttgtactggaaatgaaaaaataattatcaaatattaattaagggcaaattaaggatcaacagatatttggctcggctactcgtctgcctctgggcaaaaagcaggagcttttctttctcctttcattgttcgaaatgggaacggaagctaacagcatgcaactggataattccatcaaactgacgagtgatgactgatgactaacgactgagctgatcaggtcaagtgatgtcttgcgaggcagcgagggatctgaagaattctgatattctgttgactctgcattgagcactacattcaataattgctaaagtattctttgtataaacacaatgctagcctggatttctgaagaatgaagtctggataaaaaggaaaaaaatacgaccgagttgctccaatgagttaacactacttgaacccttggccaaaactgatttacatgtgattgaaccctcggccaaaacgagagctaatttattggagcatgcatttgcttggactaattcttactgtctgaaactctgactgtttcaccatattcattttctgtcagcactatatccagtagacactgtgcttgagtaattgagttcaagttcaactactttaataggaggtggagacagcgaatgactagtagtaagaaatacctaaacattggatttacccgttccaatttaggaggatactccaattttgagctgccacttgctacggcaaaagtcttctaccatgaattaatctacgggattgcttttccccgaaaaaggtctacgggatggcactgtttctgctgcttttcggctgccaagtgccaacacgtcgtaatcagttactgtagtgttacactaacaacagtttcataggactaaaacatcatcttcatccgtggaaatagtttcacgagaaaacgaatgtatgtttggatatggattatgagaggcaagactgaaaaatataaattaataggagattaagacgaaacggtacgtaggaagaatggatggtcaattggttgacatctacgattagaacttaattagattctaaaaggtgaaactttaaggttatttacttcgttgctacttttaaccatatcgaattaccttttcttgtcattattatcttatcaaagtttgacaattataaaatttccaattttataagctctatcataatcttggtaaatctttaaaccaaatacatccaacaccatcaaaattgaaaagtcatgtagcctagtggttgcagtaacctgagtagctacataggagtgaattttagattgggttatttgagcgctaatttctaacttaaaaaaggttgtatatatccggttggatttagaggccggataaaaatatcattctctaaaaaaaattaaagaaaatcaaaatttggcaacatcaaaacatactaaaatctgacattatcaagctttaatagggttaaaggtggcaacgaagtaaatgcacactaatttttccatcccatttagtcaaacatgttttgtgttcaaattactcgtaacaaatacttctcgtttttgggtagaaatacccttctctaaaaaaataaaaatcaaaatcaaaatttggcatcatcaaaacatactaaaatctgacattatcaagatttaatagggttaaaggtgacaacaaagtaaatgcacactaaattcttcatcccatttagtcaaacgtgtttcgtgttcaaattgctcgtaacaacttctcatttttcgttagtatactacccgaattgtcacgcgacatgttttatgtaaaaataatttctatacaaagagtgttttaaacgattataatatatatatatatatatatatatatatatatatataattttataatagttaatacttaattaataatatactaatgagtattctcgtttctaatctaccatcccaaactcacagatcaaccagcccttagggccacggtatcatcggcgaaaattaacatcggtgccctggtgggcactgatcaggaaatttagctttcgtgcctccaggtgcccgtgtgtcatgagactcgttgccgcggcgtggcagcgacatggtcgccgaattcacgggagcacggcgattttggcttcggatgcacgtcgacggtagcgacgcgcgtaaaccgcgcagggggtttcgcgtgactgtggctccgtacgtcgccacgacggacggatttattgtcctttcttttccctttcgaactcatcaaaaaaacaacaacaaccaaaaaaaaaaaaacgagagcacgagttaaaccgttgactcatggaccaaaatactagaggaacagagcaagtgtgggccaaagcatgacgtaacatcagaaattactccaaaccgttcgttttcagttttcactagtcgtttccgtatgctctgcttacaggttgatgccctcgaccatttcttatcaaaatttgacagagaaataaagtttgagctatggagcccatgactaataaccgaatcaagaaacgtaaaatagtttaggatgagacttttatatatgtgttattattggtttaaaaataatatagaaaatagacctgacgaaaaaactaaaataaaatccaaagttaggcctccaatttaaaattttgttgtctttagctaatatgtgggacaacctttctctagaaaaaaaaggtgaataacatactaaaaataattagaattggttgaaagaaaggaaacacataggtaaagggttatcatttcacatcatgtcctctccttctccaacactatgttttgaaaggcacatcaaagagaatcttagaacaccatcaaagcatctcaagcaatttatgtgtgtgttttctctgatttcagcttcaactaaactgttcaatatgaatcattgtaaggctcacacaaaacaattatgtcatatggttccatttattttcctatcattaaagcgttttgcgagttggatgaatgtttctatcgttgaattgaatatatggaacattttagaggagtttacctatgtatagttagtgttgtcgtggtgtaatttcaacgtgagagaaacaatgatttcaaagatatttaatacgaccaaacaaaaaatagacatccgagtaatcattgtagtatttcctttttttctgtgtgttgggaacgtactcatgggtgtgtgaatatagtgttatatatgtcggtgtagctacgcgtatgtctactgtataattgcaagaaaaaaattttaggatttcaacgaaaatttagtgagatcagatatgtatcattggttttcatttgtttggtgtgtcagaggcatactcgcgaggagagctgctaaacatacggtattatgtttactattgttttatgataaatgttctctcttagtgtttgttgacggttgcaagtttcggtcccacgctaaactacatagcagatggtccggcgttggatcgtactaagatcgtaataaaacatcgtatgtgcagtattttccacttgtgagtgtgaatgtagtgttatgttgtagtggtgcggactgcggaggaaataaaatttgttccaaaacgatgatgacgacatctccatttttgcttatcccctcgctagatttgccgagatgtgaacaggagacaaacaacatatcaccgtgcccacggcctagcctcaggccgtaccctgcactgcacacgcgcacgcacgcgcacacagcggcgtactccgtaggcgtaccgcggcagcgaaaaccgagacgaaacccaaacccccccattcgagcgagcaggtgtttgtacaaaggccgccgcgtcgaaagcaaccactcctcctactcgacctcgcgctcgctcgctcgccctacaggccaccgccgcaccagggggggcagcgagcgagcccgcgaggtagtcggcgacgaccaggagggggactgggatgggttgctgcgggtcgtcgctgcaggccgggacccacccggagaagccgccggggatggcggcgccgccgcagcgcccgtccttctccctgaaccagcaccaggcgccggggtcggcggcggcgcagggcgtggggagaggggaggtcccggcgttcgcggagttctcgctggcggagctccgtgccgccacgggcgggttcgccgcggagaacatcgtgtccgagagcggcgagaaggccccgaatttcgtgtacaggggccgcctccagcgcacccgccgcgcgatcgccgtcaagaagttccccaagatggcgtggcccgatcccaagcagttcgaggtacgccccgattcgggaagagcttgttgtgcctggagaattcgtctttgctgtcatcagtccgatagattaaggttatttgctttggttcgcaggaggaggccaagggggtggggaagctgcgccaccgccgcttggcgaacctcatcggctactgctgcgatggggacgagcggcttctcgtcgccgagttcatgcccaacgacaccctagccaagcacgtcttccattgtgagttattggaatatctttcttttgataagttcctttctgaatttctgatcaccaggagactttttttttccatatccgataaacactggtcgcaaaaagattggatttttctgccttgtagttcctgattagtgtggaagttggcaaaagaggacatattggtctgctttgagcaactgctggctcctaccggcttcctgcatttggtgtaccgaacgaatgattgggactgccctttgtcatatcttgttcttattcggttattgttggcaatgatcttgagtcagtcgaactgattatggcacaagcttccttaacacactcgatggaatgttggtgttgttatgagtctgtcagcagctatatgtgtacacaaatggatgccttaaactgattcagggtctccaatgtggaaatgtcttgttattacagtgaccaatgcagttggtaacttttttatgcatttaaggttacgggagattgtagttcacttgagaacttaggcttctttatatgttgtcttcatgtttgatgaacaacctgacaatagggtacactggcagtggtgaagggtgagctgtcgactgtattggtaatagttgtcgcaagtactgaattctgtaaaacctcaacaataatgcactgtattacttctttttgtgatcttaattgcattcaccattcatgcaagtttgaatttgcgcaaactagatgtgtgttattaaatttgcagttcatttatcatgattatttttttttacacatttgcaggggaaaaccagactatcgaatgggctatgcgtttaagagttgcacaccacattgctgaagcacttgactactgcagtagcaatgaacggcctttatatcatgacttaaatgcatatagggtcctttttgatgaggtaagcaaccaattcttttgtggtgtttgtatgttttattctgtaggattgtctcatgtggtagaggaagtgaggatagtatatttatctctacaaatacctccctgcaagaagtagtgtgcaatctacggaatggcactgatttaatttagtttgtgctcttatcctggatgcttcctctgtttgttgatttgcatgcttatattggaagtggaaattgttggcatctctagtacctggaagaaagcacatggcagaaatgaaaatgtcaactctttaccaattgtgctgattggagaaatgattaggaatctcatcaaagaataaatcgctttcccatgatgttgttcacatgaacctctccttcacatggttatccagatgttatccgtttatctaaatcgttaatgtatttatatttgcagaatggtgatcctcgtctttcatgctttggcctgatgaaaaacagcagggatggcaaaagttatagcacaaaccttgcatatacacctccagagtatttgagaaatggtacatatgccttttaccctgagactaaaaactattcttttcctctgagatatgaactgctatttattaaagagaaaatccaagaaatgatattgacaagcgcccaattccaagaaatgttatcaacaagtacgagttccatgaaataatatcgtacaagcaactttgtcctagaaatgccatcgccgttagggttccgttagcatccctcctttaggtgctatatgatgaacaatgtatttaacgacacgggatggatagaaccctaacggcaatggcatttctcggacaaaatcgcttgtacgatggtattttatggaacttgcactcgtcaatggcatttattggatttggatgtttgtcaatgacatttcttagattttctctttattaaatggataaatacacattgctctttttttttctgtatgcatgtaattcttgctttatgcctaaattttttatttgaattgcctactctgggcattcataggaatattatagatgttaaccatcgtccattgatgacagaactgtaccttccactctaatggcatgacacatcatatgcacaaactggacctataatcaaaataaggcataataatcatgttctttttccctgccagataaataaataattcatcttgtttgcctactgagtgcttttgtaagcattgatatgtgctttttaaggtgattacgaagaaatgtcaagctcatagttagccagctaaaacatatgggtgactaacacaaaggcagccttaggataacaaatataagaggaaaccattctaaatgtaaggtttttttttttttacatttcttcatggtatattctcctttttcaggtagagttactccagaaagtgtcatattcagctttggtactgttctcctcgaccttctaagtggaaagcgcatacctccttcccatgtaagtttattttgctagtaaagtatgccttttcttgttcctctttatcctagctccaatgcagcataagaagtccgaaatccgtactgaaaataccttggccaggtggcatacaatgctattctgcttctgcatatatatttcttttgcatcgtgctgatgcaacactcctgtgcaactacagtagaacagagttttacttatatagacatgaacattaagaggttgactgctgcttgaattcatagtatggctaacactcttagctgctccaaatattattttacttctaaatgtaacttggtagcataatcacatcgtaagtggtaacaatgcttaaaacaattaaaacatgtgctttcttattgacaattagctttgtttcactcaggctctcgatatgataagaggcaaaaacattcaagtgctcttggactcacatttggaaggaaaatactctacagaagaggcaactgctttggtagatcttgcttctcagtgtttacagtatgaacctagggaccgtcccaatacaggaaagctggtctccatacttgatcctttgcaaacaaaactagaggtaaccattgtgtttttatccttacttttctaaatcttttttctgtctttgatggtttaagccttctttactaatttatggctgccatattttgactgacctaattttattttaaaatacaaacaggtgccttcctatgagatgcttggcattccaaagcatgaagaagaagcacctcctgctcctgctcctgctccagctccacaaccacaacaccctctatcccccatgggtgaagcctgttctaggatggacatgacagcaatccatcagattctagttgccacacattacagagatgatgaagggactaatgaggtaaatattggagcactttgatttctgtcatatggcagatcgttgtctaagaaatctatctcttcatcaatctccctgttgcagctatcgttccaggaatggactcagcagatgagggatatgttagatgctaggaaacgtggagactttgcgtttcgtgataaagattttaagacagccatagagtgttacacacaggttggaacgtcaaatatcaggaaccttctggtgttacaaaaaaatcgttagattgaagttatctcactcctttacctcctctttgggttgcagtttgttgatgtgggaacaatggtatcaccaacggtatacgctagacggagcttat

SEQ ID NO: 21247 - DNA, 2520 bp, Oryza sativa
gggtataagtgtcatttatgaagagagttgttggttcaaggataagtttgaactaaaatgaaaacttgaaggattaatatggatagattgaaacatcaaggactaaactgagtctcagatgaaacttggaggaccactttagctattcacccattaaaaaaacaaaagtaggagaacacagggagaacagtagaggggtaaaaaattaagggcagagaaacaaacagagcaacagaaggaaaaggtagaaagatagaaaagaagaaaaaaaaagacaaaggggctgggaaacagccctaaaattaactcagcttgttcatccattgatggataagatcgcgactgttgtttgcgacacggtgcttccaaagactgaggtcttctttgatgtggtgtataagctgtgaaagccgtataaactttcattccggaatgttagttgcacgattccgagccttccaaagggtgtgcacgcacgcggcaaagcaaattggccagccaggttgcagctggttcggggctgtatcgtcatgacagtctcgacgacctcaagtcttcagtcttctcactgctttggtcttcggcattggcagtgtcccggtctagttcctgaaaaaagttataagttaggggaaagttgtaagttcagaaaaaaaaagttaaaagtttatatgtgtaggaaagtttttgatgtgatatgatataatggaaagttaaaaatttagggtagttaagggttaactaaacacggcccaagctgccgcgtgcatacgccatgctatgctccaaatgctcgcggtcgctgttgcactgaatgtgccgtccttgacgggctcatctagctcgtacggttgcatgtacatcgtttgagttcaatcggacggagtgatcgagccgaccatctcgcgcgatactgtcgtatataaagccgtgccgtgcgctctgcagtctgcagtctgcacacacgatcgagaaacacaattgacagtacggaatttgtaagttgttgatttgcgccatgagaaggcttttcgccgttcgcgggcgccacgctgctgatcgcggcggccggcggcgccagcggccagcaggcgggtgttgggtcgatcatcacgcgggcgatgttcgagtcgatgctgagccaccgtggggaccaaggttgccagggcgcctggtacacctacgacgcgttcatcaaggccgccggagatttccctagattcggcacgaccggcaacgacgaaacgcgccggcgcgagctcgccgctttctttggccagacctcccacgaaactacaggtagtactcactactcacaagctagtcacaaccttcacagttcagatcacttaatttcttctgtttttatttgcaaattaaacggattactccatacaaaaggtggatgggcaactgctcctgatggaccctttgcttggggatactgccgggtgaacgagatcacgccgtcggacccgccctactacggccgaggacccatacagcttactcagtacgttcataaaaaaaaaccgcacacaaacagtcctaagttattgcaacacatatcgtctcatgcaatgaaatctatcactactaatctacaaataatcaatggatccaccaaaataaatctgatatgatgcatgctctcgtatgcattatgcagtaagtacaactaccagctagccggggacgcgttgggtctggacctggtgaacaaccccgacctggtgtcaagcgaccccgtggtggcgttcaggacggccatctggttctggatgacggcgcagtcacccaagccgtcgtgcacgacgtaatcaccaaccagtggacgccgtccggcgatgaccgtagctccgggaggctccccggctacggcatggccaccaacatcatcaacggcggtgaagagtgcggcaagggctactccaccgacaacgccaaggaccgggtcggctactacaagaggtactgcgacatgttccgcgtaggatacggagataacatagcctgcagggaccagaagccctacggaggaggttaagcactggagacgatcgactgggagtacgtcgtcataagcggattctcctagtgctagtacagctgctggttgcttgctaatggctagcttagccttcgcgtacatacgtatatgtacgtgatactagtacgaataaagctagcagagagcgttcgcggatatcatgtaacagatatgagtatatgacacatggtcgcttatctcacatgttattgtgaaataatattattactggtggaacgatgcccctagttaaactgatcgtgtgaccggtatctgtgttaattttcttcaattgctttcgcatctcagctcccacggcgataagcgatcatgagctagcgctgtctctgccgcgcgctgcactcgccgtacgtacaagcccaacgccaaagttgccgcttggcgccgcgcacctaactggatctatctcccccaaccaccgaaacaggaggcgagagtcgcgaagactg

SEQ ID NO: 21248 - DNA, 37478 bp, Oryza sativa
gttataatcggtgcacaaaaaattggcggcgcaaacatgaatataaaggtcttgaatcatagtcttataagagattctagcattgtcaagtcagaaagcatcatattatcttgagagaagaccaaaagattgattgatatctcggtgctactactatatgtacaatcgaatccacagctagccattctacgctacttgttcttcgtcgacgggtgatttgatctcttgctcttgcacatgcatctggagatcgtgatcgactcctcttgcttcgatgcacaatgtaattctctgccccttgcttagtagtagagcagatgggcgtagggagacaggcagtgctggtcctgccacgggctgcgcagctgcgtcaggaacgggtcctgcagccagtccatcgccggaagctgcaggctcggcagctggctcaccgccgggagctgtaggctcgtcgccgacgccaccgtgaccgtgacgtctgcttcttccttcttggcttcccttggtgcgccagcgccgccgttcttgctgctgctgccggacggcgccgccgacgaggatgaggactggatcaggaagccgctgtcgtggacgtcgtccgacgagaagtagtcgtcgccggtggaggcggaggcgtcgtggacgagggatgctctcgtcgccgtgtagtctccgtgacttgatcctctctgcatctcttccattgccgaggctctctgctccagctccttcagtggcgtcgccttccggtatatcttgcagagcaccatgtcctcctgccgccaaacacagtgtgagaaaaatccaagttaaaattgtactactagtggagtatttgttctctggagtaaatttacatgtacaatggtaaaaatcaaggcagtcaactcccaagtcaaccgtgtcaattcttaattcttaatgcttggtgcgctttcgtggaatatctacatcattgatactgcaagtctactgggacaacgactacattgcaccccattttcacaccaaaaacaaccaaattaatgagagcattcactgccaatgtactaatactctaatactagtactacatatgacatgatcattgttcgttcaaaaaagaaataaatgacatgatcattctcacttcattccgatcattttttttgtgaccattttaagaattcagtagtactaatattttgcgatcacttaaaggattcgttctaataattaactctgcaactgattgttcttgttaattgctaagagagcattagtttaaccttgggaggcggcgcggcggcgcgggcggcgccgtagtcggggaggcggtactcgttcatgacccagtccgtcttggtgccgcgcggggcgcgaccctggtagaagacgagcgtcttcttgagcccgatcacccgcttcgggtcgccggagctccggatcgccctgtccgaccccgtcgccttccagaacccgcgctccgtcgtccggttcggccgcccgccgttcccggccttcctgtcccgcggcacgaagaagtaccactccctctccccgatcttcgccatgcctgcacatttttacaagaaacacacacatcatcatcatcagatcatccagctcaaacactgtctccgttcttgctgaactctcactgtgtgttggtgtttacctgggaggtcccagggatcatggcggtagatgttgagggtgccgatgatgttgaagtggagcttcttgcctaggacgacgcgggagaggtagaagtcgaggagctcctcctccgtggggtggaaacggaagcccgggaggtcctgctccacctccatggacggcccagccacagccactgccgccgccattgatgacagtgtgctctgctcgctcgctcgctcgctctgctccaggtggtggtggtggttgcctctgcacttggcttgccgatcttgatttttactggagacgatggacgaggtgaggtggagatggttgtggatgtggaggcaacgagcttatatagaaaagaaaggcattgcattgcttgaatactttaacgcggtttcatggagaaaaccggtcgcaatttcttagcactggtgacaacgaccagtgcagtctccagtgcttggcttcagtagtagtaaaaaataatctgggcggcttaacagtaaaatttatttaactgtatttaatttggagggttttgcttatttgtgagtgtgcattaggagacttgtcaggtcacacaaattgactcatttttcactcacctgaaacatatggcattatggcctattcattcccttttgctgtgccgaatatttatgagtaactctccaatttggctgctggggtgagagttattccacagttttaaatttgaaaacgatatctgttttacataattttttttacaaataatctgttttactcaataattgaagtgcaatcatttctgcaggcattctctcggtttatttattggtcttcatgttttactacttgattaagatcgtttagaattttcgtgattcgcataagaaattaagtgttccttacgaagttcatgtcgtccgagaatgtaactttctcaacaggtggaggtaattagccatgatatcgtctaaatgagtaatttaatttgtgattttttttgcataacttgtcattaattactactacctccatattaaaatataagagattttgtccacgtagataaatagtctacatgtaatcaatggtgtgtgaacgttgcataattgtattgtgtttgtatcagtggggattttttttagaaaactcataaaggatctaccatgcaaaatttcaacaagctggatatctacatacttaattagactttctgctgtaattccacaataaacttcagccttgtcatcggatcatataattaaatgataccatgttaactaaaccaatatgtaacactgcatggtcttattaattaggcgattatatattgttgagcctctcgaaactgtgaccggactagatcatatacgatgtccacatcaatggaatattggacttggtataagcttgtcggatagagattgcgaccaattccaaaattaaagatgtcattgtcatgtactacattcttttctgtttctcttcgagataccgcgctaacctatagttataaagttgaatgatagtaatatgaaaccctaatttattccttcttaagaaaaggaagaagagagagtaacgtctggttaatcttgctgtattattccgggaaaggcggccacatctcattttacttgcacacttttgtttgctgaagggttggcgcagcatgatcttcgtctgactaatctgttaagaaaaacagcttattgttaaagattttaaacatgtttttggacttaaagttgccgaggatcttcgatacacttacaaaggatcatggagcattgcagatcaatatagaagtaggacaagtgtaattaccatcagattaccattttcatgcgtgcatagtagtacttgtggtctaattaattgcctcttttttaaggtagcatcacggcagtcctaccttttaaacatgtggtatgtgacatctagaatacttttcttttcaatgggcagaaaaacgactggagagattatctgttgatcaggcatccccaatgtgaatttgaactaagcaatttaatgatgaacaggcagaacagaaactgttggtcagttccacgttttaccgatgacttgatggtctcccaacatctatctggaaagcaaaacaggtaatgaggtttccattttatccctgcttttaccttccctttcactttcttacgggagactggagttaagtcagaacgaaaaattacttcaatttcaggtaagagactagaattactgtaccatgaaaggtgcgataacagaaagaagagtcacaagccacagtgtcgtggcttcgacaccatgtcacccttgcgtttggtccatttgagaggattgcaacaatcagatcttcaatcagcaaaggattggaaatcccggaccaatgatcgttagcaggttctcataggttgttcatattctctaataaaccaaaacggcttcttagagataaaaattaatttataggtaaaatttttatatgtatgttagcgtcttcagagttaatgctgaaaaagaaactacgttgaaaatgtcttaacatcaactttaaaattaagtttgaaaattaaaagtttggctttggctatgacttattagggcaccaatggggctcttagccggtgattaggggcctgtttagtttccaaacaaaatttttcatgctgtcacgtcgaatgtttggacacatgcatagagtattaaacgtagacgaaaaaaaaccaattacacagttcgccaggaaattgcgaaacgaatcttttaagccttattgtgccatgatttgacaatgtggtgctatagtaaacatttgctaatgacggattaattaggcttaataaatttgtcccgcaattttctggcggaatctataatttattttgttattagactatgtttaatacttcaaatgtgtgtctgtatatccgatgtgacaggtaagggcaaaaatttttttccaactaacgccgcgtttagttctgaagtttttcttcaaacttccaactttttcatcacatcaaaacttccgtcttttacgtcacatcgtttcaatttaaaccaaacttttaattttgatatgaactaaacaaaggctaaacaagccctaggttttggaggtcagccatcaagctcgtttgagaactccagtgaggcagcgactagtagacatgaaatttttcagccttttcgaccttagctagctaactataggtgtgtggctgcctgtcgcgttttggtcatcttgaccgactttgaacaaagactgcatgcatattcatcatgaaaaggactagtgtgacgaacctaacgaattcctagtggaccaaccaaaggccccatcgtttgtcttttttcttgacaagccaaaacagcttattagagaataaaaataaatttataggtaaaaattttatatatgtgttcttggtgacttaaaagccaatgctgtaaaagaaactacgttgaaaatatctcaaaattaatctcaaaattaagtttgaaaatttaaattttgacttttttttagctgtttaggtcatccgtgggagcaaaagagcttatatagtttctcactgtttgacagcgacattacacgcattgggtgggtcgtgacaaaaatatttgaacaaaactcggttcctactagttatgtgtacaaacaccgatcacaactgacaggacagaaaggatgaaataatttcctcatgaaacggtcagagttcctgaatttcagcaagaattcagacgggataaggcgatcggagttttcctagctacttcctaaagttataacaggcaaagcgcatgaaggtttatggtgtataaacaacatgtaagttaggcaaatgcctgggaagtcatgcatatgagaatatgattctagtagctcttgtgcttaacttggtaaggaaaaatgtgtctaatgcatgcctgtgtgaatgtcctgaacagatataaacagaagactgcatgctgattggttccatatatagctctcacaaaaaaaaatataatcactaatgtaaagagaatatgaaagcatgcgtagtattagacgtagtttctagagtataatcaacgggagacggattttttttcctgaggacatattcccttttttaatgtcatttaaaaattcttcaaaaaaattaaaatcttttgatacgataaatcaatatgtgatgttcattccacaaacatgcaaattcaaatttgatttatataattagaaacgaaaataataattttgactatgaattgtacgttctattaatagttaaatttatttaatttttctacttgtattaagttaaatttaatcctacatgtttgtttagtgacatattacatattgatctatcttactattttttaaatttttagtgatattttaagcgacatgaaaaaggagagaacatcctttcaagagataaatagactttccttagcttgttagtacagttcagtagtgccaaccacaggaccacttatacatatgcatatctaaactgtttattactaactaaataaaatcatttatagtaaaacttttatatatgtgttcgtagtgattgaaaagtaatcgataaaaaatccacaaaatcaactttaaaattagggtaaaatatgtaaaatttgattcacgttgataataattacctgaaggtataaaaattaatatagaatttagatatcttaagatactttctcaatgatttaaaatttctcttagaactaaattttaaatttaaagtttggtttataagcataaaataagcgaaacgataggctgcctgtcataacgaagtacgttgatgcattttctgtggtttggctaagaaaaataacgtgcttagttaggcatcacgcggccttttcttttcctgttgaaactagtagtgaatttgaaggttgcattacactgacagacagtcaagtaccgtaccactctttctcgttctttccttgaccggttcaaatgtactgtgccggtacaaacaaacaaacgaacaaagtatgaattccaagcctctaggttctaactactcatccatcacataaaaaaacaataacttgaattccaaatccatgaccatgaagatatcctttcatgcattcacacatttcaggacctcctttggaataggggaattgttagaggattatacaattccaactaattaacggcatggtacgctgtcaattgttcggtactactccatgtccatgtccatgtccatgtccagcagaaattaagtcatgtcagtttcagtgctctttgttagactactgtattttgtaagcactcaacactaaccacaagagtagcagagaccttggtggtggactactccgcgtgaaagtcagtaggccggccgttagtgtacaagagatttgcttgattttcctctgcatgtccggttgtccaccctctgaaatggggaacagagacagtagccatagacgtctcgtcaacgcagaggcgaggcgaccattcaagtcgagtcgtccaccgaggagaccacacacctcatctccctgatcaattggctgagcagttcgctatagccagtgcttgttccattttaaaatataagagattttaaacgtggatataacatattataatatttttatttaaattcgtaatattaaaatatatcttatttatttaaaattatttatattttggacggagggagagctaggtttgcggaaattttcaatagcctcatgggcagacaagttaaagcaagttatctaagagaaaaggttaaagtagttacagtcacattataaagttctgttaaacaacttgcagcagattcggcccatctgcaaagtgccattgttaagcagcatatactaatactcctactatgtgatttgctatttgacgcgtgggcctactagccgtacgaaataaagtcgtattggacgcgtagctatgttgcttctacgtctgcttcgtcatggttcgtttcgttcgtacgcagggaatcaagcatatgataaccactggaatagtaacggtaatagcaatggctagagggagctccagtggcctgtgcgaagcatacggaatccgaatagcagcaacctccttcagagatagacgtactgtacgtacttgccatcaactaagcagtttcagtgaaacttccaccatgctttaatgctttgcctgatcccagattcccagacttcagtgcaacacccgggaaaattcggactcgccgcactcgctgcaactcctagcatgtgtttagattggcccaaagtttagaatttggttgaaattaaagacgatgtgactgaaaagttatgtgtgtatgaaaggtttgatgtgatggaaagttgaaagtttaaaaaaaaaaactttggaacacacagtagctcgcaaggcgccattccgccgaattgcttaggcaacaggctacttgcatgggagttcgtttttgcgtgtgcgattcggtgcggttgcggcaccgggcttgatggattgggtagtggccgaggccgatggctctccggcaatttgttcggcccagccgcgcgtggcgagaccgtgggcgtgggagttcacgcacgcagggagcgggtgtgggttgccgggctaaaaagccgccggcaacagccacgtcccgccgcgcgtcgcacgtccgcgccacgaggcaccgacctatccccgcctcgcgcgccaagcgctccacgcgccgcccagcgccgcaaggcccgcaaatacgtggatcccccacggcgcaacgccgcaaataatttacccgcacgcaagcctgcacgcgaacgttcgcgacacttcgtaccaatccattgtccgtcgaacgccagaactatttaaccaagaccaggcgcgcgaagagcgaacgacgctatagcttcagctacgtagccgttgttcatcactcactcaactcagctcagtagtcagtgcgtactagggaccgatcgatggagaagctggtgccgaacacgaagaaggcaatggaggacaaggaggagaagcccaaggtgccttcgagcgacccggacctcgtcgacctcgtcgccggcgagcagccgcagctgcagcgggagcaccagccgcccaacatctccgagatgaagccgctgacgcgggaggcgtacggcggcgggatgtacgccaacgaggggcggagggacccgacgcggccgcgcgccagcgccacgcagagcgccgacggcccggaggaggccgccgtcaggcccaagcacgcgccgccgccgtccaccggcgaccgcgacctcgacatcaccggccagtcctacatccagtagtttgttgtgtgtgtccgtgccgtgacggtgtatgcgtgtagtcaggcagtttggtccggaacaaagatgtgcataggtcgttccacgctgtaacgaataaatgtaagtttacttgctgtaatttggcccaataaggctaccggcctaccaaccggagatcgttagtcttggcctactaactcttatggaccttgccaatgggctaatctgaccaagtgcccatggatcataataaagtcacgaggaacctctcttatcagcccgcaaaattttaccgttttcatcccttaatatcctttaatataattaatatcccttaatataaaggattttgatattttgcttgcactatttaaccattcattgtattttaaaaaattatataaatatataaaaaaaagttgtgcttaaaagtactttgataataaaaagtactttgataataaagtaagtcacaaataaaataataataattttaaattttttaataagataaatggttaaacaatataaataaaatatcaaaatctcttatattaagatacagatatggtaatttttaaatgattttgaagttttgttttcattatgctttatattttcaccactacctagctaaaataaatcttactaaaataaacgtttggatgacacaaaacattttaactggatagatgctgccacttttccacgacaacaacgtaagctgccatggccacggcagaggcccgcggaaccacagccaagcgtagatagcctccaaaattctcgacggtaacacgcgtgtcaccgtgtcagtgtctccacggtcaatgcttatccagtatatctatccaaagccggggaggtaggagacatgttccacggcgccgcgccatctgcaccggccgcgctgagccacgagttacctcagcacctggccgcgcttgtggcgggagccggccgtttcactctcgcgtgcgcgtgacgtggacgatccgtggccgctagacacgcgagtcgcttttccacgtagccttttgtcgcgacggtctctggcctggtcctgatcgggttcagtagagccgcctggttggtcgccacttgggacaggagcgctttttgtccacatgctgtgactttgcgtggagccacgtaagatagaccaggccatgtgatccgtgatcagtgctatactatgctttagcgtacgtgatttatggaatttaattttatgatataatatatatgattttaaaaacattattttagtataccatcttattgtcagaagttgaaggtttaacccatcacacattttcttaagttcttttctttttatttttgagactttttggttgtatgctcacaggcagagatcagagatacaatccatttctattatttaaaaatttttactttattttcatttataattctaatgaattttagcattgtaaaatttagttgaaaaatagactaaacaaattcttatcattgttttcttatgaagttttagaaaatcccaaagcttccactgttaaaactctacataagactttaaactgaagtctgacactatcaaaatttaatcccaccaaaatatagcaaatggtaccgccatttgtaatactaaatattggtaaggttaaaaattacaacaaagtaaaaagcccaacgtgcgtatatagggaccagtgtcgcgtgataataataattttatctttgctagtgtgcgtgagacacaagcagcacaagacatgggacggggtcttctagtaggagtgccaaaacaatttgagctcacgtcttgggattccactaccgattttaaactgcattttcagataaagtgtgtgaattatcacaaacaaaataaaatgctttttttcattagtttccagaagagtaggggagagaggctggccaacttgttgggccgggccgaccgtgcggctccctgcgtaccgatcaccacaaacttagcacacggtggcatccttgcggtgggcccacatcggggggtcccctcctgattactgccaatcttgactcccaccgacaagcgggacccaccagcatccttcgtcttcttcccaagccccatgttcttctccttcctcctcatcgccactcctctcccccacctgcaaagatctcccacccctaaacaaatccaaataaaagccccgaaaaaaaaggcttgctcatttatgtctcctcatttccgcgagctgattcgcaatcaatcgctctctcgctggttcggatgatgcccgcggtttccctcttcgccaccgcccctttaaaaccctccccctcgcctccgggctcccaccaccgccgccactgagccagtccgccgccgccgccgccgctcctgaagccctcgccgtggcatgagaagatggccgcgtgctccagggggctcgtggcgcggccgttcgatctgaccgcgaggggggcggcgcactggccgtgccccgccccgcgacgccgcgcgatccgatgctgctgccgcgcgcagcaggagccgcggaggcgcctctccaaggccgcggcggccgcgccggagcgcaccgaggagtggcgcatcgacgggaacaagcccgccgctgccgcccggggcaggcgtcgcgccagcctcaccgcaatgccgtcactccccttcccttctcctcggtacgtgcacggcggctcgtcactgaacatggcccatttttctgccttatccagtcaggcctcgcatttgccacttacagtaacatgttgtctaatcattccaacatatggattgttttttgctttatgctgaattgtcgtagtgacaagttaatgtgccaatgcttttgacacacgctttatgtagtggaataaaccgtacctttctgctgttgcacgaatgctctttgttcagagaatgaattttgatggtagactttgttttcactagtatagttctaggaggcagtggaaacaacagaatttctatccacggtgcacgccaagagggccagctcctcaatcccgtgatactccgccgaagagaggtgggttccttgctgatacttccaaattttgtgatagacatagtgtactccaaaaggaaacacccgacccgcagttccaagtgtatttttcagctttgctaaggaaatgcatttgttttctttgccacctgccttatagacactggtattgctagtgagaaggaatggggaatcaaccttctggatgaagcagtcaaggagtctgggacaaatgaagatggaagcacctggtacagggagagtggagacgatcgtggtgataatgggtacaggtgtcgctgggctaggatgggaggacagagtcatgatggtaccactgaatggaaagagacggtatgttcttgttgttttacccttaactgataatattctagtacaaatttatcaagttgtatacctttgtatgatgcacctgagttaagagttaccatctcagttttgtgcaaacaccacattttcgtatgagaaggatctagaaaagatttctgggatgtagccattatattccaatgacttctttatgtaacttctgatgctaatgagctgttgttgatgcttgtggcactagttagaatcgaagatatgtctgccatcctgcaagttgcttcgtgcttgttccaatagctatagcgcactctgcaatagatccaacttgcactttcttacttgactgagaatagggatttggaattataatctcccaggatttcataggccgtagctaactcttttggcacattaatcaatgctggacagaattcttgagttgttaaaaagattttttctaacagatctcaataatttattatgtggcagtggtgggagaaaagtgattggaccggatataaggagttaggtatgaacatatctttataatgaaggctctggtagcaaatggtctttgtaatttgttgttaaatttcctaagaattcagttaattttcttatttatgtgtgcccttttccttttgcatatctgatcagccgtcgttgacttttcattacaaatctctcacattaggtgcggagaagtctggaaagaatggtgaaggtgattcttggtgggagaaatggaaagaagttctttaccaagatgaatggaggtaaattattagcatgcaaattcatttttttaatgatactagctccttgcttaaataatacaaaaatacataatctccactgaattttaactaattttgtcaccaaaaataagtttactgttctttgtttctgcctgctgaagaaaacaattgtttggggaggggggggggggaggacaattgttgaccccttggttatacttctgtgaacaaagaactttgattgtgttagcgcttggcgcttgcaatttcttgttgtctgtttggaacaattttgtttgaccatatatccatgctctatttacttatatttgaaatttagcacattattgactgttattaccagacatggctatacacttcaacttggacttttggacacatcatatgtgcaccaattatcgattagcatgcattattttcttattcctcttatggccttctagtacctttgtttgaaggaaacttgttctgtgggctcaactgctttaggattgttcaatttagtttgaacaataactgtctagaaccaaaacagcataagctctcctgtggattgggatatttgacacgaatatccagtgaaaatcacagtgctgattcataaattatcctgttcagagagtagttctaatttctaaacatactgggcacataatatatttctggcttagtgttatgatcataatgatctgtacttttgagtaaaggtcctgaattctctttaagatagggaaattaaagcaaactaggtgataccccgcgctttgctgcgggattcacgaatgagtatatgttaaatattgtcgaaatgatgaaagttgaaatgttaaaaaaataatatgaggaagatgatttgatacatacttgttgatctctataatataatattatagatgatatgtcatgcttgcatgggatttaaaataggctagaatagtaattgctagtgagtgaaaatgtggcatgcttgcatgggattttaaatgggttagaatagtaatggctagtggatgatgatgtggcatgcttgcatgtttagctttagctttagtgggtaccaactatatagaaagtatagattagttaataaatgaccatctagcacaacattgtaaactgtagatcataacatgatttacattgtgcaaacagcaatcttgcaagaatagagaggagcgctgaaaagcaagcgaaatcaggagcagaaaatgctgggtggtatgaaaaatggtgagagttatctcaggctttcgtttaggtttggttgcaattgttctgcaaaatatttgcttgaactgttgaagtgttcatgtttctttcctaggtgggagaaatatgatgccaaaggctggacagaaaaaggtgctcataagtacggaagattaaatgaacaatcctggtgggagaggtggggtgaacattatgatggccggggttttgtattgaaatggtgagcctatatatatagtgctattttgcagactattgttatactgtactttagtttatcttcaagcactataccatacactttacattgtattacatgtttcttatgctgcgcgcattgtggcctaaatttgtagtctaggttgtgcatttacattgtgcatcatatttgaggcacaagttctttatacttttaatttatttgcctgttcaatcatgattggaacatccgatgtatgttaattggtaaccactgcaattcatttgtattacaggacagataagtgggcagagacagacttaggcaccaaatggggggacaaatgggaagagaaattctttgctggaattggttctcgacaaggggagacatggcatgtatcccctggtggagatcgtaagtttcatcgtcatttatatatatgcacagtatccaccttgatgatgggctttgttctctttggatgctggtattaggcataaatgctaagcacctttggacctttgatgcatagaaaaagtttgcctgctgcattggccgaaattcacactggtgcaatctattggaagctatgctggatattttaacatgttgcttttatatatgagctgtatctactgtctgcatactcaggtttagaagttagatcctgtttattgcattgttaaatgtgtgcaccgctcgtagtgtgacttatgacttatctgatttccaattgccatccacttatctgatttgatactttcaggatggtcaagaacttggggagaagagcattttggtaatgggtatgttccatcatgacgctggtctcgcatttggtttgactgacacttgacattaataaatgaattgaaaccacatgggcttgtccttttctaatacactatatgtcattctgcaatggttcttcttgcaacgatactacctggcattacagtagtagctttcttagatactgttgttctcttgtatttcagaaaagttcataaatacggcaagagcacaactggcgagagctgggatttggtagttgatgaggagacgtactacgagtaagattatgtcttgtttggttcttccagacatcttcggagtattttcagatttacaatttggcgttgatctgtgcattgtcaattagggcggagcctcattacggatgggctgatgtcgttggagactcaacacaacttctgtcgatacaacctgtcgaaaggccaccaggagtgtacccaactattgacttcagcgcttcatctccagctccaccttcggatgatccaccaggcatgcctccttcgcctctggaatgagtcatacctgtgccagtacaaaagagaagcttttctgcataggtttccaattttgcctgtaaggggaacattctttgtagaaaggggatcaaccgcagtattgcgttcattggttcattcattctttcgtagcatgttttccttccgcggcttagcgttttatcgttccggactgctgtttgatcaattaggcgaaataatcagtggctcgcgatcatattgtctctatgcttatccatgtgcatttttgcataaaagctccgtataaataacggaggagaaagctctcaatgatatccacgcgttttttagcattgccttgcgatgtggacacctctgtttggctgttggtttgtgtggcgaagagacgtcaacttcgccctgctgtttccattttcctcgcatccagctccggcctgtctgtcctgcttgtatccaagtgtgctgccgtggacgaggctactcgttcacatttgtgactttgaagtccagattggcctcttgtgcaatttaattagcctgacttgggttgccaaagtcttagcgtagtcaagctccccttgaagacgctaagctgcatgcatggctaacgtttgtagtcaaatttccatcggtaattttgaaatttcagtgattttttgttctccaagtctgactcaaaccaatcaattccacacaagttcaccattttctactttgatgcaatcgaaccaaaggatagggaaaggcccacgctgcaaccatttaagtcgccacaagcactagcatcgaggcatactcctcctgctccagtgtcaacacgacagtcaaacaaacaccaagcctctcattcccacctctcgaggagagctttccccaccatggcgtcgctcaccgccgccctggccacgccggcggccgctgccctcctcctcctcgtcctcctcgccgcccccgcctccgccgccaacttcacctgcgcggtggcttcaggcaccacctgcaagtccgccatcctctacacctcccccaacgccaccacctacggcaacctcgtcgcccgcttcaacaccaccaccctccccgacctcctcggcgccaacggcctccccgacggcacgctttcctccgcccccgtcgccgccaattccaccgtcaaaatccccttccgctgccgctgcaacggcgacgtcggccagtcggaccgcctccccatctacgtcgtgcagccgcaggacgggctcgacgccatcgcgcgcaacgtgttcaacgccttcgtcacctaccaggagatcgccgccgcgaacaacatccccgaccccaacaagataaatgtcagccagacgctgtggattccgctgccctgcagctgcgacaaggaggaaggctctaacgtgatgcacctcgcctacagcgtcggcaaaggggagaacacgtcggcgatcgctgccaagtacggggtgacggagtccacgcttctcaccagaaataagatcgacgaccccacgaaattgcagatgggacagattctagatgtcccgctccctggtacgtgccttgctgttactgtttagtatggttcttgcaatcttgtgatcgagctcagaagttttttgtttaacagtgaattttctcagtagactagtcttactagtactataagagaagaaacttgaattagttaggcaggtgtttagttcacttcaaactttctaaaattccatcacatcaaatgtttggatatatgcatggagcattaaatatggacaaaaaaaaaaccaattgcacagtttgcatgtaaattgcgagacgaatcttttgagtctaattacgccatgatttgacaatctgatgctataataaacatttgctaatgacggattaattaggtttaataaattcgtctcgcagtttatatacggaatctatactttgttttgttattagtctacgtttaatacttcaaatgtgtgtccgtatacttcaagaaaattttagcacacgaactaaacacggccttactcgtattactacctctacatggttgactggggagactgaagattagctgtgttgttctgttagtttgcatattaaacttaggttaggtatggtaaattatttgcaatatgctgataatatattgctcggattcagtggtatttgcaatgaacttaggctatggtccccttgcatgatggagtttatcagaatcaaaatatctggttgtgactcggaaagttgctctcaagaaaagatagctagctgcacatgcttcgatcgttgagagattgagacaacatgacacatagctccactagcacatgagtagaaagccacaaaattccatcgcaatgttgaggaatttaagctttagagcttgaattcctgcactctttggacttgtataattagttagccgttgctatcaccggacaaactatctgactttgtggtttaaaattacggaataaactaccaataccaatccacaaagttgaccctcgctactcacaaggtttcaaaatatactattatagtactatcttagatggatcttgatgtttactactattcactttcttcggtaagaatgtcatatgaaacgagttcctagacctagtactaacttctggaaaactggtgtcctcagtgtgccgttcatcaatcagcgatacctcagctgatcacaatctgatgctcctcccggatggcacctatggattcaccgcaggaaactgcatccgctgcagctgcagttcaactacctaccagtatgctcccctattatttccatctccttctaagttgtttctgatcaagcagtaaccaaagaatttacatttcttttcactgtgtcaaccaggctaaactgcactgcagtacagaacaagggatgcccgtcagtgccactgtgcaatggaacgctgaagcttggtgagacgaacggcaccggttgcggatcaacaacgtgcgcctacagtggttactccaacagttcatcgctcatcatacaaaccagccttgcaactaatcagacaacagcctgccagagtaagttgagcccgcaaacctgtacaaactcagagtctctgagtttgtttgagttaaagaaacggcaggtttctaatagttgattttgcaggaggaggatctgggaggtcgcagttcgctaggtccatgtggagcatgtctgttatctccttccacatggtgttgatcattatctgtttcctttgatgttggagactactgcaactctagatggtacatttcaaagagttctctacgatctatgattgttgtatacgatatatgattgttgtcgtaacttagattttgatgactggtttatccagctttgaaatttgagttttgactctgttctttagaggatgagtggcacttgtacggctgcttgaataaaacgtcgatgtattgtattcgatctgcatctgaaaaggaatattcattagataggattattcgaaataaaaagatcccacatgtttttgttataggcgttacatgttctggatggatatataatgtaccatgcggaagtatgaatggacttcccaccttccaatcttccatctacacttcaagccttgcataaagcaaaattgatcttagcaagtctcaggcaaatgctcgaaactagtactagtttctttctgatatcattatttttgttgcgacttgtttttagtattgaagatactttaagcatgacatattttacatatttgcattaagtttctaaataagttgaatggttcaatatcattttcaaaagtccatgtcatgcattcactcctttcatttatatatgacgttggatagttcactaaaatgaattaaccaactcatatataagtggaggagggtgtgtttaaaaacggtgagggtatattcctcattttccccgaataagagggtatattcttttttatgattacttttaagtgcatcctacatgatgctgcacttgactcagttttaacacggaatttatgcaacatccgtgttggtcttcccaaatactgtatcatcagaaaatatcggagtagtcgtgcagggcgctgtcatcttggcagcaaaaccaatcgcagctagtacaatagtacaagactacaacttggatttgctttgcataggcaggcttcccatggccctggccttctcccggagcaagaacttctgcgtcttccccgtcgacgtcttgggcaggtcgccgaacaccaccgtcctcggcgccatgtaacgcggcagccgcgcacggcagaacgcgatgatctcgtgcgccgtcgcgcttgccccgtccttcagcgtgacgaacgcgcacgccgtctcgccccagtggtcgtccggcctcgccaccaccgccgcgtcgagcaccgcgtggtggccgaacagcaccgactccacctcgatcgagctgatgttctcgccgcccgatatgatgatgtccttggcgcgatccttgagctggatatacccgtcagggtggcgcacgccgaggtcgcccgtgcgcagccacccgccgcgcatggcctcctccgtggccgccgcgtccttgtagtacccgctcatgaccgtgttgccgcggagcatgacctcgccgacggcgcgcccgtcggacggcacgctcgccatggtcaccgggtccttgatgtcgacgtcctgcaacatctggtgctgcaccccctggagcgccttgatccgcgcgcgctcggcgagcggcagcgcgtcccactcgggtctccacacgcaccgcgtcgccggcccgtacgtctcggtgaggccgtacccgtgctggacgttgaaaccgagctcctccatcttggccagcacctgcggaggcggcggcgcgccgcccgtcgagatgagcaccctcctcggcagcggcctccgctccgacgccggcgcgttcacgatcatgttgagcaccgtgggcgcgccgcccatgttggtcacgccgtggcgcacgatctgctcgaagatgaccttgggcacgacgttcctgacgcagatgttcgtcccgccctgcgccgccgtggcccacgccatgcaccacccgttgcagtggaacatgggcacggtccagaggtacaccggcatggacgtcatgtcgttgcagagcagcgcggccagcgagttcaggtacgcgccgcggtggctgtagatgacgcccttcggcctcgacgtcgtccccgacgtgtagttgagcgatatcgggtcgcgctcgtcggccggccacctgatctcgaagccccgcggcgcgtccctcagaagcgcctcgtactctagcccgccaccgtcgctgctgctgctgtcgccggtgtcggagatcgcgatgacaaggggaaatttggctttagcatcggcgagcagcctcagggcgtcgtgggcgacggcgaggaactgcgattcgacgaggaaaaccttggcctccgaatgtctgagaaggacggacaccatggccgcgtcgtgccgggtgttcagcgtgcagagcacgccgccggccatcggcacgctgaagtgcagctcgtacatcgccggaatgttcgctgcgatgacggcgacctgaccagcaattaacccatgtcttgttgagagctgaattggcaccaagtacaaagctcatcgaggcatcaagctctggtcgatcacttaccacgtcccggcggccgacgccgaggcgcgcgagcgcggacgccccagcgaggcaccgttcccgcgtctcgcgccacgagtactccctgccgccagagacgacggccgtgcggtcaccgtacacgacggcggcgcgctccaagaagctcaccggggtgagcggcgcgtagtttgcatcgctcggcatacagccttccatggcagctcgtgtaccagcaatcgggatcgatttgtcacactaattagcctctctgaagaagaaccaattgcaactaatgcaatccgatttgtccaaagtgagttggaggataattaaacggatgaccaacactaaaccaaaacgttgttctccatctgagtcagtcttctttcgcgtgcattaattaattgcatacttgatgtgtgcactccggttagattaaagacgaaacgcaggaggtgtgagacgctgagaatacgtagtacatcacgggtcactcaatgagtatcatgctagtggaattatttttcgaaagcacttccagttggcgcaatggaaaaatgccaagagcatttgatcgagacagagggacaatattcaactattcagagcaagctagaaatgcagaattgtgtcagcgttatgtacgttaatgtcggccttttcaactgatgaatgctattactacaggataatggaatggtcgttgaattgtccgtcactattgtcttcgtctcgctccctttacataccttttggatcccctcctagatatcatcgagcgatttgaattcggtgtgcactgatacgaagctgcgctcgtttctcacttctatcttctacttcttcatttttcacatgctcttttcctaagctccatcttcaattcatggctccaaggttactttctacccttatcttatctcctactctttttgccccaaagctcaatccaacgccttcatttttcacatgctcttttcctaaagctccttcttcaattcgtggctccaaggttaccttctatccttatcttatctcctactcttcttgccccaaagctcaatccaaggcctttgtgggtttggggcgataagagcatcaccaagagatacgtataatctttcccaaaaaattatttttgggttttctaaactgaaaataggtagcgaaaaaactgatatctccaagagaaatctaaattttattccaaaaattaaaaaggatccttttgttaaactaacatcagattccgttttcctcccactcacgtgcgcccgcgctcctcactgagaaaaatctggcgcgaatgagagattggggacggcagacgcgccatctctctccctcgaatgaagagagtgaaagatgcggggagggggtttccaaaaaaaaaaggatccggataggacatctattggagactttttttttcaccaaaatctaaaaaaataggattgtgggtgaagtaagggaactattggtgatgctctaagagaggcgtcgaagtaaaagcttgcgaggtgtggaagaggaagagattgccgacaccctctccatggagtttgctttcattattgcctctattctcactaattggtactaactccatcccaaaataagtgcagccgtggatccgtgtccaacgtttggccgtccgtcataaaaaattttcaaataagacgaacgtttaaacgttggatatgaacaggataaaaactgcacttattttgggacggagggagtagtgcgccactcaggggcggagctaggtaggagaggggggggtgcccaggaacccggtcaagaaaactttttagctatagttcatttattttcactatatgtgcacccctctcaattcaaacttagacacttatataagtataaagtagagtaaaacaagtgagtggcacccctcttcatttcgttctagctccgcccctggcgccactagttcaaaatacatagtattggtaaatatatctcgtttaaagtgaaaagatcaaggatagggtggttcatggtgaatcttaggtaaaaataccagctccaatatgcaatttactgaaagtaaaattaataggagccacatgatgggcacaattttggtgaagccactaagataaataagtcatttggccaacatcaaattttgccacagggattggtggcaacctgccagctgacatagtataaattgaaaaaccactcgataaattaatcattttttttaaaaaaaatccaaacttaaactcagacgttcggtaaattttgttcaaaattcacaggttttcgagtggtaatgacaaaaatcggcaaaacccctcgaatcagctaataatctttggaactctgcatactacggcatcccatccaatgtccaacaacagaaatgatattacagtttactattggcagacttggtgagactgcccatggcccgggccttctcccggagcacgaacttctgcgtcttccccgtcgacgtcttgggcaaatcatcgaacaccaccgtcttcggcgccatgtaatgcggcagcctctcccggcaaaagcttatgatctcgccttccgtggcgttggcgccatccttgagcttgacgaacgcgcacggcgtttccccccagtaatcgtccggcctcgccaccaccgccgcctccagcaccgccgggtggctgaagatcaccgactccacctcgatcgagctgatgttctcgccgcccgatatgatgatgtccttggcccggtccttgagctggatgtacccgtcagggtggcgcacggcgaggtccccgctgtgcagccacccgccggccatggattccttcgtcgcgccgatgtccttgtagtacccgctcatcaccgtgttcccccggaacatcacctcgcccaccgtctgcccgtcgtacggcacgttctccatcgtggccgagtttttgaaggagacgtcctgcaccgcgatgtgatggaacccatgccgcgccttcagccgcgcgcgctcctccgccggcaacgcgtcccactccggcatccacgtgcagacggtggcggggccgtacgtctcggtgaggccgtagatgtgtacagcacgaagccgagctcctccacggcgagcaagacgcggggcggcggcgccgcgccgcccgtcatgacgcgcacgggccccggcagagccctcctgtccgcggccggcgcgttggcgatcatgttgagcaccgtcggcgcgccgcccatgtgcgtcaccccgtgccgcgcgatgctgtcgaagatgaccttcgccgtgaagtggcggaggcagatgttggtgccgccctgcatggcgacgccccacggcaggttccagccgttgcagtggaacatgggcacagtccacaggtacgtcggcatggcggtgatgtcgtacgcgaggaccgtcgcgatggtgttgaggtaggcgccgcggtggttgtacaccacgcccttgggccgcgacgtcgtgccggaggtgtagttgagcgtgatcgggtccatctcgtccaccggccaccggatgtcaaactccgacggcgcgtccctgacgagatcctcgtagtccacgcagcccgagtcgcgggcgccggcgccgtcgtcggagatggttaggagaaccggaaggctcgcggcgctggttgagccggcgaggcgcctcagagcggctctcccaacgtcgaggaggtgcgactcgacgaagaacaccttggcgccggagtggctgaggagggtggagatcatggccgcgtcgtgccgcgcgttgaacgtgcacaggaccgcgccggccatcggcacggcgaagtgcagctcgtacatagccggcacgtttgggctcaggacagcaacctgaacatgggacacacgacaatgtgggtcatacgcctgggcctagttttcagactgacccatgattaaatcaggtcgaaattatttcgatcgttgagtggcctgaccaaggaacatgaagaggtggagtggactgtgagtgggacctaaaatccttaccattttctccagaattcctatggatctccgaataaccaataatttgcatggaagccacattacttcgcagttcatactgaaagtataaaagtgaaagatctaaactgcagagaaggccattcgcatgatcgagagttttcatgacttcgctactattactcggtgtcagtagactgtagactcagatttataactggcgttgcaaaaatataaatagcggcaatgcacgaggatattagcagcaaggtaaaattatcccactaactgaagaagtatacgcggcaatgcagaagctttatcgctaactgaatcaagctgtttattctcaaaacaaaaaatcaagctgtttacatgctgatgcatagagagaacattaatatcaagagtactgataggagaagatccgcgaggacgtgaggttatctagcttcaactattcatgggctcatggcaaagattagcggaaatattactcgtaaactatatgtttagcatacttaacaagttttctaccaaaaactttcgggccatcgatctaagctgcatccgccacttcctaccttgttggttcaaaagaagaaacatctaagtagcaaatgctcgcgcacacgataagctaaaagagctagcagcattggtgttccactcaccacatcgccgcgggcggcgagcgcggcggccaagcggacgcaccgcccccgcgcctccctccacgtgtaccgcctctccccgcacaccaccgcggcgcggtcgccgtagacggccgcggcgcgctggatgaagctgatcggcgtcagcggcgcgtggttcgccgcgcaccgcaccgtgccggcatccatgtccagcacctctccctcacacagtcacactccacttagatccaccatcccgcctccatcgcctcgagttatcgaggtggtactaaacgagagctggccgtgctcgagcaggattgctattgcggccgcagggttgggcctgcattgtctttggggctttacttgccctggtgggctttgattggggcgacctggcaagctgcagtgtgaacgaacagcggcgacttgttttcagatggaaaaagtccactttgactcccttaagtaggccgaatctaatacggactcccttagatttggtgtaagggagtcagtgtgaatttttttttccttttcagatcaccacacttaatcaaatgtggatttggtgtggatgaattccctttttgcttcgtacggcgttaggaagatgcaaaactagttgaacttgaacacttgcctcctttttattacccatccacggtgtgctatttttttctgacggattatacctaaatgagaaacatcacctaattgcggtgtttggctaatgggattagaaaatgaattcccaccaaccaaaagatatctttaaatcttaaccattcattattcctcttccatttaatcctaaccctatattcatttctcaatctcaatcccacctcctattttccattatccaaacacacccaataggctaactacggtagaatttctttttttgattttttttagataatagaatcaaatatcccggcctttactcaaacgagctacaaccaattattacatagttcacaaaatagcaaactcacacagtgagtccagaaccacataatgaaaattttaaacaagcccaaaccaatacttgatgctactaagattcataaaagaaagcttgtactaggccttaggcactgcgctgaagtacataattgctgatggtctctacagaatgaaccagtcctaacaagttatgatcctggctcagaaggaacgctagcttgcttaacatatgcaagtcgtttcggggagaggggcagaaggaaaagagactcctagcttaagtattctcgccctgcttcaaaagtacagggcgcgcgctatgccgctatggctttgacataacaaggacattactccactatttacggaggtgctaggccacgagaaaatatatgtgattgggccttgcacattacagaatttcactagattggcccgttagatgtaaatgctaatcgttaaatcaggccgagattatttggatcatcaaatggaccgacaaggatgggaatgaagtgggctgtgattgtgagtttgtgaccgagaccttaagcttatccatctacgcatctccagaaactcccaatggaggtccccgtgaaaccaatgattgcaagcaacattacgcgtcgccgagtttcatgattttgccacgattactcggtgtcaccgtgtcacggtgtcagtaccaatcatgtgacttcaacacgagcgtgcgcatggtacgtaggctaaactaaggccctgttaaatgggactaaaacttttaataccctatcacattaaatatttagacactaattataaatattaaatatagactattaataaagcacatccataatcttggactaattcgcgaaacgaatctattgaatctaattaatccatgattagcctatgtgatgctacagtaaacattctctaattatagattaactaggcttaaaaaatttgtctcgcaaattagctttcatttatataatttgttttataagtagtctatatttaatactctaaattagtacctgaatataggaactaaagttaagtctctgatccaaacaccagctaaactgcctaatcgccgcatcaaagctcgcagacacgacacgccacgccacgataagccaagacgaaaagaaagcaggaacagatcaaatcacgggaagctcgtgttggtaagtactatttccactcaccacatcgccgcgggcgacgccgaagcgggcggcgagcgcggcggccacgcggacgcaccgccgccgcgcctccctccacgtgtgccgcctctccccgcacaccaccgcggcgcggtcgccgtagaccgccgcggcgcgctggatgaagctgagcggcgtcagcggcgcgtagttcgccgcgcaccgcaccgtgccggcctccatgtcgagcacctccccttcggcctccccctcccttcccgcgaggctggagaatagcagagatgctgcgctggatctggcagaagtaaacgctcgctgatggcgccatggcgataaattaatcgcgcggggggaggcgagattagtagtataatccaagtgaggaattgaataatcttggggagattggtgatgacatggtggtgatccggtgctgatgcggcgagctagcctacgcaacgcacgggatgcggctctcatggtgtgtgactgtgccagtgacgctgtcatcttgtatagccgtgtctgtgtcactgtgtgaggctactgttcactccggcagggacgcagcgtatgcatccatatgagctggatttttctgcatcggcatatcgtctcttttcttcgatttttttttgtaaggagtacagaagctttgcccagtatattaaggtggtgtttggatcacaagatactaattttgagtataaaacatagacaacttacaaaactaattacataaataagagctaatttacgtgatatttttttaagcctaattaatctataattagcacatgtttactgtagcattacataggataatcatagattaattaggctcagtagattcgtctcacgaattagtccagagttatagaatatgttttgtcaatagtctacatttaatatttttaatctgtgtcaaacatccgatgtgactgggacatcccatccaaataaggtctaatagagagagtaaaagtatatacagaattatgtacaggtctgaaaaaaagccaaaagaccccggaaaagggcttttcttcgaattggactattctgcatcagcctctcatctagacctttcttctaatggaatgaatgatagagctttttctgccgatgagctgcggcttaccatttgcaagcgaatacgacatccgttctatttttaagtgtaactatgagttttatctgttctatttttaagtgtaactatgagttttattttccaactttgatcgttcatctaatattaaattattttataattaataaaaattacattttaagtgtaactattagttttcgtgtctaacttttatcgtccatctaatataaaattattttataataattaactttttattgttataagatgataaaacatgaataatactctattattttataataattaactttttattgttataagatgataaaacatgaataatactctatacgtgatttatatttttatttttttaaaaaaaataaaataagacagatttaaaattgaacaaaatattgtttttattttttttcaaaatttttttaaatacgaaactccgtagtaggcaagtgaccacctcgatgggaatattttagcttaatctctcgcttatccgcttagcttcacctcatggtagtagcacatagcacccgtcaacttacttatcaaagggcctgtaagtaaacaagagggaccaaattttaaatttaggtaattggcaggggccgcgcgaacgcgtaccccctctaccacaaattatgacgtccactctcccactcggggagatggtaaaccaacgcgctcaccaagtgcaatgtgagccattgatctaggccacggcccttcttgatcggccgtcgaccccgtccaggtaagtatgttgcaacgacgcaccactagcctcttatatagcaggcgctcccatccccatcgcctcgagttgtcgaggtggtactaaacgagacctggtcgtgcagcattgcagctgcctggttgggtctgcattgtattgggcctaattgctgtggtgggctttgagcctttcattggcgcggcctacttggcaagccggagtgtgtacaacggcgacttgttgctttctggtcacgagcacttcagcatcagatggattcggtgtcccgagtggaattgtcaaatcgatgattttagattcctcctttgctacatacggcgttagaacgccagtcatcacacaaaaccagttgaatttaacaattgcctccttttttattatcccatccagatgtaacattttttttctgatgggttagtacatcaaaagaaaaacatctttacctaataggctagtactgtagaatatacttcacgctactgattcagaaaagaaagcttgcactaagtcttaagcactacgctgatgctactgggattcaaaaaagaaagcttgtattctgaagtacatagttgctgctggtctctactaccagtagcaactatgtactggtctccactaccagtacatagtccttacaaagtaaccagaaaaataaacatcacattattacagcggtccaaaggccacgagaaaatataactggggagcttcaggaccatgggtacctgggcaaaaaagagaagcacccttgcataatcagatacccagtgctgtcctctgggaagaaatgtcgaaacatatgctattcctttgaactgccagccaaacatcatcgaacctttttttacttcacaacacttcctggaaagagaacatggattcagacagggtcctagaattactgtgcatcaaacacaaccacatttcttttcacaggaaggtgtagatactaataagggtgtcaacgactaatccgcaaaacccacttttaggccaaaataagccacttacccgcttagtttgacctataagtgggttcacgggttagccacttacacccttaggtatatgattgatgggttcaaaattgcttatttatgtacgggtgagttgttctagaaatgcaggaagtctttgtaaaatcacatgttataaaatggacaaaaggcaatgtgtattactgacaatagaaaactaaccattagctttgtcatctgaaaaactaacggcaacatgctcaaaataatctcttctggcatctggcgtttaatcagaaaaaaatgttagcatatggttaacatgtagctaaaagttaacttgaaaacattggatcacaaaaatttcacccacatacttaccatgtttcatagttaaagaagggtcttccttatctttatacccaactacctttgcagggtttcctactgccatactttaaacattatatataaaaaaaaaggtcagatcaatttgactgaaatactattgtactcatcaaaataaaaatgatgtaaaaacatgcagcaaaaaaaaggcacacgtgtaaaataaataagcatttcattacaaaatacatattacagcgatcacttggggatttgactatgtaaaggcctgctggcataatttgcattatttttcagtgcaagacaataagacacaactgaaggactccttaacccaggaaatatcgaagagcctttcctagggggtatgccaaaagtgaaagggaatatataatctgctgagcacaagagaaagattcttcaccaggcactggtattttggttgatatattcttagattagtctgggatgaacataaccaggtgtcactaaatcaagcaccttaatgggaaacatgatgccatgagcccatgagaaaaaaaataatatctccattaaaatccaaatacttaaaatttacactacaaaaatcaggcaccttttttttatatccgatataatgaagttcctagtccaaaattactttatcatgatcatgttatccccccgcccaccccggcctgcccgcctcccctgattttgctctctttacaaggaaaccacattgcaagaaccagaaaggtcatatctgtaaatgattgtttctacaaatttgacattgcagcaaacactatttaaaaaatattaataggctagctcctaacctgtggggaggtacatcctttaaaacaagggaaccagcagcaatcatggcaccttcgcctacgtttatgttgccgaggatagtagcaccagctccaagaagagccccctgaccaatcttggggtgtctatctccattttccttgccagtaccaccaagtgtaacaccctgtaggaaaagtctgagtttcggtatccaaacaatatcatccatatcgaagtcattgttgttataaacctatctcggcacattgtagtgtatatatgttttaccaactcattagatgtataatcagcacacctgttgtagtgctcaaaactaaaattgcatctagaagtactgctttattttgaattttgcagctagcaaaaactgagttatgctgggcacctgcattaatgaaacccagtttccaacaatggcagtttcaccaataactagacccgttccatgatccaacaatattccctctccaattctggccgctgcagatttagtaataaagaatgtaaggaagataaagtgggaaaaaagggaacatgataaggcataaaagataaaccacaaatgttcataacttcactgttcaaaaatcaaattttaaaagcaatataaaaagaaccaacaattatcaactagaagagtgacataaaattgtcctgccaaagatgataaaacaggctaaatatcgcatatcaccatacaacacttgaatgttaaacacactagcagaccaggaaaatgcaaatatacatcattacagaacaatcatatacctgggtgtatatccactgcaaaaacctgaaaggaatatgataccaaatgttactgaaacagaactatttgctaaagcaatgtaaaaatatgcttcataaagaaatcagtgttcacctcactgatacggctctgcagtgccaatgccagaactttacgaccttgattccataatacatgagctatcctataggattgcacggaatggtaaccctgaagtggttcacaagcaacattagagttcttcatatatgttgatattgtgttttctttgtagcgcagagggctcttattacacataaggctgaatcgaagtatctagcaaatacataccttgaggtacaacaatgcccaactgtattgtgcacaggcaggatctctgtctttaaaggcctgaatcagcagagcgattttatagttgtcaagagatcaatgggataatacagaatgaagcttcatgcaaacacaattacacaaacatggtacatccacagaataatactataacaatgctcacctgagcatcaaggcgaatagaacggcgtatatctttgttgttcatcataacatcattgaaaatgtctattaactgagttgcaagcaatgttggatcttcgagcctgtttgcaaggacgaaactcaacgccctctcgagacagtcatgagatagtacgctggcgtacaagaagctacttaaaataggttccttctctgcctgtgaacagtataagaggcaacaatataaaactaaagctctatcataaataaaaaaccataaagtcatatttaaccacgtatgatgtagctcatgtttaaaactcattcgcatgcaactggagcttggttttattgcttggtcttttattaaaaagaaactaaactttcacacagtcactgatatgcttccgaacctgcgatattggccttcagttctccactaatcagataaattagctataataaactacttgcctcttcactcctagtttttaactggagtaccatttttgcctcctgaattacttggctacactgaactggcaactactcctacacaatagtaactgattcaggagaacaaaatatactaataacatttttttttctcacaagggtcaaggcaactaaattttaattttaaaaaaacattactcaattcatgctatttcccaactgcgcttaactcactcaacacaagtgaaagcagaagacaatatagcgaagtgctaactcagaagaacaagtgaactagcatttctaacccctcaaacccaaatcgagccgaaagaactctctggacctaagaacatgcagaacttcaattaatccaaacacgaccaccaaaaaaaatcgtattttttcctcgttccaacccaaaattcagagtctgtctggcacagtagcagaaaagccgcgatcaaatcagaaggataaaagaagaggtccgatcaatccgcgagagcgatctcgtgagagtactcacctcagacttggcctccgacttgacggcctcccatatggggtccccggcggcgtcgactatgccccgcgccgccgcggcggagctggcccgcgagctccccatcacgtagatggggaacatggtctccgaccggctcctccactcccccgcgcacgatccgcagccaccgccgccgccgccgccaccctgcgcgagcctccctctccccctccccgccgcctcgccgccgtggtcctccaccttctcgagcaccaggcacccgcacgacgtcatgggtgccccccaaggggagggggcttctccctcgcggcggttgtcggccggcccgacgcggcgagtcgccggcgcgcgcgccgcggaagaggagcgagcgagagaggagagggaaggggacgagagcgaatcagcgaacgaaaaccaaaacggcgagtgcgaaagaagcggttggggagcgacggggttattttacggaactgacggcgtcaccgcgcgtctggggatgcgcgccccagacgagaggagacgagacgacgagaggccccacccttgacggcttgcgcggcggcggcgcgaggaagggattttgcggcgaggtgtgggggaccagagggtggtctggtgctggaacggcagccacggctttttcggtttgcgcctttcggctcgatggctaccactatccccgcgaccccgccccgcggcgcgggggggaaaggggatccagacaaatcgtacggctcgcggcgcccgcgcggccgggtgggtggatgggtggacggggcccgggacgtgtgtgtgtgtggtgccgtgcgtgcgtgcgcgcgcgcgccaggtcgcgtaggtcgcgtgtgccgccatcgtgtgcgccgcgcgatggtgggcagcgggatgcgccccctgtgccgcgccggttgacacgaaagccttgggtgtgtgtggtgccgtgcgtgcggtcgcatgtgcgcgtgcgccatcgtgccgcgccgggcgacgggtgggcgggtctgtgcaggaagcgtggcctggtcgacacgaactcacgaagctttggtgtttttctgtataaagcaggtgacgccgccggataatcgccaacaacagtgttacagtgtactggagtagaacggaggatgtgatgggcattactgtcatcgtgtcgctgacgcgtgacatgttgtcaacttcctcttttcggctgtgtttagatggattcaaacttccgtcattttctatcacatcaatatgtcatacacataataactttcagtcacatcatttctaatttcaaccaaaatctaaattttgcgctcaactaacacagccttcatctactagggtggtgtggacgggaaatttaactatttgccactcttacgagtgtcaactctccatatgccactattagatttggcctaacatatttaccactagagagagattacgccctaattttttgccactttcgttgggttggagcaccacatcagcatgccagcatggaccggcctagtgaaatgacaattttacccctccattctcaagtggttaatagccaacataatacaattaaatcaactacgcacacatgaataaatgataaaacataataacttgagaacaactcaacacataacatactgcatcattaacacacatgcgcaacaaaaatcaatttttatcccataataacttcttcatcgttagaaatagtactaccaagttcataaccactatcaagttcagagttactgtgaaggccatacataacaagttacatgccattacgcaaggccatacatcattacaaaagcacaataatagaaatagcaacatcaggccaggccatacacttaagttcgttaggccatacacttaagatattcacaccacatagcaaaatatgccataccaaagtgcacatatcatcgcacattacttgcaattagtttttccaaaatatcatgccatagtagaccacaaataaccaatttcactagcaggttgacaaatttcaatccaaaagtttaggtggtgttgcacttttcttcttgcttgcgagcttttttctgggtgtaagcttcttgggtggctccactatagctggagctacttgagagctttggtcaagctccaatgccaacctcctggtgtttgtgatggtgtaaataataaaagaagtttagttcagtgtataataagtaatgaaagctagagaaaaatgaaaagagcataatggtgcttacctcctagtgactggtccagggctgcttgtttgtgatggctgcacttgtgtttctgcagctccttctctagctgtaactgctcttgttcttggtgtagttacttgttcatcactaacaccctttgatttcttccttcccacctttgttgttgttttcttgttcctcttcctgccaaaagaaaaacagttagcatataacagcaagaaaatgaataataattgagatgaaaatacagcacacctctttttggtgccagttagttcacatctagcacttcccttcctgtgtccaaagacaccacattctggacacttaatttgccttgtagccttccccttgcccttctcaagagcagatgggatcctattcttcctttgcctacccacttttcttttcttggacacaggagcaagaagcttgaattctttctcaacttgaggccattgcttcttgtctgtaatgttagggatggttcatccatatgctgcctgaaatctgagcacagagaaagccttatcaacatatttctccatatttggttgcctcacggttgtgatgactgccaatgcatgttggcaaggtttcccagtaacttgccattccctg

SEQ ID NO: 21249 - DNA, 1134 bp, Oryza sativa
gcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccactctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 21250 - DNA, 39668 bp, Oryza sativa
  unsure (1)..(39668): unsure at all n locations
tgattggagcatgatcagagttatttctagctaggacagaagcctaggtgttagggaaaagactgatatagttcgaagaagtaaagacccaatccagttgttcaagaagaggatcatcttgcatattgctccacgtaaaggaccttccttttatggggatctcaagtacccccaggtgactaatgatatcattgaaaatgaaaatatcattcatgttacctccaggtttatttctgttatccaccaatctataaaaaataaaatctcccaagatcatccaaaaatcatttgccacatccaaatcgtataatcacttaacaacttcatccctttctggtccatgagagggaccatagacattaatcatgatccagttaacactatccaatttagaagtgaaactgactacgagagcatgttgggtttgctacagaagtctagcagaaaacatagagctacaccagccaataaaaactccacctgatgcaccaacaaaagggagagaaaaggaaaccatcaaactgtttggtagccagggttttgacaaattttgcatcaaaaagccctttttttggcttcttgtaaatagaagatcgaacaagcactttcatctatcttttgcttgactgcctgacatctgcctgacaagatttcttcatttgaagaggtgaggaactagagcttgagttcacatgtgaaagatccaaacctagcatatacgcactcctgaccaaaaagatgccatttttatctagataccaagcaacacagtcctcctctacatgagaggaaatacgaatattccagcaatgatattagcgtcaactggccagaaatgtcagtttaacctattaaggtcccaggcaccattctcagtggtaaaatttgaaacccattttagtctgcaattgcctctcttcgtaattggcttcctagagtaatctctaggaatctagtagtcacgccaaacctagattgatctcccattccaacctctccaaatgatacccttcttcaataactccaaaccgtactcaatcgctcgccacctaggggatgcattgcctccaaaacatgtatcaattagggaaccagtaggatagtaccttgctttgagtactcttgctcacaaactatgaggattcataaggagacgccaagcctatcttgcaagtagggcttgattaaagattttaaaatctctaaatcctagccccccaaagctcttcggttttgttagacagtcgtcccaagatttccaatgagttttccttttgttattttcagctccccaccaaaaattccgagttaaccttgttaaatcctcagataccgactcaggtaacttaaaaagacccatgacataaaccggaattgtttggataacaacctcgataagtatctccttacctccactagataagaaattatctgcctattgtatcaatcttttccagatcctggcctgcatactttggaacctgcctttttttagcctgccttcagaagtcggaaacccaagcctcaaaactagggtgtgcaacctgcaaaatacttctgatagattcacaaactgcagtaggggatgaaggcccaaacatcattgaacatttcactggattaatcaactggctagtactctgagcatagttttcaagaacttccttaatcaccaaatcttgctggttatttgccttgaagaacaatagggtatcttcagcaaacaacaaatgggagatactcggggcttgtctgcagatgtgcataggggaaagatcaccgttatgaacctttttgtctagcaataaggagagaccatcggctacaaacaagaagaggaagggagacagtgggtcaccctgccatagactgcgtgtaggagcaaaggtagacagaagagttccattgaatttaactgagtatctcactgtggttatgtaattcatgaaccagctaacccaacaatgagagaaccctagtctgaccattgattgctccaaaaaacaccaatcaactcgatcgtacgccttggacaaatcaagcttgtaagcacaagcaaccttctgtggttgtttatttttctggataaaatggaagcattcaaaagctatgagggtgttgtcggttatcaagcggccaggaacaaaggcactttggctttggggtatgaggtcatccagtataggtctcaacctattcaccaagcacttagaaacattcttataaattatattgcacaaactaataggtcaaaaatccttcaactccactggattctctattttcaggataaggacaatcgttttgtcattgattccttcaggaagaacacttcttctgaaaaaaagacagcaccgcccttaccacatctttcaaaataccccaattacaatggtagaaatatcccgggaaaccgtctggacccggcactttcagaggcccaatctgaaacatggcagtagcaatttccgaagtcaattgtttgttcaaaaccatcattttgctataacattagctgggtgtaacgacaataatggcaaatgattttatcaaaatgatacaaccatatcctctatgcatttatcataggtgggcccaacttatacccgcataaatgttgcaggttgtcagtgtgttctcggtgttatagataaggtattcccaatacttttgggttaggctcggtgtggctcaccatataccaagttttatcactactacagatttcatttttgcatatggcccaaatcgatctttgcacacaaacgggcggcccgcatgcactcaaaggtctgcaaaaattaggatttttgcatgcagttagcgtaaccgcatgcaaaaaatccgattttcgcatgcgggtccttaagccgaccgcatgaaaaaacaaaaatcgtgaataaataaataaaattcccaaaaagaaaataacccagccccaccgccgccggtcgcccaatcccaaaccctagcccaaaggctggccgctcatcaccgctcacaaggtccgcccgctcccaccgccaccgctgtcatcgccggtcgtcgtcgtcgccgaggtcgccatcatcgtcgcaggatatggcagccgctgctagatctgtgcaaggggagagccaccgccgccaaatccaggtgggggaggggccgctgcccccagatccgtgcggtggatggcctccgccagtcgtcgtgggaaagggccccgtcgctcccggccaccacgtgaccgaggtcatattcgtcgcggggagggtgccgccactggatccgtgtgggggaagggtggccgtccccggatccacgcgggggagggccgccgtccccagatccacgtgggggaaggccgccatcgccgggcgcctcctccgctggactcctcgcgaggatggtcgccgccgctggcctccgcaaggggcacaaccaccgccaccgcccaccatcgcgccgcactgcccacccaccagttgatatcaagaagagaggaggtgaggaggtgagagagagatatatatagagagaggagaagataaggttgagttagaaatttttgaactgttgagtgggaattagaaggtaagttagacttctagacagctccttaagaggtcccggctgcgaaaatcgatttttgcatgcgggcctcttaatgagccgtatgcgaaaatggaggtcgatttttgcagacgtggtcagttatgatccgtctacaacataacaagggtctcgtccagaaaaatcatttttgtagtattgtatatggaatcatgcctcatatattgaaggtgttccatatttactttttgtttaaatttttaatcttgattctaatgccacgtcaacgccacgtgggacgaggaccaaatcaaataatctacgtaggcgccacgtcaactaaaaccactgttcaaacctccttggggtcttatttgagatggtttttagagtcgagggacgtgttatatgtggtattttggtttaagggcgaataccaaatttgacgacaaattaagggagctaaagtgaacttactccctgtttgaagcagtgacgcaatggtgtataatttgggccttttggctatctgcccataggcccatggagactctttatgggctggatcggatggtgcctcggccataattaaggaggcacagtgtttcgaacgatttttcttcctataagcacatgcgcatgcgcccacctacatgtgagcatgtgtattgtcctgaatttatgtagtatttctaatcaaactagcaggcacaaattaagcaaatgatccatcatcatgtatttgctagtattacagttacagattatgatccaccctgttaatcttcctcctctgcttgctgatgccgcgttctatgtaaaacaaatcaaagattacagactagtatgattttgacgatccaataagcagatggattatatttgaactgaccgctgcagttccaatttacaaaacagaatgtaccacaaatgataataatgttttcattttcgacagcaaacagtcaattaggcctaaacaagttgctacgagctagtgatttgtcctaatgatcagtagcctattaatcgaagtccgatgaaatgacccctgcacacacctgagcttcttgattcgaaatataattacagccgttacgtgctcacatttaaaattagagggttgcatgtgcattcctagatacgaaaattaattggaattttggatttggatgggaggaaatatcagttgcaccatcgccgaagagattaattccaccaaaaccatatgtgtacgactctgcacgtttctttcccctaacaaatacatgtacacacaacaaactcttttggaaactactccatatatataaataggctatgttcattctaatgcccaagtgatggaagagagtatgacgaagcccacgacgatggccatttttctttctatagtgctactatccatggcacagcttccctctctcgtcgccggcaccggccggccaagggtcataatcatcggcgccggcatatccggtacgcacacaagtacttttaccgtcggtgatatctacgtcactcagtattctaagtttaccgtctacgtcactcatagtattctaagtgttactaatagaaatgatgttagctgtaatttatgaatttatatcacacatgttacatgttgttactcccttcgtcttagataagggagtgtgtattttatggctggtgcccaatatgcaagatgtaattttagtttgattcactatcttcctagattaccctttcataatgtgtatgcatgcaaactgccacaacctatacacgcagaaagcatgtgggcatgcaaaccaaccaggcataacactaactcactccttaactaaagccttagaacgctagcatacccaactgatacccacaaatctatctctaaaattatatttttgggatttataatttaattttaaggtgtaaatagatttttatctctaacatatatcttgaataaactcataataataaaaagtagacaaactcctaattaccaacatatacataaacaaaaatcgctctgcatatcatctccccacgcgcaatctctctctatgtgccaccctctccttttgttgtgcggaaatttggagtgagagtgtctctcaacctgtgaagagcaaaaaaggacaaggtgattctaatttttcggataaatatttaacactaccacataaatgattttcccatatggccaaaactcattattgttggcgggtggagcacctacctggagccaggtatctgcaaagaaaggcacttccccatgtggttgcaacaactgcatgcaaaaatgcattcttgcagtcaggcgtcttaaggaggccgcatgtaaagacctgatttttgcatgcaatcaagtaaggatgtctgactacaacgattttcaataataataataataataaagaaaaaaaaaatccaaaaccctagatcaggcactgccgccacaggcgtgagtccgccactaccaaggctgcgccgttggatccgtgaggaagaggaccactgtcgtcgtcatcgatgcagtccgctgcctgccgttgtcaacatcgcgaccccaccgcacccaaagccagcggcggtggatccaagagggagagggccaccgccgctagatccgttagagagagggccctaccgtcgtcgccattgataccccgccgcaccagaggccacctgtccgcctgtcctgaggccgttgccgccggatccgtgagggaggagggcccccgccgtaggatccggctaggagagggcccccactgttgtcgtcatcgataccccaccgcaccaaaggctggtggcggatccgccctcccgaggctactaccgccggatctgcaagggggatggcccctactaccggatccacgcagggcagggtcgctaccatcggatccatcgaggaggctacgccgctgccgccgttgacgtgcttccccgccgtcatcatcattgatatcctgcagcaccagaggccaccgctggtagatgcacccctctcgaggcttccgccaccagatccgtaaggaggagggccgccgccgaatccgccgaggaggctacgccaccgctgctgtccacgcacgcctctcctccaccggcttcagttttagaattaggtttatttaaggatattgttggtcatgctcttaattcactctctccttgatattaggaaaaaaaattaggaaaaaaaagtgcaccctctaattaacgacgaagggagtaatttatgcagaagctataagaacaattatagtcccatagatgtgtgctggtaacccaggtgcttgctttaaatcctgatcttcatacataaactaagacgacatatagttctatatagatgtacatctatgttgtgttgtgcaggtatttcagcggggaagcggctgtcggaggctgggataacggacatattgatcttagaggcaacagaccacattggcgggcggatgcacaaacagaggtttgccggcgtcaatgtggagatcggcgccaattgggtggagggcgtcaatggtgagaagatgaaccccatttggcccatcgtcaactccaccctcaagcttaggaacttcctctccgacttcgacagtcttgcccaaaacgtctacaaggagtacgtacattccatgagtgggtggatcgattgaaataattaaaactcgacacatgattaattatacagatttctctaaaaacatattttgcacatatttacgtgtgcgcatcatagtaatagacaagcactaatcatctgccaattccaatctgtcaccgctgttggtttgggaaaaaaagagagtaattaatgcccagttgtcagaagtactccacctattcacctttcatttatcaacaagagagagactaataaaaaaaaactttttgcggcccatgaaatggaatagtatacttctaaataaattaaaatatatatgcaacttctaactagaaatttgaaatgttaatgaaaatttcaaaaagagactgaaaaactttcaaaatgcaaagtttctgttgagattaaaactttcatatcattaaatattaaaatggccataggtaactgttttggacatccatatttgtcatttaaacagtatagttttgaacattaacttctactcggctgctagctgcgagaaagttatataaaaagaaattacgttatatatatagaattttacttcacatggtttggccaaataacatataaataaaacctccaattatagaaatataaataatgtagccatataagaaaaaaataaataatagatcgatgatctaaacatgaaaaataatttgaggaaatcctccaatgctaaaattatagacaatgtagcttccgtaagagagaagagataatagatcgggtccaaatgctgaaaataatttgaggtaattgtgatagaaaaagctagaaacaaaagatggtatgcattaattggaacagattcatgcagggtatgcaatttcggtaacaccgaaatttttgtggttgccaaaatttaaaaaaaatcatggatttcagtgtttttttaccgaaattatttaaaaatttaacatcttttgacttaattgaaacaaattttgatcaaattcataaatatttgaaaaaccaaaaattccagaggagatttgtgcttgttggtacggtctgaaattaccaaaatttctaaaatttaaaaccgaaattgcaaaccatggattcattgagaggagatggcaatttgcatcatgcataagtgatctaaaggctagaaacagatgaagtgacgtggcttaattagagaagataggattagcattatcttaatggagattcaactttgttagaataaatcaataaagtcaacgtataacaaacaaaatataaatttaagttttgatctttcgaaaaatagtagtacatatactcagacaaattaacgcatatggatatatacccaagtttcaactagggtacatatatatgttcaaaccgatgaatgtttgtgagtgacatgaatagattttacagcaaaacttaattaattgtgttttcagacaatagaaacaaactatgcatgcaaatatattattgcatccaaaatatatatatcctactagcatacatatgcatgttgcattatattgcctgaagttgaataatttcagcggtggcctctgcgacgcagcatacgtgcagaagagaatcgacctggctgatgaagcggataagagtggggagaatctctccgccacactgcacccaagcggccgggacgacatgtcaatcctttcaatgcaacggctcaacaatcagtacgtgcctttgccgctcaagtctttacttaaaaataaaatttaagcacttagaaaacacttcaaaagctatttgaattgatcattcatgtatttcaaatagtagctccaaaacaaatggaatttgcttaggcttgtgggcctctgaaaagttgtaggcttgtgggtttaggcccaaaatgaaactaataaccagtctagcagatacagagatacttcctcatgcaggaatgaatacgaaaccaatctatctatctattatctattattatttactaaaaatccatgaaacttcctacaaacactcataagccgccacgtggcactcctacaaacgctcctaaaccgtcacatggcacttttaatctaaccgtcgattttcacttaaattggtggacccactgttttagactattagattagatctatttagaaaagtcccagcttcatcgaaattataccagaaaaattaatgtacataccggatataaaccttccgtattgttctcttaaaaaaaccaaacagacgtatacgtacgtacgaagattaaaaaaaaaccaaaaaaccatatgtatgccgtaagaacaatacggtctttcgaatatagtgtagtacgtattgtgtatgcctttctctgttttttatttatcaatgaacagcaagtacatacttaagacttatctatctatccaccgtctttaaaataggatttcctatattataaaataaaatttattactccacaaatatgcactgttaaactagattaatataaagtaccaaatcaactgtctttaaatgttcatcttttaaattatttctcaaatatatatctaacttataatcctttgtctttctttaattaaataaaatactaatcacttataatcacttataatagttatatgttatatggaactgctaaattcattacgacacatggtgccaacatataatacgtaatgtgataattatttttcaaataatttagttaacatataataactaatgtcatgatcatttttaaaataatttcacatgacaaaaatgatcaacttggtgtcaaattcgcttgacaaatatataacactaattcaaatctacatgcagaaaaagtgaaacaacattgtggtttacaatcagatttgattttattttaatttatgtgatattgagattctcttttttttaaaaaaaatagaactatttgatgggaatttccaggcaaagaccttgctatattacgaccccttaatccatcaggagaattacggtcatatattgtttttctttgcgaaattggtttggtaacaaatgaaaaatcatttgcatcaaactattcatcatatattttttatactttagaaattctaatatatcaaacataattgatgatgtatgtcatacaccccactgaagtaactataaatgcactccaacaaattagttactttaaataattttggaaaatatattcttagaattagtaaagatgtcacatgtaattatgaacaatacatgaatgaaaacaaactgaagctaaactatatatcttagtcaaaatataaagaacaatatggtactcctagatgtcacggtcgtatgtctgtttagttatattttttttatcaaccttgctcatctgaaaagagaatattgtatctacacaataaaaaaaaagcattactgattaataccatgcacaattttgtctacacaaaactatgaaaaaattcactagggaaatattttcatcaccaacattccctcttttttttcccataaagggcaccaagcatgctgtgctaccacaagtgtagcaaatgtcatacatatggttgagttgaagccaccccggcaaaggccactattgacaatagtgtataactttgtacttactgatgcaattatctatgagggtgctgatagtgaactagacattaaaattatgcttcatgctggcattgcggggcataactatgtcgactcaagacctatgtttaaaggcagtggagaaataaagcctcgacagatacggttagcttcacccattaaaggggacattcatatatgattttaacggtcatcaaagttaaaaaatcttataaattataagaaaaaaatgatcaacggtttacttaaattatttagaaaaaaaatagaaaaataaagtccccaaaacctcgtcctccccggcacatgcacaaaacattgccggtccccttcaaccttggctcatgctctccgctctccattcctcccccttcctatgaataatactgaaaagaccatatttttaatatatacataacatttctaatctaattattgctctgttaaataattaaaccaacaattcttgatccataatgcctatatttttaatctaaaataagacttgtataaaataaaatagaaaagtagaaaaaaagtcaatagggattgaatcaaatcaattagagagaatatagtaataaatttctgaaaaatagaaaattggaacaaccattgtatgttccattgccataaccatccatctatcgtggtattatgagtttctcatatattattgcatatataagacatactaaggtagctggacgtagtagtacttagttggttaaaaagttatatatatatgctactatcaactttaaatttaggactcatgttgcctagggttttttttaaaagaacaccataaatcacatatataaaagggaaaggacgcgtaaaatatatatatctcctatgtatttattgtctcattctttcaagaaaataaagaagatcattgataattgcttatagtaatgaattaaatattatatagttcaaaccttacaaatgtcttgtaaaaaattatctaagcaatagcgatgaagaaaatttataaagaaatactccctccgtcccaaattataccaactataatcaaactcggtaccttttaactaataatcatactaactatatctaagtattatgcatgttacatcactagatttatattttgaagtactttcatgtgatgctaatttcatatttgttgggatagaatggaataaagtactggtcaaaatatgttattaaaacctgtgtaaaaaaatataggtcttataatttgagacagagggagtagtatttttcaagcatagcaggtattgtccgattgatactccatcatccgattgatattcccagtgtaacctactttacatgcccacgcgaatgcgcgggctaccttcctagttctaccagaaagggtaaatgatagtaccagaaaaccaaatctcttttaactaaaatagcccttaaacctcacgaagtttggtctgactgatgtatatgcgcgtcagtctgactccgtagtcctgctgatctaatcaccgtgtgcgatgaatctgcctgcctactcgtcaccgctggttaaaccgcccgtcgagtagaccgcttgtctgatgctggtctgaccattgagatccaaaaaaaacacgtctcgacaaaactcttaaaagtagatcaaccgtattgtatcaaattgtgtttacaaatcgcatctaaagcactgctctttcacctcatgtactagagtcaaagtctcaaagcaagaactaacttttctcccttaaaagtcgatatactcctaatatcaacccctcgcctatttatacataaaacatagctgtacctagccatgaatcctactggaactaggaatcctaatcacacaaaaaaacccctctcgaaccaggaaaacaacatccctatacaacaccaaacttctcaaacttaggctctaatctaaatttgactctactttccatacacacacaacaccacgtgtatgccataagagaactcatgtatattgttctctagtctgagcatctcgcatgatctcgttgatcatttgtacctcaagtaatgcaaaatttcatatccaagcacaagttcacaccaacttgtgtcacatcatcatgcaaatagtatcacatatgtatctaaaccatttagaagtcatgaatatgaaccgattttaaaaatcgacaaaaccaacctgaacatagatgaaaaaccgaaaacattattcgtcgtattttcacatatacttatctttgacaattatttttcaccaagattacatcatcacatgatttcacacctccaaattttaatatatgatgccattggcattgttagatacttttggttgtccatattaattttgttattatttgatttgtcaataaatatttttaagcatgactgatatgttttatgcttaaaatttttaaataagacgaataactaaatgtcaacggcaacgtatattaaaaaccgatagagtttttttggccgggccagtggacggcgtcggccaatgtattaagcatgggaaagaaaaacattttacaaacaaacaacagtcactgctgtcgggaaactagaacatacaccggtagtaggctgggttaggccagagactaaatatataactggcccgcctgacagatagtatacaacatacttctatgtaaaacaacttaattctaaagatgtatctagataacgtgtatgtccaaatacaagctcagaaatggattagaattaaaaaaaattttaaagatagagggagtagtacaatagttgtacaagctgtgattcagtctctctgttcttctgggtggtggtggcgtgcaaatccatgaaatggccagcctgcccaacggcccgtcgtcgccggtggacatggtggtggactacttcacctacgactacgagttcgccgagccgccgcgcgtgaccagcctgcggaacaccgttcccctcccgaccttcaccgacttcggagacgacaactacttcgtcgccgaccaacggggctacgaggccgtcgtctactacctcgccggccaatacctcgaagccgacaagtccggcaacatcgttgacgctcgcctgcagctcaacaaggtggatcgatcacttctgtttctgtaactcatctcgatcagctcctgcgctaatgctacgattgttttcgtaattggtcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggagcatgttccctgacgaggacgtccccgacgccaccgacatcctcgtcccgagatggtggtcggacaggttcttccaaggcagcttctccaactggcccatcggcgtcagtcgctacgaacatgaccagctcagggtacgagctgttactccaaccaaatgctaatcgcaattcactacagatcatgtttttcattgctactttgatgtttctttggtcatgaacaaatgaggtttaaatttgagcttaatttggttttgtgtatgttttgctgtttctgcacacaaggcgccggttgggagagtctatttcaccggtgagcacacgagcgagcgctacaatggctatgtccatggagcttatcttgcaggtatctatgcctaatttgttagcctatgtctctaatgttagagagaccggagatgtaaaccatttttattgtcttaaaaaaatacctgctctagtgattgacgagatttgtaatgctaatatttgtgcttattatgtgctgtgcctatgctagtttttgtcaggtattgactctgcagaaattctgatcaactgagtgggtacagaagaatatgtgcgaatgtaatgtcaggggagagttgctttcccctgacattacattcttcagttaattaattctgcgtgttgatatgtatttttaggcgcaaacattttcatgatggaatgagaaatgtgagattccacaatttgctcatcgaggtgtgtagggccttttgtggaaaattatggtgtttacattaattgttttcttatgctacttcttgttgctgaataattcagcagttgagctgatgtatatatgttcggatatggtatcttcatatatcttcggatatggtatcttctctacagggaccaattcaatagtttaaactataattttcagataaaataatgtccaatatccccacttcgttttgttgggactctcatgtcataccctacaccttgtggatttctaataactaatggtatccgttctcttaaaaaaacattgtcaaattttcccaacatcgcaattatataattggtttgatcaatataattaatactaaaaagtcattgtctcttattgcaaaaacatactccctctattctataatataaggtgcggttaaagttggcacggtctccaaaactaatctttagcttataatttctcatatactataaggtttgtaacaacaaaattataacaatatgaaagaagatctaaatctcaatctattatactaagtattggtcaaatgttttaaaagttgaatcttgaaatacgtgcgagcattatattatgggatggagggagtatttaataagttattgatttatgataagatgggataattcttcgaaagaatttattattttacaaaatgttggcttaaattttaatttttatagtacattttgctaatcatgtgacatcatatatgggccgcagtggaacgtacgattgaattgattagggatcatttttcagtttataattttgatttgagcaaaggccagtttcccatctctttttctcatcagatgttatatttctgttttttgtgtgctccatataagataggctttggtcgattttgaataacggcgtttagtgtactttacaaaattaagaattcatttataatcttcacttgtcacgggttagtctagtcagctctttaaatgggaaaaaaaatcttggacaatatggaggaatgcatgaggccaacatgtaagacaaagtgccaattggactaaacccgcagacatgatttgtacagtttgggaatcgtgagtggtaggatatacgcgaaattcagctaaaagagatgggagatagagatttttatacaggttcaggccccttaactaatgggtaataaccctactcccgttgaccgaaactggtgttgcctttatatataagtatcacacgagtacaatatatggaatgacctaatctagtcttcgtcggctggcaacatggagctctcacacttagtcgattgttaacgtagtcagctttctcgaatatgaacttgatgagattggagttgtctctagatctctcatgtcggtatttgtggcttctacattgggtttgtctatatatgtattggtttgtattttgacttagcgtgtctagatctgtctagatgtcttggtgcgttcgttactcctcttctctccccctatgggttcttgtatttatatcgtcgggtacccctttacaagtagaactagggaaacgagtatggatacgatccgagtaatccttatagtgcccgagtagactctgtttctttttccttatctgaaacaccttatgtttagtaagctccgccgagcccaacccaaaactattgggtatacaatatctataacactaacaccaaaggtacacccataagatgctaggcaaaccaaatcctaattcatgtgcaattatttaatttttgctagtgtatggctaatcgatccgaatgcagatatgtttgaggtactactctatatctatataatacggctaaaccatatttaattatttaataagatagatggtcagatgttggacacagaaaaccacaactctacttaaaatgggacagagggagtagctctctcagggttgcatcgctcgttaagattaaactgagagcactatcattctagattgtaccaattaaggaagtttgaaatttctctctataaaacgatttgttacaaatacatccctcgtaatgcaccttggtttgagattctcccaattgtcaattattgtccattcttcgcacacgtacgcgctcatctgaaaaataataggcaaggaaccgtggtcaccactcgtgttaggcatggccagataacatgaccatggtggcttccggcatcccatgcatggtactcagtacgtcattgggcgaaaggggtcacgagtctcctctacaagacattgcggacgacggaagatgagctatatattacgcttgcctcatggggtttcgtgagctgcctgatttattggacagattaagatgaggaagaaaatgtgtttgaaatagtatccatcatgagatgccctaattcatataacacaggtggaaagagaaaaatacaggaggaatctcaaacaaaggggaattaggagatcgaggggcaatttttaaatcttatggaaatttcaaacacagagtaacatttggggttttttttttggttgcaattttccataaaaaaaaggcgctgtggtatatataagtacaccgatggcacaaagcatataattaaatgaaaaaaaaagaatactccctccattttatattataactagctttgtctcttttactagtcaatttcttttagtttgatttaagtttatagaaaagatttaacaacatctacaatgccacattagtttcattaaaactaatatttaatatactttgataatatgttaattttgtgttgaaaatattgctatgtttttctacttgtactataaaacggatgtaggaatcaaacatgaaaaggaaatagctagcaagaaaaaaaagatacatcaactaaaaacatgaagggttcttttttattattatagtccgagtatttcataaaaaactagatgaagaagaaatgcaatcaggttcaatatttagaaaagccattttatatttaacataataaaaaagatataggtttttgacatgcacatattttagtttggttggataaaaaggaaagcaaaataacaattgaagcgagataaatggatatcatcagaaatactagatcgatattaattagagaagatcctctaggatatatatattctcgatcatatttgaacatatgattcagaccatgcgataattattttagacttttttgttagtgttggttgtgcttaatattataggatggagaaagtacagatgaaatagaagaattaatatttagaatgtagatatatatttcaatatttgttatcaagatgtattatggagattatttggatgtgaatccagccaccccggtcccagcctaccagcactgaacccaatcatttaattactcgcatgcgatgcaagttgccatgttgatgaacttctgagcgcaaaaagctaaacacgaacagctaacgaaatttaatcaaacaaaagggaaaaggacctgacaacaaatacctgcaggtcccccttttacaaatgaaaatatggaatacacgggatattttataaaataatcttcattttcaaattttaaaaagtgttccagttgtacgtacgcctcacaagtaaacaaaaaaatattaaatttaccacataaatcaaaatccataatcaattgttcatacattaacaacaaaaatattaatttaccacacaaattaaaagccataataaactgtttataaaatatcaaaatttaatattaaaatactagatataaaaaaaattataactctggcactcgcatttacaacttttttggaatggtaagcgatgtacctgatgatggctaggtgcttggataatttcatcaatcttaaaatttgtcaatccaatctcgcgagaaagttgtatgtgtattcgtttataagggtgggtgcgtacgtgtgtgctaatctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccaaatccaaatccttccaatcaaattcctccgcaaaagtctattttgcctcccccgaggtcgatgggccgaatctcgctcggcccatcttcccctcttccccggccccctctctcccgggcgctctctctctctctctctctctctctctctcgcgcgcgcgctctcccatctctcccccccccccccccgctcggcctcgcccgtacgctgctcgcgcgagcgagagccgccccgagcgcctctctccccactcccctgctcagcctcgcccgcacgccgcacgcgcgtgcgcgtaagccgccgcgccgagcgccccctccctttcccctcgctctaccgcgcctgcagccgcgcagccgctcgtcctcgcgagccagcgtgtgcgcgcccgcgcggacgccgcccgttgcttcccgcgcgcgcgtgccgtggtggccgaccgcccggtcgccgccgccgtcagcctctgcacgcgcctgtcgccagatcaagctccggatctcaagcaaggcaagccacctttgaacatcttgagcctatatttgaaatttaattatattgcttgcgaaatattatgcattgataagatcacacttaatctgttgtcccgtctgcaaggcagattggcagacctacctaatttgttacatttgatccttcctttgttaattgttataccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccacggaccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggttgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaaaggggttcgatgtttgaaaaatctgcagctgatgggatcagctaggcccgggtggccgtttgaaaagttgttggcccgggtggccgtttgaaaagctattggccgggtgccaaccctgtttcaagatctaaagactgatacattgcacatactccgaccggacgagacgcactgtctcctccgtgttgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgacgattggtccaagtcctggcttccgctttccttttgtaatgcagttgtgatctcgggatctgtccgcagcccaacatgactgtacttctactctataaaaaagagacctatgttgctgtgatactctgtctccctgtgataccagcactgtttcctgggactggtatcgattaacaggttaatttggagcgtcacgggctagttccggtcgggactagttcggggcgtgacattatcggcatgacggctatgcgtttctactgtgttttaattagggttttaaaattatgatactgatataaaaaaaccttttacgctggtttcaaaatagctaacgcgccaacggcgggccaattagataggaaattaagtgaggagacaagggtgtatcgcgcagcaagagggcatgttgtgcagcaagagggttagtggccaatttgacaagttcctcatcagtctgcacgagctcatccaacttcaccacttcgcccactactacaaaacattcaaataggtatcggtactataggtaccggaagtgctaaaaccggcacctataagccttttcccacctccgcggtccgaaaacacgaaaaaccgacacctttaagcaattataagtgtcggttctgtaaaaaaaacagcacctatattataggtgttggatttcagtaaaaaccgacacttataataaattaaaggtgtcggtttttttttaaaaaaacagcacctttcagatcgagctgtgagccgagccgcctgaggagcggataagggagaccgcgtctttctcacgcgtctttctctctctcggtctcttctcttcctctctcttctccaccgcacacctcctcttctcttctcttcgtcctctctttctcctctcccggcggcaggaagagcggcgggaggagcagcggtgtcggtgtcggtgtcatcagcaacgtgtgtcggcgtcgtcggcgtgcggcaggaggagcggcggctgcccggaggcgccctccctcctccagatccgacaggaggaagggcggcggcggcccgacagcgccgtcccctccgctgtagcagcgtggggcggcggcggcgttcggcgggaggagcagtggccggctggaggcgctctccctccgccagatctggcgggaggaaggacggcggcggcccgagatcaccctcccatctgcggcactggcttgcgacggcgttgtcggtggcggcagtggctgatttttgatttttgatttgttgatattttgatgtgatgatttgttcatatttgttgatgtgatgatttgttgatattggttgatgtgatgatttgtgatttgtttgatctagatgtattcatggatttagggtttttttgggatcggcttgacagcacgatgcatcaagccgatttgttttggctcgttttgaaaccggcacctttaggcttctgtgatctgtgccactctcgtggtgtcggttgggaaaaccgacacctaagggggtttcccaaccggcaccatttaagggttctgtagtagtgtccccaaatccagtgctcaacctctcgtcgtttggtggagtggggaagaagaggatatttcttcgtcaaggtgagaggaggggattgacgtggggacaaacaaggctgagtgacatgcaacatgcggtggggaaaatgatgctatagctcttgctcacttacatgtggcaatgtgggccaccagtccaatgtatgctttggtaacaaaatatggcggcctaaagtgaaagtagatggtccaacttgaaatttaatttgatgataaagattagttcaaagtgtaattcattttttgattttctttttgttataatttgtatttttattaaaggcactttaaatatgacttgttttttatttttaatataatttttcaataaagcgaatggccgtcaatttcatcgtacattaaaaatactggataggtaatgattactcccgatttgctggaaacttgacacacacacgatctggcttccaatcaacacgacccgaaccctgcaattgcagcaccacgttttctctagttatcaacctgattaacctcaccgaaggctaatccttgtgtgcgaatggaagaaaacaagtaagagcaacgtagattgcaactcaatttgtagatgaatgactaagcactcgaatagggttccacaaaccgaaccagtgacgcaactgtaatggcaaaaataatgtaagcaaaactcgagtctaaactatggcggctactgaataaatatgattagggacatcctagggttacccggcaccacccccttggtcttagcgcacgatacaatacaaggcccaaagctcaaatcagaatcagactatgtgaggtatgtgacttgttttgcagattcctaactgctaaggaggaattttgatgtgagaccaaaaccatatgaaagttgcctccataaactttccaacaagtactcatgtgacctaagattccttctagactagagtctagcttcatttgaagcttatgctataaggagacctgaatccgaatccgaaacgtgtacaatttcatcttttgccttttacagaccaaaagtggtgtggtaatgttggagtagactttgggaaggtcttgggttggtccccaataaacttccttgataatccatatatattctttgcgctcggtctctttccttttactcaagcaagtacctcttcaaacgagaacagacactagtactgaaagggtttttacagacggcccgaaaggggttttcgcgtatggtagggctagctgcacacaccaaatgatatgcgaaaatcgctatttttgtgtgcgggtgggcgcacccgcacgcgaaaatcagaggttcgcgtgcaggtgcttattttgtcctcacgcaaaaataaaaaaaaagaaccaaaaatcacgaaaccctaaccctagaagccgccgccaccatccttgttgtcaccatcgttgcttgaagccactgccgctgtcctcgtcatctccgccgtccttgtcctcatcctccacctcctcgtcgggcataggggtggtgggatccgcgtgggagaggaaatggacatcgggtccatccctcacgtcaccgttgccacgcagtagaggccggatcctccgccgccacgcctcccacccaccaccgtcggatctgcctccgctagcaccgccgccgccggatccgcccctctcgagaacagccagctgcggatccatgaggaaggcaacgaggcctctccgctatcaccattgctgacctcgtccaccgccgccaagcctcccacccaccaccactggatccgcctcccctagcaccaccgctgtaggattcgcccctcttgaggccagccaaccgcagatccacgagggaggcagagagacccctctaccgttgttgtcgctgacctcctccgccatcaccgtcacgcatccggcagccaccaccgccgagagagagagagaggactgagagagagagagtcacagtggaggaactagaactcgatccttaggcgtcgaaagtgttggagctcgagcttaggaagggatgtcctcttgttcttccccaccagcaagcaaaaagtgcatggtgaactcttctccactttctcatttttgctatcggcaaggaaccaacgcataacatagtcagtagtacaaaacgtcacattcgtgacgctctcatagatatcgattcactttaaaccaacacctacgagggatttttcatgcaaacaaggctttttaaaaaccgacattcatatatgatacatcagtgccacctatggattgagccgaaccgacagcaccgaagaaaataactctagctagccaggttggtttttaagtgcctgcttaaatgccccccacccccctgtgcacgcacgcgtgcaaattcgcttcccttcttgatccatccgccctcatcctattctcttctccatccacaaggcaaccatatttgtgtggggactttggggggaggggggattgatggcggtcaacacatcggcgggaagattcttgactccatattatcccatggggagcaacagcggtgatggtgtagtattcttccttccagatatgtgttcttgtctactgacttgtgcatgcttgattcaatttttttcttcgatgttcatggaaacctttcaatcttagggtctccatgttgttgttggatggatggtggcatatggtgttgatgaatgtgatgttaatcaatgtgttcttggatatgggtcgctacaatttctttggttccatggaacctcataggtatgggttcctaaattggcacctatatgatttctcctcattggttttgccgaaactagcacatatgtgggttcccaaccgacacctatagggtgttgcaccaatgagtgtggataggaacaacttaagctcgttttgccttgctcatggccacaaccgcaaactcagatttgtatggttgaagaacgagtggatagaaaagagaaacgtgctcaaggtgaaacattgcactactacagtgcaattgcatggacaaccgcacgcaaaaactgattttcacgggtggttagttatggcgctgcctaaaaaaaggtaaaacaataaaaattctaaaatcatgaatccttagttccgaaccatagctccggcggcggctgatctgccgctcccccgatgccgtcgtccctgtagctcccgaggcgagcccgaagcccagagcccactatacatgaagctgccatcgccagtagccaaccaccttcgcccctcgaagggccggcgtcaaaatctgcgcactacggaggcactgcctccgaatcggcccctcccagcagtatggatgcacctgccgcggggccgctggcgccagctcaagtttgctctgctgctctcgtcgccacccctcctttagttgcaggcactcccgtcgcaactgtcgtcactgctcccatcgtcggttggtggaggacacggtgaggaagagaggagaggatgagggaggagatgtctcgagaggagaggggaagtaaaggaggacatagaattttttaagggaggagagaaaataagagggagaagactaggtggccgtcctgttgctaagcgtgcctcttaacaagtttgcatatatgtatttatttgttagctcaaaatcttttaacatacgggtgtttttagcctgtttggagaaaaaattaaagggattgtctacaaaaccatttttagtgtactgtttagcaaacaaatctcgctcaaattgaggagggtagtttaacataccctattccaaattatacaatggtgtaaaaagagatgttccactatgcaatttactcttttttataagtcaaatgatttaattatcgaacacatgtctacaagataacaatgtcatagtttaagctagagaggaaatattaattagttgtttccatatatgacgtgacatgtatatgcatatatatgacttccaggtgcaccgttaccgtttgtttatgacactgaagttaaaccttagatcggaaattcggaaaggaaaacatttgacctgtacgcataaaattctcaagggtccggtgtagttatatttatagcgccgtattttttacttaaaaaataggcaacacgtatttatattgtaagtctctaaattacatatgtaaatttagtgtatttataatataagtttcaaaattacatatgtaagtctcaaaattatatagtttttacatgtgtaaatggtgtgtaagtgggatgtaagtggggtgtaaatttgtattaaggaatagcatgcatgcatgcatataacacgaaattaattaggagccgtttcactcggatttgcatgactttagaggttagctagcatgctttcaggtctcttggcaaggaaaaagtatggaagcacggatcttaaacacagatccaacggccagagaactaattgtaatcaactaaaaaatttgtcgacacaattatagcaaatacgaattctcaatggctacgcgttgaaatggaaggcgacgatcaatttgtttcgctggtcggtcaatttgttcgtcttacaaccttaaaacatgcgtgtacgactcgatctatatatgtgtcacgtttattttcctccaaattaacaatacaatgtacacacaacaacctctttcggaaactatatatatatgtaggtacaagttcattctcgtgccaagaagggagatcgagagtacttgaaagacagtatgacgaagcccacgacgatggccatttttcttgtcttagcgctatccatagcacagcttcttccgtccctcgtcgctggcaccggccggccaagggtcatcattgttggcgctggcatatccggtacgtacaatctatctattatattattatagcactagaaaaaagagccttcacgttcgctctgatggcctaaaaatttttacattaatcggagaaaaagaaaaggcagagtccatatagaaatacatttagaaatagctgaaattcggaattaaaaaataaggaatattagaagaggagactagagtccatatagaaatacaatttagaaatagttgaaattcggaattaaaaaataaggaatattagaagaggagactagactccatatagaaatacaattaggaaataactgaaagtcggaattaaaaataaggaatattagaaatagagtatagagtacttatagaaatacaattagaaaatagctaaaattcgaaattaaaaataaggattattagaagaggagactagagtccatatagaaatacaattaggaaatagctgaaattcggaattaaaaaataaggaatattaaaagaggagactatagtccatatagaaatacaattaggaaataactgaaattcgaaattaaaaaataaggaatattagaagtagagtatagagtccatatagaaatacaattaggaaataatagaaattcggaattaaaaatggggaatattagaagtagagtatagagtccatatagaaatacaattaaaaaaaatagaaattcggaattaaaaaaaaggaatattagaagtagaatatagagtccataggaatttaaaactaactaaaattcagaataaaaaggagcctccatgttcgctctcatgatctagaaattgtcacattaattggagaaaaagaaaaaagcagagtctatatagaaatacaatttagaaatagctgaaattcggaattaaaaaataaggaacattagaagaggagactagactccatatataaatacaatttagaaatagttgaaattcggaattaaaaaataattaatattagaagaggagactagagtccatatagaaatataattaggaaataacagaaatttagaattaaaaataaggaatattagaagtagagtatagagttcatatataaatacaattagtaaataatagaaattcggaattaaaaataaggaatattagaagtagagtatagagtccatatagaaatacaattaagaaaaaaaagaaaattggaattaaaaaataaggaatattagaagtagattatagagtccatataggaatttgaaactaactaaaattcggaataaacatgataaaattaaaagtagagtttagagtccgtataaaaatacaatttacaaataactaaaattcgaaattaagaaaaacatgggaagaagattttaaagtcaatataggaatacaatttagaagtaactgaaatttgaaattaaaaattaaagaatattgaaagatgagtttagagtccacatagaaatacaattagaaataataaaaattcagaattaaaaaaataaatattaaaagacgagtctagagtccatataggaatatatataatttataaataactaaaatttgatatcaaaaataattaataactaacatgtatataaaatacaatatgaatattacacattagtagtttcgtaaagttattgtaaaatttaaaattatgttgtcattgtaatatattttaataatataatgagaaaacatatatgctattatatgagagaaaatataatgatgctagccgcgcaatctgcgcgggccaccatgctagttacttttacagtggtatctaccatcactcgtagtattccctactccctccatccaaaaataaaccaacctcgtagtagggtataacgcatcctatatgttcagatttattgtatcctatatattaagatttgttgtattaggatatgtcgcattctaggttgtcttattttacgacagagagagtataacagttgccggatgaaaatccctcgtaggtgtcggattcccaaccagcattaatttggaggcgcctttgcccgttcgcataggtgccagttataaaatcaacacttatagagattataggtgtcaattctatagacagacccgacacctataatctttggaaaaaagggttgtggaggcgcaagggatcaccgacctggtagcaaagggcgacaaagctccttgtagaagtgcttgaagtgtcctagcaactcgtcgacagcggggaaagataggcggtgggccccgggcgtgcagtccctgtggaacttcaataggtgctcatccaccagggttccgagcgttgaacgaggagtccccctgtgcatgagcacgcatgtgcacacacaatgacacgaccacaccttagacaccaccggaccaaatcgttggagggaggaaggggaggggggagtggacattatacttgtcagctttttaattaattaacgcctatgatatattatatgtgtcattcgttttttcaaaatcggtacttatagaattaatgccagcttttcctatagctgcttaaaggtgcataggtgttggttttaaacgaaccaacacttatgagctgatatctattagggattctacagtagtaactccaatattattactatgttagccacaatgctatgtttttaattatgatgtatgttacatgttagtttatacggacccatagtacaaattatggttcacacattagagataaattggtccggtggtagataccatatataggagtagtacatatcatgagttaaaatctcggtctccacaagctgagaaccgcatgtacattgatttacatctatattgctgtgcaggtatctcagcggggaagcggatatgggaggctgggatagcagacgtattgatcttagaggcgacagaccgcattggcgggcggatgcacaagcagagtttcgccggcgtcaatgtggagatcggtgccaactgggtggagggcgtcaatggcgaaaagaagaaccccatttggcccatcgtcaactccaccctcaagctcagaagcttccgctccgactttgacagccttgcccagaacgtctacaaggagtacgtacattttcacacaaccacaagttggtggataaattggagcagctaacaacttgacacgtgattaatcagacatatttctctaatgacatgttttaattgcatatgttgatgtgtgcgaatcatagtacaataattaacacactcatcatcagttgtcaattccaaaccgtcaccactgttggttaattattgcatgcacagcacagcactcagaactgtatcatttagtattcatgcaccattcacttatcaacaagagtaactaataattggatactttgtgcggcccacgaaatggaataattatacttaatttgaaaaagttgatgaaatttcaacaagagatcaaaaatttcaaaatgcaaagcttttttttagattaaaacattcatataaatattggagaaatttcacacaattttcaggtaattaaaacattcatacacaatgttcaagcacaaaacattcaaatatagatcaagagatatatataagtgacttttctcccaacttttggttttaccttgaaactatctaccgtgtaaacatggaatagtacttggaagaaaactaggtattgttggtcaaactttttctctttcccggccactagctatcagttccccatttcttgagtttttttatttcttttgtgcgaggagttccttagtagtaaactatagatagtatgggttctcattggaagatagataggtaaacatgagagggtaaacttataaatactacctttgtcttagaacccgttctaagcagatacatcaaacggctaattagccgcacatgagaaatgtgattagcatataattaattgtattaattattaaaaactttttgatttttaatagcttgtatataaaagaaattttgtaggtaagacatcgtttagcaatttaaaaacatactaacggaaaatgagaaatagctaagttgaattagcacttcagaataaggtcttaaaattagtagctagaaataaaaaaaaattaggacgaagggagtagataaatactaaaccttctaaaccacttaagggcaatcccaacactcaaagggaaaaatatgaagaaactattatttcttatacaagacactagctttaaaggaacaaaaataaggataaaaagaaagagaagggagatgatttgatgagagtttattttaaataaatcgtctatattgggtatatagtttctgcgtacattgtcgatataacatggtatatatgaaaactagtaatagtttttgggttaagattgttctaatgatcaaccttctatttatttcacgctgaatgccacctcacagttgtacgttcgtaggcaagtggccaacaagataacagtgcccggccccatcatgcttatgggaaaccaatcgcaatagcatacaagttgtatcaaattggccataggtaatgtttacatgtgcacatggctttatgagaaaagatggacaatttgcaccatgcataagtgatcgaaaggttagaaatagttatggtaacgttacttctcatcagaagagaaaattggcattaaaaatatttagtggggattcaattttatggatgacgttctctttcgtggtccaatcttctggtgaggggataactctcggtttgatcgagtgcgacatttgcgatatggctaccaaccagaacaaggacatgacgttgtgcaatcgctacaccacaaacaatgtcataccaaccgtgacacacggttgatgatctttacaatgcaaacgagagaacattgcaagaacaagatataagatgcaatctaaatattgcgaataggtaattaagcacaaattaatagttgtgattaaagtgatatatctaatcgatccgataaatcaacacaccaactattaggggctctgaatctattgtcgccgactaattaatcgagcgaggactatagacaaggtgaatggcacttggcaaaatccaactaaaccaaaacacaattgttctagagggtatacatatacatttatagaggaaaatggatctagagttaagtgctaattcatggaggtggagggagacacttttgagatgggactagccatgtcttgttttaaagattcttgttgactcggaatgaatttggatgagaccggatgcgtttgaaagatagcgagataatctttccatcaagtccaggatcacctaaatcggagttggcatggagacgctacgtccgtttgaagtaagtactatctccggaggctgaactgaacttggacttgaaattatcattagaacgtgtgaagttacgtgcgtatccgatgaagtaatgccctcatcgtttattggaacaaatacataatgtcaacataacaaacataatataaattgaaattttgatctttcggaaaaaacaaacgtataaattctcgacaaattaacgcatatggatactgcaagtttctacctgggtccaggaacttatatttgttcaaaccgataaatgtttgtgacatgagtagattctacaccgaacttaattatttttttaaaaaaaataatggaaacttaattaattagtatcatgtatatttttttcctccaatatatatatgctaccatacatatatgcatgttgcctgatgttgtataacttcagcggaggcctctgtgacgaagcatacgtgcagaagagaatggatcgggcagatgaagtggacaagagtggggagaatctctccgccacactgcacccaagcggccgggacgacatgtcaatcctttcaatgcaacggctcaacgatcagtacgtgcctctgcccctcaagtctttacttgaaaaaaaaaacgttaagcacataaaagaacacttcaaaagttatttgattttttttgcgacaaaaagttattcgaattgatttgtcttactgtaagagtatagatagatatagaaaatcgtttgaaatttgtgtaaggactgaactaatcgtatattgggcctcgaaagatgtaggactatcaactaggcccaaaaagacactaaggcctccttcaagatttatagttggaattttgatagatcaatgaacaagttgattttgtgatagctatttgagggtatatacacaaattaattaattaactactacttacaaatttaaaaagttggttcagcaaaacagtatatagaaaactttacacaaaatatccatttagaagcttagaaaacgcgcaaatgaaaaatccaaaatccagtacaagctagctggcctgaataactggcctgacaagcagtacaacatagcactacaagctgtgaatttactttctgctgtttcgggtgcgtgcaaatgcatgcaattggcagcctacccaacggcccgtcgtcgccggtggacatggcggtggactacttcacctacgactacgagttcgccgagccgccgcgcgtgaccagcctgcagaacaccgttcccctccccaccttcaccgacttcggagacgacacctacttcgtcgccgaccaacgtggctacgagtccgtcgtccaccacctcgccggccagtacctcaacgccgacaagtccggcaacatcgccgacgcccgcctgaagctcaacaaggttgatcatatcacttctgatgccatgatcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggtgcatgttccctgacgaggatgtccccgacgccaccgacatcctcgtcccgagatggtggtccgacaggttcttccggggcagcttctccaactggcccatcggcgtcagtcgctacgagtatgaccagctcagggtacgaactactactccaaccaaatgctaatcacaattcacaaattgatgcggtttggatttgagattaattttggttgtgtgtattttttgctgtttctgtgcacaaggcgccggttgggagagtgtacttcaccggtgagcacacgagcgagcgctacaatggctatgtccatggagcttatcttgcaggtatccatatgtcagataggccggacatttaaaccatttttattgttctaaaagagaactaccctagggtagggatcgacgagatttgtaatgctaacatttgtgctcaagtgtgcgttgtgcctttgcttgtttttgtcaggtattgactctgcagagattctgatcaactgtgcacagaagaagatgtgcaaatataatgtcgggggcaagcacggctagtttgtggaggcaagtcaaactaccttgtcaattggctgtgagaacattccaagctatatcttcagttaattaatcctgcgtgttgatttgtatttctaggcgcaagcattttcatgatgggatgagaaatgtgagattccacaatttgttcatcgaggtgtaaagcaatttgaggaaaaagtgtttacactaattgtttacttatgctatttcttgttgctgaatatatatttcagcagttcagctgatgtatatatgtgctattgtttcgaaatgaataaaatcttgcgtagatttgtaaatctgtaatttctgatgactacaagatactccgttcattcaccaattcacgcttgggattccgatggaccaatggagaaggatgaaacggagagcaatctcttcggattagccatttcattttctacttatatgaatcagaaaaccgatatttttctctaaaaacaagcaatatctatagcttcgattatgactttgctgaatatctaaccagaactcaatgtcaaaaaaaaaaaaacaaaactcaatatagcagtgtatatatataaaacttgtgtggctaacactaaatccgaccttagctcagttggtagagcggaggactgtagtttgatgcagagaaatccttaggtcgctggttcgaatccggcaggtcggacaatttttgtttttcaggcattcaaaatgcaaactctttttcgttcttttagaacttgtttttcgaccaagtttacaggcattcaaaatgcaaactccaagcagctcgtgctcggttggactaatacacaacatttaacgtcagcatataaacattgaaaccatagaattttgccaaaaaaatatatatactgtaataaagaaaagccacatacatgtggaaaataattaatccctccatccctaaatttactttttttaaacatgtttgaccgctcgtcttattaaaaaagtttaagtaattattaattatgttcctatcatttgattcattgttaaatatacttttatatatacatatagttttatatattttataaatgtttataaataagacgaatagtcaaacataattaaaaaaagtcaacggcgtcaaatatttagagatgaagggactaaatatttggagggagtactaagttagatacaagaacaaaccatggggtgctccctgcaggcagggcaccgcttctcttgcagggcttgtttcatctcgcggttctccggtcgccggaggccaatctgctcgagcgtcgtgcggactgcggcggcgctgtctgttggcttcctcgatcgatcggaaagaacgggctcttgggcctgctggcctttcagaatgcctcttttgacgcctgcaacctgttccaggcccacggtccgcagccggcccatgcctcccacaaagccttttatccctttttttctttttttgcctatccatttatcaagtgataaaatcactcagagttttcctacattaagatttacatccaacgaactacgaaaaaaaataaaaatatatatttacttacatattatttttatcaaaattatagtgtacttacatgtcatatcaactgaatttataaatgcaattttagttatatagaattgtaattttatattttaaagaaaataataaatacatatttacttacccaatatttttattaatattataatacacttacatgtcatatcaattgaatttacatttgtagatatatcaaaggatcgagaaaaaaacataaccacgaagtcgccatgaaaaatagaacatcaaattatcaaaccaaactaacttatatggttgcatccgttcatattccttatttgtttatagtgtttgttgtgtgctcgatagaaatactactaggcggtctgtatagcgtgtatggtaggagacgcatcgcagccgttaaattaaattatgcgtgatccaatggaagcaaattcgagtgatttctagggaaaaaaaactgtcgtatgatgtttagcaaaatcgttttgattttaagtaaaattatgcccacggtaaaatgaggcgcattttacgttggcattccaaagtcctggcaccaaatatgtgctcttagttcgatatggtatttgttcttgaatttcacatatttcaaccaataacatgattgggaagagaatccaagcaattcaaagttcaaattttgaccactaaaatgtctaaaagaaaatgttttcctctacccttgttgttttttttacttcaagatctaaaaatagtactagtattttgaaacagatgccggcgtacttggcacatggcagaaagaatcgaataattacaagaaacatgacatattagagtatatggtagtcagagatatattaggataggattgatttgtttggattatcactctccctgtactatccaacatgacagagtaccattaatttctccagcttacagcaaaagccaaagtacatgcaaatgtggttgtggctactgaagatcaaaaacggcagcaacaacacgagctctctcggcctgaccgttcacttcaggggtggcgcccgtacgtacgcagcacgtcgaccctgcctgccactagccgccgcctcctccctttcgccggcagagctttccactgcgttaaattgcagttgccggtcgatcggttgatcgatatatccgactggccaacaagcagccagcttgccgcctcttggcactgcacaagagtcaagaggcaggggcactgtatctgtatgtgtaattccagtgaacctgaactgaaacatgaagagcactgcagctgcgccaagttgaggttcgtgcgtgtgtcctcagcttgcattgacgggtcggcaagctgccgtgtcgtggtcatggcggttcagccatccgggctcctgcgggtagactgacgtacggtggttttctccttttctgtccattcttgcagctcaaatatagggtgtgtttagttcacgctaaaattagaagtttgattgaaattggaacgatgtgacggaaaagatggaagtttatgtgtgtaggaaagttttgatgtgatggaaaagttggaagtttgaagaaaaagttaggaactaaaccaggccatagtgcagataggtaagttgctccatttggtttaatttagtcgtagataggcaagcgagcaaaaagtatagtcacaaagttttcaggtcgatataggatcgaggaacgtgataccctactcacgagagatttttacaaggtgggaacgaaaatgatccgcgttcgcgggacagggacagtgtttccgggtcgagggacggatcctgtgactaggagcaaaaccttcttaccgacaaagataaatcaatggttgtgatttaattcaacattgttatcgatttttgtcgctgcaaatgatcatgataatgatttgttatcaattatgtatggtactgatcatgaggaatgcacaatatctgattatgacgccccctttgaaacaaaatactcgtggagaaattttgtaggactcaaattctataggaatttttcctatttaatcatttgaaatatatgattgaagctttttgaatcctatgaaatttctaaaaaatggctcactaaaagtagattttgaataaaagttagcaagaggctcaacctcttggaaaattctttttaatctatctcactcattcatttcttgcatttttcctgaaacctattcaaatagttatttctgtattttttatgcgttttgcgattctctgttttgtatttacaattctgtcaaagttccatatatatattttctacattcatctgttttctcaatgtatcatttgaaaggactatgcatatgcacacttgaagggattgtttgctgttgacacatcatgagggacgctcaactctgcaatgatatcctggtctgattgatggactgatgctaattatatgtaacactagtatcatatcctacgcagcatatgacatcagtcatttttttttattctgaagcaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21251 - DNA, 27433 bp, Oryza sativa
  unsure (1)..(27433): unsure at all n locations
gaaagtatatttaacaataaatcacatgatatgaaaggaataaatattacttaaatttttgaataaaacgaatggtcaaacacgtactaaaaagtcaacggtgttaaacattttgaaacggagagagtatatatgtatctatgttcattaacatcaatatgaatatggaaaatgctagaatgacttatattgtgaaacgggggaagtatttatatataaaatagcttactaaatattatagataaataagcttatgcatgaggccatgacatgtatggttcctgggttcttgtttattgttgcatatggtacttaaattattgcatttagcttcatattcactctgtttaaatagataatagttgacttttcaacacacgtttaattatgcgtcttattagagtaattcatgtaaatgtaaaagatataaatcatacttaaaatacttttattgataaaacaactcacgacatgataaatgataaatacatattttttaaaacaaaataagatgaatagttgtgtgttcaaaagtcaaatggtatcatctacttaaaaaaacagaggtagtataatttttcacatggtttatacaactttctgttgctggctgtcatctagtttaatctatttatcagccacttagccgtgagagtaggcggacgcagctttaaaatatagatgggacaaagaatgaagatgcttaatcgataagagaaatcgaacacaacatatatcatatttatagttaaattgcataattgcctcgaccattgtttgtggcgtgcatacgtcgtgaagatacagactaatctattggacgtttacaccttgttatacctaatttttatggctaatgactaatataaggggtagggagggtcatgggtgtgaagcgacacgagtcgtaaatgagacagtcaacccaccctgcctaatgggtagatccgcccctaaagagtagtacgagtgaattatttagacatattctatcatcagttaggcccctttcgtttggaccggttgcttcgataacttctgtagcacgttttttaaatcgtttatataagaaattttttaaaaaataaatctattttataaatttaattgtaacaacgccttgggctgtgtttaattagaggcgttaggaacccctcccttcacacgtaaaatagagcgacgaattaacatacgattaattaagtattagcttaaaaagttttaaaatagactaatatgatttttatagaaacttttggaaaaacatatcatttagcaatttgaaaaacgtgtgttcagaaaatgagagagatgaggttggaaacattgagggaggaacacaacccaaatagtttcaacgccacaaaaaagttctaatcctacataagggtttgcattatcctataacttcactttaaacctgctcatggtgttctttaggagttatagaaaccttccaaccccacctttggattgttgcacaactctactttaaactcctctcttaatatattgcctctgagatacgatataggattgggtgacaaagtgaaggagaaaagtgagagatgatgaaccattcgaaattaagagatactccctccgtccaaaaaaacgaatctatgactgaatatgacgcatcctacaaaaacgaatctgtataaaaatatatccagatttattctactaggatatatcacatcaagtggtaggttggtttttatgtgacggaggaagtaacctccacataaactcggaagaacaatgtgtaactggatatgacagattttatggtaggaaacttttattttaacgcgattttaactattagaacacgataatatcatctttagggacaaaatacccctaaatattcgtgattttaaatctagaacacggtaaaaaataaaaatcaatctttagagacaaaatgattttaactatatatagaacacgataaaaatcataaaaatcaatctttagggacaaaatatggttatttgctggttaactttagtgtcctatatttaaaatcatgaaattgcagtgctcacttgctcttataagttgctactcgattaattcttagctgctaccaaacgtacctaatactaactaattattaattaataatgcgctaatcttttctgaagagttaggcaccaaacataccctaatactcgatcaatattgattgattatatccgtaatactcaatttattattgattaattatacgctaatgacccgttctttttttcagccgtcaatagctagagttgtgtgattcaaacgcaagcggccttaatttaatccgcttttaatttaggatatcagtcacaactcacaaatgtaaaaccagtaactaattaaacaccgattcatgaatattattagaagcagaacaagaaacactatgaccaagcattagtacctgatcatgcatctaacagtacagatcaacttgttaaactctatatcattaacctaatcctccgcttaattacctattaataatctctctctctctctcggttcacttttgggaacattaacacaaagcctcagatcaggagttccacacgcgcccaccgtgttgcccagcttcttcggccggccgccgcaccaccgcctcgcggcgccgccgccgccgccgcccatgatgccgccgcctctcaggccggcggcgtcgctcgccccgtcgcgcgtcctcttctccggcgccggcagcttccgccccctgaccgcctggacgaccctgagcagcagcattacgccctccacgttgaggctccaccacccgggcccgccggcgccgccgcccgccctccgcgccgcctcccgccgcggcgacgtacggctcgtctcgatggcctccagaaggtcggacacgaccgacttgctcggcagcgccgccgccgagccaccggcgccggcgctggtcccggcggcattattggcggcagcgccgccggcggcggcggcgagggtgatcatcaggtggcgcgcgggctggagcgcgccggcgaggagggagcggctgagcagcttgacgaccgccgacgtgcgtacggcgcgctccagctggctcgcgagtccgacaacggcgccggcgccggcgcgttcggccgccgcgtcggcggtggcctggccggcgccggcgggcggcgaggtgggcttcttcagacgctgtatcctgccgtgggcgcgcacccacgggttggagtgttggttcatatcgccgccggcttcgtcttcacctgaacgaaacatcgagaacaaaacgaagaaattaatcaggactcgacacgtctcactgcaacagtgttaaaactaatcagcaagttttaatagcatgggggcaattgcatctgtgcactcactttcgaagccaattgttgttttacccccactttttagggcttgcagttttacccccacattttaaatctaaatcagccatgtacccctatttctaacggccgattttaacggtgctagttgttaaaaaaaaggacatttatatcctggatggttattgtatttttgccctatttttttcagttttgcgtgattttgctcctaatttgtgatttcagcttgtgtgatgagcattttgaccaaatataagcatctcttgtgatgttttttactttaacaaaaaagaatcacaaatataggcaattacaaaatttaaacaaaaatcccaaatactagccttcatggtcaatgctctagaccttgtgaggtgctgagagatgatagccttcatggtcaatgctctagaccttgtgaggtgctgagagatgatagccttcatggtcaatgctctagaccttgtgaggtgctgagagatgagagtcatgttaggcatcttggagtaagggtgtgtttggttgcaagctacactttgccacagtttgcaacgcctaaggttagacagatttgacaggtgtttggttgtagccacagttgtggcaagattcccctccaacaaattgggtcccacgtgtcaatggctcaaaaaagtgtggcaagattcccttagacttagtaagttgtggctaacaatttgatcacctcaccttaggtaaggtgtgacaacttttgttggcaagtaatggtaaagtgtggctgggaaccaaacagcccctaagtatcaaacagattcgtagcacccgagcttggcagcgcaaggcttgccggatccagcggacgaagagccgctcccttccaggcactaacctcaggaaatacatgtagaaatggcagtgattcagaggcgcgttgtagctgcggagcgtgaaaacgcgatccacgaagctgatgaacctgtccaactcctgataaccccaccaatcgatggagaggcccggtgcttcctcccagtggtggagccaacgacgggcgagcacgcacgtcgccaccgcctcgtgcgccgggagcagcaacagcacgaggcggagcacctcgtccggcagggcgctgatgcggtctggcggcacctcgtgcgtgtgggtggaagcgcggcgccgccgccgcctccgcctccgcctccgcgcacacacgcggccgccgccgccgccgcgcaaggaccaatccggtgggagaggagagctggttggatgtttatcgattccctcgaggatagaacggtaaattgatatttcataaatcattttttttatttctatttgtttttctaaaaaaatgtgggaccaacctaacggtgttaaaactgaggacgttttaaaaaaatgggggtaaaattgcaaaccctaaaaagtgagggtaaaacagtagttggaattaaaagtaggggcatggatgcaattgtccctaatagtatagccaaatgttagatctaaatcatctatcgctattctaacagtcaattaatacaataattaagtataaaaatatactacaccattaatacctggtctcaggtattatacccatatactccctctccctccgtattttaatgtatgacgccgttaactttttaaccaatatttaaccattcgtcttatttaatttttttatgcaaataaaaaatacttatgtcatgcttaaaagaacatgattcaatttttttatgcaaataaaaaaaatacttatgtcatgcttattatgtcatgcttaaagaacatttgatgataaatcaaatcacaataaaataaatgataattacataaatttttttagtaagacaaaagattaaaaatttttagtaagacaaaagatcaaacgtttgttaaaaagtcaacggcgtcatacattaaaatacggagggagtaatatgttggacataacaaatagcttgctttcttctctcttctcttttcatcgcatatcatagtctatgttacagctagatacaaatagcttgctttcttctctcttctcttttcatcgcgtatcatattcggcttatagcttgctatgtacctgctctaactaatgtttttgatctagtacatgttgttgtgtacagtaatcaacctagtatatatgcacgcatgcatgaagataatttgatacgcatcgcacaatatgtaattaactagtaggattaattggtaatcacacgcgttctaatttgcatgttaattggaataccttgctgcgtggtggagagatcgtggtaggagcagaaccgggagaagatctcggcgagggtggcgcacttcctctcggcgccaccgccgccgacgacggcgtagaagaatccgggcatctcgaagacgaagacgcgggcgtcgaggcgcgcgacgagggcgtcccgggacagcatccagtggtggttgccgacggcgcaggaggccatggagaccgggtggccctcgacgcgggccatgcgcaccgacaggccgccggagcggaacagccgcgccgcctcgaagcggtcgccgcacagcacgaagaggctgaccggcggcgagccctcagcggcgagcagctgcgtctccctccccatccggtactcctgcgtccgcccgactcgcagcggcggccgccctcctcctcgtcctcctccctcccgagtcgccatctccgatcgatcaacacttaatgctgcttgatcacacaaattaagctactagattcaatttcactctgtactgcaaaagaagaagaggaagaagaagaagctgcaggcacgcaaagagcatgtccatacggcaaatatactggtcctttttattagacagtgatagatcgttggctcgtggctagatagatattttttgcccggatatttttccatgcagctaatattattcgctaggttaaacaacggcacgtgttaaggttaatgaccatgtatgtatgcaccactcactctatgctagctaccagttaaactatggtacgtagtgcttaccacaacgagagccggatcggagagaaaagagaagggaattacgttagctagagagggatcatgttggagtatatgcgaggttgtacgagctgggagaagacatgggggtggccactcttaaataagagggaggtagtggtagtagtagatagccatggtcgccgaccgaggaagaagaagcagtggggggtcgcgaaacggaggccgcgcccgcgcgggagaagagagcgtattgcattgcattgcatgcatgcagggcacgcgccacgcacgcgggacacctgcgcgccacatcgagcggggggtaggggcccaggcgtggggcccgcaggcgctacacgcggcccccaccgcagcgcgacgtggcccgacgacggccacgcgtcccgcagcgctggaccccttgcatgccgccgcctcgcctgcgccgcgaatccgcgaccgcttcgcgcgcgcgcgcgcgccgagccgagccgttcgagttcgcgcgctgcgcgccggtcgaatcaaataccggcggcattggcctgcctaatcaggggcttagagcaagcataatagacgtctctgtaagaaagtagacgagagaggagagaaaagtgaggagaaacggtctatgaatttgtgacagctggtttagaaaaaaaaccaaaaaataaatctatgaagggcagatggaccatatatttattacagtgaaaagctaacaactatatgagtgggttgaaagatagactataaaaatctatataatcagtagctggttgtattattagctatgctcatagggcctgtctagggatcttcgtagtatcttttagaattaaaaactccctacacagtttagcttttagtttagattctaagaatttatagttataaaatctaaaaaataaagtagaagtcataagctagaaaacctagcttttttaagattatcagtatcaattagttgtttcttaaaattttaaactcttctaaacaggctgttagctacacttggtaagcctacctaccgaagacaattatatatatatataatcttacttaattatttttcatgagcgagctgtacatgtagggcagtgtcttatttgtatattctatatacctgagtatgattaatcaacttatcacatcatacttatatttagagcatgtttggttgagaaataatgttccacgtattattttttattaaggtggctaagttttttcttgttataattttgcgataaacaaaatgataagttaaacttagataaatttgataataaaatagagtgtatgacatgtggaccatgtaaaaagttaagatgtgacaaatttagttgccaatcaaacatgcagccattagactcactcttttcatctacgtggtctcgccgaggtggtaatgtggtggttaaattgatgacatgtatctattaattacttactactaccttcattttttaatagatgacgctgttgactttttctcacatatttgaccattcgtcttatatttattttgttatgagttattttatcactcatagtattttaagagtgatttatatcttatacatttgcataaaatttttgaataagacgaatggtcaaacatttgagaaaaagtcaacggcgtcatctattaaaaacggagggagtataagattgctcaaaaaggacccacaaatattcgctatgtaggctaacacatttccacatatgttattaaagggagagagaaaagatatatattgatgcgcgttgatcgatttaattaaatacgaaacgctattgttaggacctgttcattttagaggaatttcaatgcacgggaatagaaaaggtgggcaaagggtgaatagccaaagtggtccttcaagttttatctaaagcttaagtttagttcttaatgtttcaatttatccatattagtcctttaagttctaattttagttcaaacttatccttgaacccatttagaagccacatggctaaatataacaacaactttcttgataaatgatacttataccccccctcattcatatatataagaaaaacaattgcattcaatgattgttttatagataatgcacagtaatttatgtaaaatgaaaataaattatgtacttacaagtgtatacgatagccattgcttaagtttaatgtgcacatattgaaataatgagaaatatatctgcaatgttgtttattcatcttggttttatcttttctaatgtatagtttgtatacaaactaaagggcaaaagagacattctctaacagaaatattgaatagaaatagccacatggcatattaagtgggtccaaagatgattttaaacaaaaacaaatatttagacgacatatgtggacaaaatgaaatctaaagtatcaaattgagcatttgatgaaacttgagggactaaattagctattcacccgtggggaaaataggaatacatgcacactccaatatataggaatttttcaagagatttgagtggattgaaaattttctatgtttttttctatacaacgtgtggaaaagaaaaaaatcttttatttttactatatctacatttatattaaccgaatagtatccatagaaattaatcctgagaaatctaaatactttaaaatttctataaaacaaaaaagcccttaaattgtcgaactatatattcacgaaaaaaaaaagacaatataactagcatcaggatgttaaactcacaggacacagcaattatgataattcgaatgaatttgggttcgttcaggtgtgtcaaaggtctgaagaaacggctggaaccaagtcaggaaacaacgtatatttgtttccacccagaataatgcaagatctcccaaggccactttgccattcgtctgcccaagccccaacggtggggaacataactggaaagagtgcaccccctccgttgtttgtactgttatctctcctcttattaaaaagtttgtgcaaatataaaaaatgaaaagttatgtttaaagtagtttggataataaagcaggtcacaaataaaataataataattctaaaaaattttattaagacgaatggtcaaacagagcatgtaaaaagttaaaatatcttatattatgagaccaaatgagtagctgtgtagtacattagttctggccggtcggcggtggcgacatgaaccgaattggttttggaagtactccgtatttgacgttactgtaaaattatattagctgtataagtaatttctggtttgtagatatgatgaaactggccactcatgttttagtttgtgttaattcaatctcagtctccactgattattttatttggtgaagacgagattaattgttgtacatgttttttagactaattaattaataatttgttaatgtttttcaaaataaatcggctagccgtcaatttaaatgaatagagtaggaaaaaactgtatgcaaataaaaactgtaagaacatgtacaagttaggtcccgagatgtgggctagtgattaagataacaagtacatctgtttcacaatgtaagttattatagcatttttcacattcatattgatgttaatcaatctagatagatatatatgtctagattcaatatgaatttaagaaaagttagaatgacttatattataaaatagagggagtagtagcgagttccctagccattgcaaggacccgtgttttgccctcttcttttatcttggttagggatgttgagatctcttaataatgttaaaattgaaatttcttttgtatttttttcccatatctcttagaggactagcaaagctaatatacggactacttgctttgaggctgcacaattttttcatgtaagaccgacttgagttcttaatttttattcagactttcaacttttccatcacatcaaaacttttctatatacataaacttttaatttttttcttcaaactttcaattttagtcaaactttcaattttaacgtggaactaagcacaacctaaaactacgagcttctatcatgatcattcaaatttcatcgatcccatggtgaagcagtcaaagcagatcgttgctcggcgagcaagatgtactccccatacaaagaaaagtcttctcttacgcacgtagtagtacgtgtctatgtctcgcctgtatccagcccagcccagtacgtgcggagagaggagtcgattgttcttggaatctcggtgcgcgcgtagtttggctccttccaacaccgtatattcccccatgtctctcagaaccccccaatacagtagcacatctcgaccagaacatccctatgcgtttcgctgactggtggggtcccagaaggccaactcgaccaaaatattgggacaaaaagctacacacttctctcaggtagcggtagcagccgtactttaattgcaacttgcatgaccttgggcccatgccctgcgtctgcatgcacgagtagtggaaagcgagagcccactacactactacgcggtgatgtcacgtacgcatgcgccgcgcccatcggcgcaccggaaggccaggggccatcagccatgccatcttttgcgtggatcgatccaccccgcgaagccgccccgccctcccgcggtggtcggaggcggcgtacgtacgttacgcgagtagaggagatgcgtgggaggagcgggagcgcgacacgcgggcctcggcgcagcgacgcgtgcccgccgcgcgcggcagcgcgacacacgtacgtgtagtagagctgggacgccgcgcgcacgactcgactcgggtgggctctcgatgggcggctttccgtttcgctgctcggtggaacatggaacgggcttggtccagcgtatggtagtgcagctgtattgggtgggtcaaaccaccaggggcaagttgttgtttccctgcgcgcgctagctttacggacgcgtggctcgttgggtgtctgcaactcacggagtagtggcgtgctgcctgagggtgcggtgtgccgcgtgcttcggtgcgtgcgatgcgactgtgattctgctctaggacagcttactccttcgtccaaaaaaaaatctaacctatttaaaataaatataatttagtattataaatcaaaacagtattaaaatatgtcacatctctaaaaaaacaagtaatataatacttaatgtgttattcataaaagatactaaatgagattggatgatgaagtggaggagagaaatgagaaaaggagaagatatatcacttttcatagagtgacaactttcacacaaactttaaataaaataaaataaaaagtgaattggacaaacaaataaaattacatcatagggttagtatgctagagatagtgtaaatatctattttatcttacatacatggataaaattatacgtggcaaactatccattctataaaacctgctctagttggtgttaggttcttttctacggacaaattactctatccatccaaaaacaaaccaccacgttttgtagtacgaatttaaacagttatattatttttgctttatatggaatgaaactagtactcactctctcccataaaaaaatgaatctaggattaatatgacatattctagtacaatgaatctaaatatatttgtatatttagatttataatattaaaatgtgttacatatgttggtcttttagtgacggaggaagtaggtgcgtaggaaggccatggccgcacggccgccgccgggtcagtggctggaccagtggaagcgtacgggaaatactagtctccagaaaacggctctcacaacttctttattggctggcactctaccagcagtactatacacaaaaacggtgtctcactagttctttactagtacactagtacacacgtttcgagctgaaaaagtctccagagcacacttctctcagaacttctttggcagcactccacagtctccgctacagcacgctgtccagcttactagtcctttacactcagctcgtttcgagctgaaacttgttgtttcgaggcaatgttctttttttagagctagggatgtaaacagagcgggtaattgggtttttttctcgcttatctcacttttattttatttatttttctaaattttatactaccatgtggaaagtgaactagtaagtgggtttttatgcgggtagcggaactacccacttgcatccctacttaggacaacagcagtacaacacaacaatataccgaatattacttcacacctagaccaagaatatttttagccacatactccacaaagcatgtcactatatggtgggtcccatgtctctctcctctcacttttcatctcttctttttctctctcctctctttttttcacatcagcggaggaaatggagcatcggcgccatgatggtcgctgccccggccgcagccgacgacccacggaaggcctctccctcgagctcctctccctctcaaccacctacttcctcttcccccctccttgctcgtcccctcccctccttccactatagcagggcgtccaagcgaagagacagtggccaacgagcggagaggcggctgaagcagcggtggcgtggattggaggacgacaacgggcaacaacaaggtaggcacgaatcggaggacgacgacgggcaacaataagttagctgtcagcacatgattaattaagttttaattattacaaacttgacaaatatatatatttgatagagtaaaatgtgttggcggtctttaatctggtagggttgtgtcatatagatccctaaactcttaaaatgcatattcatgtctcagaacttgtcaaagtatatcatttaggtcccaaatcgacacgtcccgtctagaatcctacatggcgctgatgtggcatgccacatggacgtgacatgtccttttctttttttttcttcttttattttcctttttcttttccgttttcttctcattcttccttttctcctttcttctgctcgggtcacagagaaaggagaatacaggggaaaaagacaagaaaaaagaaaaaggaaaaattttaaatgggtcctatttgtcagccaaaataataccacgtcatatccgtgtggcatgccacatcaatgccacgtaggatcctgaagggttttggtgatttgggatctagatgacacactatgacaagttttgggacttggatatgcattttgagagtttagggaactagatgagatacccctacaagtttaaggaccgcccgtacactttactctattggatattttcggctgctggacatgcatcgcacatctattatattattaaaggaatagaaaaaggagtctccacgttcgctctcatggcctagaaattctcacattaatcggagaaaaagaaaaagcagagtccatatataaatacaatttagaaatagctaaaattcggaattaaaaaataaggaatattagaagaggagactagaatccatatagaaatacaatttagaaatagttgaaattcggaattaaaaaataaggaatattagaagaggagactagagtccatatagaaatacaattaggaaataactgaaattcggaattaaacataaggaatattagaagtagagtatagagtccatatagaaatacaattgagaaacaatagaaattcggaattaaaaataaggaatattagaagtagagtatagagtccatataagaatttaaaattaactaaaattcaaaataaacataataaaattaaaattagagtttagagttcgtataaaaatacaattttcaaataactaaatttcgaaatttaaaaaacatggaaagaagagtctaaagtcaatataagaatacaatttagaattaacttaaattcaaaatttaaaatttaaagaatatcgaaagatgagtttagagtccacatagaaatacaattagaaataataaaaattcagaattaaaaataaataatattagaagaagagcctagagtccatatagtaatataatgtacaaataaataaattttgatattaaaaataattaataactaacacgtatataaaatacaatatgaatattatatattagtagtttcgtaaaggtaatacaaaatgtaaaattatgttgtcattttaatatatttgaaaaatacattgagaaaatatatgttattatatgatagaaaatataatgatgctagctgcgcaatctgcgcggaccaccatgctagtttataataaatcacttcacaaacttgcaagttataatttaacttttataggttgaaaaaaacaaattaaactatggctagttaacatatatttgtgatcaaatttatttttcccttgcaacgtacaggttaaatttgacattacatgtttgtggagtaatttatcacatatttaatctatgttgttgaatttttttcgtaaccatttagatgagatgtgaacaacgagggatgtcccctcgagagtttaaaatagttttccagctccttacggctttggttttttggcaacatgcacacactcgttcttatggacacaaactattcctgtgagtattttcgaaggactaaccaagatatatcttaaaattgttgaagtcgtcataagcgtctcgctgtcgaccgatatattgacgggtacgttgtctaccactgaaaaaataattagtcgtaaatacgattactcgtgtcaaatttaaaacttgaatcaagtaaactgattctttcacaacaaacttgaccatatttgaagctacgttcgcttggcagctttagcttcgttgagcaaaggagaactcacgttgggccacacccagcccacaaaattaccaagtcctgaagcctctttacgctaggatttagcccaatccactattacacaccgactttgctgagctaggtcttcggtttcttgaggacgacgacgccccaaagcgcatgaacttgcataattcgaggctacttgcggacttcatttaattttggcctggatcaaccatgtacgctcatccccgttccaaatactacatcatctcttattgttttttctgtttgtttaggatgtgagcatatcattgacatgaaatctgtaattcacatccacgaattggtattgctgggactgggaaactgttatgtttgatcttggttttcttcttactcttagcttcagaattgtatcttctgaaaccagtgcagttgacaagaacatcaaaagataactggttccctactgccctgactgtggcctgatatttgctacataaatctgccatccagttaattaatcatgctggattgctggtctggttcctttctttcaagatttctcgccccaaaatctttgttgacgttcgaggtcagttgagatgaaattgcatgcactcagcttctttatttggatgtgtagttagttcagagttacatgaacaatattttgttgtgtataataattgtggaggacttttacggtacattctactgctagtatatactaccagtatatacaagggtagttttggtattaggtaaaagtctgaaaagggctttttggtcatttaaattagagaattaatttcacccggattaattttccttagttttttctgtggatgtcgtcatccgcttcttctcgatacatctcgcgtctccggcgtcgctgctcctggcgcacatcgctcccgcgccgacgcctccatcccgattcctccggcgccgggagaagccgaacctccacgtgcccggcgtctcccacgtccccggcgccttgcctccatccctagcctattctcccccacatccgacctcccacagcttgtgccttgcccaaaccacaacggcgagagtgccctcgtcgagccggcagcctccccacgcctcccatctccgtcctggttgccctgcctgccctgcagccactggagtgctcctggatagaagccagcggcggcggacacccatgcgagccgagcggattcggtttagagtcgatgtggtgaaacggatctgactaagtgagttcgcgttaatttacaaaaatacccccatgcaaaaagataaaaaaacaaatataccctatccaaattatactgcagtataattgggagggaaatcagataaatttacaccgtcagatcaaacatactggtagtatatactagcagtagaatgtaccataaaaaaactctaattggtaccactatcagcaatgtgcaattatatttttcagataacttctctctttccaattataaactgaatgctctattgaaacccttatcggagtattcgaaccaacaactgtacgttagtgttccatgtcttaccattcaatgatgaaacaatttgatgttcaacagcttggatacaaataggagtccaattaacagggagtaacatttaacagcaagcagtgtcttaatttcctcaggaaagcgatgcatcacgaatcgtaattagcatgtgttgtagcttagagaggctcctgagagtttcttgtgtcttcttgaagtcttgaaccagccaatcacagttatttgtgctactccgtaattccttccatctccaagaagctggcagcatgtatagcatcttaataaagtattatagtgcacacaatcattagcaactgtcacaacaaaacttctagggtgtcacaaaaaaatgtacttaaacatttttctgaaagagacaatcgtacttaactcttatgatagcatgataaaaaacaggatccgtggagacaaaatggacataaaaatgggaacggtcttttaaatggaccccaatcattgtgccattgttaaatgcaaatatataactaaagaaatcattgttattagatataatataaatttactaatactaatgttacaatttctgataattgaagatgtcatttgtccacaaggttcgtcctggaggagggtgagttaggacttaggaggacccaagatcaggtcgaaaagcatagtcgatggacaacagatcactgcaaattaaccaatcaagccgtaaatatgccctatgaatccaagggttcaaacggagtttcagtgtaatttatttgatatagtacaatcacatacttgaaattatcttcctgtgcaatgaaacataatggcatgcatgaacttgtgctatactgctctgccattgacagcaaactttggtttctgatcaatgaataattaccggggctttgtcgctgtcgttaaaggaaaaaaaacataataacggtttgggtcaacaactcaaggtttatcaatcaggttactgaattctcggtctgtgtcgggtactcctataatgcagtagttggattgaacttaattacagtagtattatcagggtacgtacaaaggtggcgagttaattcattcatataattctaggtcaccaactagctagtgccaacattagtgcacatatatactttatgttgccattatgcagccactgtaccacacggtttaacaattgtgaagtagcaaacaaaaaggttttgcctaactgcctaaccactgacggctcatcagttgcatcagcaaacctcactgccgttgcacgtttgccatagtttatcagttcggctaccaatcaacataaacaacaccactaagatccgtaatggtgatcgctgccagtacaatgctgcaaactttaagcgccaatctatgatgatttcgttgatgatccttgcttttgtgagaaaaggtgtgattagtttaattagtgcatacagccaccataaatattcaacaactgagttgttacgaacaaatgtctgaatattgtcaaatgcactcaccgaaaattaaattttcaataaattaataaccagaatatgtaagtagaattttcagataagaaaattactgcctgccttcccgcctatgtgtcggtaattaaaggttgattggtaaagttgcacagatatcaattaagcataaaaagttaacccaaaagctgggtgtagcttgcttctttagagtcctcatctaacaatgcttagctgcaatccaccatcaggacagtacttaaaggcatatgatagcttatataaaacaaggaatagcaagtttcctattcatcaagttcttcattctactttaaaaaacggagaagaggaaaatgattcagtgtgcacaattggttgtgatgttgtatcattacagagatcgaaggtgcatcaagtaaagcaagatactaggcacgagctgatcgaacgaacatgggtagaaaggggaaacaatcaacacacccaaggattaggtattaaggccccttttgaattcataactaattttctttaataatggataaaaatctggcatcaatatccatacatatccagaggttgtatgaatacttagattttgaatcttataaccgagataacacaacaacaaaataaaaaaagaaaaggactagaagactaatcttcggttttcttctacttaacgagccctgccgtaccaagaaccacaccaagtcgatcttgatatggaatccaaactcctatactcctcatccacgttacatccatatttgattcgctcctttccccaccatatccctatcgacagctggatccaatcgattcaaatttagtaactcccagcatctacttccttcgcttgccaatgtcattcagaggagaaaaagaagaagtccctccagttcacctttgctactacacaaatagataatgtcacgcacggatacctcggatacaatacaacaacatttaggccccagatccaatgtcgcaccccatccatcactagcattgccaaccagcttgccttcatcctgccaatgccgctccttgttgtagttgtcttgcaaaacaagaagtagaaacagatctggccattagggtgaatccggttgccgccggcactactaaggatcccactgttttcacttctcgtgcaggcaccttattatcacatggagagcaggatgccattggcactgcccacgacttcgccatcacctcaagttgtcgtcatcgagctaaagttgtccaaccggccacaacagccacctccatctcaccgcctcgacgaaccatccagtcaccatcaccaagacacttataggacgttgagcacgagacagggcagaagagcagaacaaatgacgaggcgatggccacaccaacccccttttggatggttgcaagcggcacgccgctgaccactgccaccatcaacacctgttgtgatgccatgctctaaggatgttgagcccgaaatggcggcgagctccattacccccacaataaagccactggagcttgcaaaaccgaccagccccaccgccctcattgctcccgctacctacactgccaccaccaccgccgccgcttgcactacaccaagcgtcgcaatccagcctcaccatggggcctcgtcggcctgtccttgcacaaagcagagcaccaccagccaagtggccaacctcactagtgagctagacactataattggatctgtggagagaaaaaaaagaggaagaaggaggatgaagatgtgtgtgtggggggtggggacggggagaggtggcggtgttgtggcgcgcatgcgtcaggggagtgaatgattatccttttttcacctagtttctattggaatcaaactgattcatgtaaaagtccagcaaattttttgcctaatacgacgtagtaaaaacacaattagatatgttctttttatcttcatataatgggattaggtgtttaattgtgtagtgcaagccgtacgtgaattaaaaattgctcctagaaaaggagctgccatggtttaggggatgaacaacttagctacgtaaaaaagatgggccaattccctacatgcccatgtaatttcacccaatcccttctacgcccctgaaatttgtttgatctcttatatacctctgagtttttatttggatcccttacatacccattccgttagttgaccattagtttgaccgttagttattgtagaaattactttcttgtccttggtatattgttaaaagctagaaatttttttatgtgtaaattatttgagttgtgaaaaccaataaggaataaattactaaatatttgttatgaatttttaaaaataaaacattatttcattaaaataaaaattatttatcgtcaaaacagttctgcacaaaatttgaaaattacttttcaacaaatatttagtgaaaaaagattcgttgtgaaaaaacaaaggggatgtaattagtttatcacaaattagaaaataaatttcagatcaaatttgatgaatttcgtatatcttcccaaaaatttaaacctaaataacatttagtttttgctcttaattttctggtgaaactaatgtatggatttaatcataattttttaaaaataaaaaataataagttttattttttaagttgggcattaaatgattatattgcttgtattttgtataagttatttttttcatatgaaaatttattgggtagttaccacatatgtataggatgggtaatatagtcattttaaaatatttaacggtcaactaatggtcaactaacggagatgggtatagaggagatcaaaataaaaactcaggggtatataagagatgatgtcaaattcaagggtattgaagggattgagtaaattttcaggggcatatagggaattttctcttagtttatcacaaattagaaaataaatttcagatcaaatttgatgaatttcgtatatcttcccaaaaatttaaacctaaataacatttagtttttgctcttaattttctggtgaaactaatgtatggatttaatcataattttttaaaaataaaaaataataagttttattttttaagttgggcattaaatgattatattgcttgtattttgtataagttatttttttcatatgaaaatttattgggtaggtaccacatatgtataggatgggtaatatagtcattttaaaatatttaacggtcaactaatggtcaactaacggagatgggtatagaggagatcaaaataaaaactcaggggtatataagagatgatgtcaaattcaagggtattgaagggattgagtaaattttcaggggcatatagggaattttctcaaaaaagatagactacatgcacagccgagtaattataaaagtatttcatctaatcaagtgaattaggtgacgcacgaactaaccaaattgcagtggtacaggtacatacattcttatatggtcggctaaagaaattcttaaagatagcaaagcaccggccacggcgagactattaattaggtcaacttattgaacaatatgtgagaatttcaactaactgatcagatcaaatacataagctacctaaatgacttaacttattttctatgtttttgaactaatagagatgatatatcagaatgcatgttgtagtttgtgagatagctagtcttagcccaaccagctggttcatttttcaactgagctccaagagtttcaaactcggctcatatatttcctatagtagagtaaccatagagttgactttctgtgaaaaaaaaacccccacatttttgcattgtttatgcaaattatcataaattgaatcaattgctcataaacctctagtgcaatcatggattgatcaattgtaattttgctgttttggtttctctcttttctcctctcccctctttcggcccttgggcctttgtatatactcttttttcctctcttaataaaatttaccgtgagggcctctctcactgtgttttgataaaaaaaaacactttaaccttttttttgttttgaaattttatcggtttgatgagctttaagatttttttctctctttctgcatccaagtccaatttcttgactagaaagttttgattcttttagctgaaatctccaattctacttttgggggttgatgggtagctagcatttgagttgaaaaagtagagtaggctatagctttgtaaaatggtccattgaaatttcaaagcactaataatgccaatagaaaggtaaacacaatgagaagccctacataaagacatcaaacctctcactttgtaaaatcaagcattcatccttccgaatctgttttatcccattgaaatccccttaaataccattgtcgcatgctcacatcccatcttttccaaagggaaaagatcttctcaatgaggagggaacattgtgtgccaaaattgactcacgaatatacaagcatctaccaacatggacactcctgtccatatgcatagctagaaattaagtttctttagaacaaagaaagcacgtgacataaacttatgctatacaaaatattatgcatatgctagaagttacttccattaccttaaaataaacatatactacatagaaacttaacattgaataattgttgatctacaagaaattcctgccttccaagatgatgatgagctgatcccatgaaagaaactctgcaggagagacaaagctgcatgcttcagtatattctctgcttcacctgtctctcgcctgccaaccatcgatccaagtcccaattcccaaaccaaggtactacgaaaaatggacacatcaaggcaagaaaaaaaaagaaaaggagcaaaacgaaaacgagatatcactgcgaattcgcaaaaaagttagcggcaggtggtacgagcagagcaggaagccaacaaaagcgcgcgaaataaagctgcctctcgcgcgctttttttttcttttaaagcggagcagcctcctactcctgcacccctcctctctccactttccctgtaaagcaaacgcgcgccatgaggaagaaggcggcggccggcggcggaggtggcggcggagggaagggcgtggtggcgacgacgacggcgccgaccgacctgctcgtctgcttcccgccgaggcagcacctggcgctgatgcccaagccgatctgcagcccgtcgaggaccaccgtggacaaggcggtggccgcgcggcggcggcggcagcagcagcagcagctcccggcggcgaggtctggaggaggaggaggagggcgtgggcgtggtagcactagcagcccgctgttccgcgggtccaaggcgaagcaggccgccgtcgaggtcgacgacgagccgcagtcgcccaaggtgacgtgcgtcgggcagatcaaggtggcgcgccccaagaagcagaggaaggtggccgggaagccaggtaatggcggcggcggcggagaaggaggagaaggtgggaggagctggatcaccgtggtggaggagatcgagcggctgcacgagcagaggaagaaggtgagctggctggaggccgtcgggatcaggagggacgcgctcccgttcctcggcggcgcgctccggagcctccggctcaaggtgcgctgcttcgggtcgctccacggcgcggtggagtcctccaccgacgacgaagacgacgacgacgacgacggccgcggcgcggaggagcacgaagccgtgtccgccggatgcggcggcagcgccgcctcgagcgtgttctcgaagtggctcatggtgctggaaggcagcgaagagacaccggagcaggactccggcgacgacgaggaggagcccgagcgagaagacgacgacgagtgctccaatgcgccgccgtccgccccaccggcgaacgcgctgctgctcatgcggtgccggtcggcgccggcgaaaggactagcaaggagacgaacagaggagccaccgccaccggtcggcgaggcggtgcacgacgagggaagcgcggccgccgccgccgcgggggacgacggcgcagaggaggagagagacgagctggtgttcatgcggacggcgccggatttcctgaagctgtccatagacatcgccaaggagacgtggatcgtcggcggcgttgaccccctcgcgcggagccggagctggaagaggtgaccgaccgaccggccggccggcgaggagtccccggcatcgggattatttgtacagtttgtatttacccttgcgttttcggtataatcttgtgactcaagttgttgttacgtttcctctaacttggtaaatggtgattatataaatccaagctatagaaatgaggtgaatttatcatgcaacaatcctctacgatccaattgtgcacatggttgggatttgaaaatagaatcccattaaaaaaaaacttaggaaatgcctaacatccaaaattcttcaagttacttgctcagtgtcggtatgatccaggtcaatatggtgccgccttcgtcaaaaatgcaactccactaattgtgacctttttatccaaaaatgcttttcaacattgccattgtctcgtctgtgcaatcgtcggccatccggagacgagttcgggagcaaagtgtttttactagaatgaaaggagcataaggcnatcatgatatacgtagatagatgtgagttaagcactgattagacaggaaccacagcttcgttgttgattgagacagttcatggtcatggcactctcctaaacggttggtttctttgacttcacccgttggtactacagccaaaccgcctatgaatatgcaacgcgctatgtgcgctctgctcataaacctcctcatgttattgcaaagttggccgttgctcgtccgacaaactatgcaccaattggactctgtcacaacagaatctgcagagaaggtcgtcgtatgctgcagtgcagactgcagagggcagagccgcaacagaatcttcagaaagaacgtcgtatggtacagtgcagtgaggggatgtgacctctcatagaaaaatgtatctagacatagggtacagacaaattttttttacggagagagtactccatttcaatataaataaaactaatataaaatatgacatattctagttttattaagctaacaacctcatctagaatgtatcatattctgtattaaattagtattttgggatgggaggaattccacggagatagaccagacgtactctctcatcccaaaataagccaatctaatacataatatgatactacctccgttacaaattacaagtcgttttgactttttcctataatatttgaccattcgttttatttaaaaaaagtagtgcaaatataaaaaggataagtcatacttaaaatattttagataataaaacaagtcacaaacaaaataaataataatttcataatattttaaataaaacgaatggtcaaaagttacaaccaaaactcaaaataacaagtattttgagatgggggagtactaatctggtgtcacatgccaaaggttggtttattttaatacatatggagtaactgccctaatcagaatcactaccatttttccaacaaaaattctgcacggcttccgaggcaacctgcaccagcatctggcaatcgcaagctcaccaaataattaacaaaacattactgcgagaagagattctaaacaactcagtaggcaccaaacgcacgagcacggaggactaaaagcaccagtgttaacttactttttggtactgaatactgatagctatacactacaggctaattctattaaggttgtgtttagatccaagggtgaaaattctattaaggttgtgtttagttaaagggtgaaaagttttgacgtgttacatcggatatacggacacacatttgaagtattaaatgtggactaataacaaaacaaattacagattccgtctgtaaactgcgagacgaatttattaagtctaattaatctgttattagcaaatatttactgtagcaccacattatcaaatcatggagtaattaggcttagaagatttgtctagcaatttacacgcaatctgtgtaattagttattttttttcgtttatatttaatactctatacatgtgtccaaacattcgatgtgatagggtggaaaattttgctaggggatctaaacaagccctcagttgagtaagttaaagtgaaaaaaaggttgttgcaatattgtcaacacctagcatagcgaatatagagaaatgagtgtgccaagtaacacctcggcaagcataatggcggcaggtggcttctgtccacctagggaacgacagtctgcataatataagatcattctcttcgagtgcctgcagctgcaaaaagagcaaagggaaagagagaggaaagacaagttccattgcaccactactcgtaggaagctgcaccattgaaaagctaaccgtttttttcacaaaccaaaggcatgtgttaacagtcggtcactgaagagatctacacgtgacagaacatgtggcattgttgtaaagtttttcccattttacctgttcatctcgaaaggaggaaaccggtttctgaatctaagctggtatccactatccagtgctagagcctacaggtagggatgaaaacggatcggatacgatcggaaactagctctatcatattcgttttcacattttttttcaaaatcggaatcggaatcggaaacccggatatgaaaacgaaattgaatattgtcggatatagatatggtgcgaatacgaagcgaaacgaatacggtgacgaatattaaccggaacataaaaacccctcaaactaagcatcacaactcaaaaaagaaatataactctttattttttttctaatataacatatcaacttttccaaattttagtgttaataattttgttatatccgattttgtggttgagggagaacgattcaatagtttatcgcactcatatggccgtcctaaggagccgtatgtgaaaataaaatttaaaactagtttatcgcactcatatgaacttcaaattggatgattctttttcataaatatttctaaaatcatgctctaatgtgttattgtgttcttactgctattattttggccatagtttcttgtgacttttgttttatcaatttaaaatttgaatttcaaaaaatagcaacttcagataatattttgaagcattaaataatttcagctgaaaaagtcatgaacataagagttgtagaattcatcaaaagctacaacttttattttg

SEQ ID NO: 21252 - DNA, 1266 bp, Oryza sativa
  unsure (1)..(1266): unsure at all n locations
ggcgtcatctattaaaaaacggagggagtattaccaattcactgccagatcaagaacattatttcacagctttggtttaatatgtcaactgcaaataattgaaacaaataagtaccaagagtcaagaagtatacccccaagacaatgggcagctacactagtttgttgatgatttagaagctttctggatctccaaagttatcgcctcagcaagatcagatgcctcatactctgctccaaagcatcgtgctgtctccaagcatggatctagcaagtacctgtatatttatacagtcaagtgcctgacacattacaacaaggcaagctatatagaataataccgtgcgtgcttacatgttatgagagctttctacaagatagtcctgaccaatgtcatcaacctttttgaagaaaacacggtattcctgtgcaatctgtcttactgcattgatggatcccgttagtcctattattcttgggtcaaactctgccgttcaaagaaacaaactaatcattcccaaatacagtgaatttgaaggttccaatagcatgaaaaatagagagcaacttaccactaagatatgccttaagctgagcaggtgaatcacgttgaggatcaattgtgataaagagtggtgtaatcttggtgccatattttgactctatgaaacgacaaattaagaactgtaagaaaaggaagatcacaaatgtaatacaaacaacagagttcagataaatctaattattataaggaaattatagcatacataaaaattaatattttatagggagaactactaccaatttaaaaagcccagctaacagaatctacatcagtgaaagctcaatgctttcgtgactctcagtaagccacgtaagcagataatctccagccatttgatgcaaacagaaggaaatataaaccgccagattggacaaagacactagcgaattggtcaaattggcatggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21253 - DNA, 631 bp, Oryza sativa
tccaaagacctttattttcatattgactttggactgccatatccattcgatagtaggtgggggagtgagagccagaaaactgagcttgtaacagagtcgcgaagtgaatttccctgatccccaaacgaatgtccatgaatcatcaacctcctgaagggtaaaggaatggagattttcttgcatgtccttatatttatcaaacgcttgttgcgaaaggggaaggaaaaattgatcttgggggtctcttgataagtgttgtgcaatagattcatttccgtgctttgcgaaggagtataaacggggatatttgactgaacgtattactccctcccataaatcatcccaaaaaagaacagctgtcccagagcctattattggttttgcaatgcttctaaacaatataacatactgaaagatgtccctccaccaaaacgaaccacaacttctcacagtctgaggaactgcgtacttgtaataagaggaccaaataagatttacccaaggtacctgagttttgttgtaaaatttgtgcaaatgtttcataagtagggctctattttggattctcaaatcaatcactccaagccctcctttatcctttgggcgacagactttagaccaagctgctaaa

SEQ ID NO: 21254 - DNA, 4374 bp, Oryza sativa
agaaatactaaaatacagatagagatagttgattgtacttcatcttggtctattgtaaaaattgtccgatgtactggacgcattcatcaccaagtccaatttaaagatgagagtctaaggattcgatcgcatatagtactgcatttcagtattttcactataagaattgcgtaacgcgtgactgatggcgatgtgtaaacctaatcgatagactagctatactagctaacaacgcgtgatttttggagatttttgccggcctttcacaattaatcaatctcaacacagacatatatagagagagtgttatatacgaacgtacgatttatcgtcctttttataaaaaaaagattttttatgctgtttgtacgagctggattaattctaatactactagtacctcaaacatatctgcatgcggatcgatcagccatgtactaggaaaaaataaataaataattgcatataaattaggatttggttgtactacctttgtcttacatgttggccccgtgcattcctccatgttgtccaagaattattttttccagttacagagctaactagactataccaatgaagattgccggccttgatatataaatgagctcttaattttttaaagtatactatacacagttatttaaaatcaaccaaagcctatcatatatatatggagctcacaaaaaagagaaatattttcacaaaaaaagagaatataatatatatctggtgagaaaaaaggatgggaaactgacctttgttcaaaacaaaattgtataaactgaaaaatggtccttaattagttcgatcgttccactgcggtccatatatacatatatacatgaaagggcatgtagcctagtggttgcagtgacctgagtagtaccccaaggtactgagttcaaatcttcataggagcgaatttcagatttggttgtttgcggggctaagttcctaatttaaatggccgtatatatccggttagatgtagagctgggtaaaaaactatccttctctaaaaaaaataaaaaaatatatacatgaggtcgcatgattagcaatttgtactacaaacgttaacatgtaagcgaatattttgtaaagtaattaattcttttgaagaattatcccatcgtatcataaatcaataacttattaatattttctgcaaggagagacaatgactttttaatattagattgatcaaattaatgagatctaattgcgacggggaaatttgaccacgtttttataagagaatgcataccattaaagtcatttgaaatccacaaggtaggatacgaacatgagagtcccaacaaaacgaagtggggatgttggacattatgtttaaaaaaatagtttaaactattgagttggtccctgtagagaagataccatatcaaaagggatatatagaattaattaaaataagatggaatcttgattagctcgttcaagtcttctacgaatggaccgcatacgacagaaatcatcttttttgagaggctctgataaaagagtcatatttttttacgctaaatgtatggccatcccacttgattaattatgttctgaatacaaatcaaattcaattgtaaagcatattattattatcatctatataaacactctcccatatggagaggcaacacatactacagtggtggacccagaaaaattatactggccatacctattctagcgatcacttcaccatatattttttaaaagaaaacacccaattatgatggaagaattttagcagattttagtcggatttttcaaaatactattcaaatgtggtccataatttatgaaaaatctataaaattcagaataatcaattccatgacctaatctatttagctgttcttctttttcccccaatgtttctcttcttctagtcctttcatcttcccctgatttgatttcttaatgattacaagatcaagacaaaccgtgatcattgttatattctattttctgagaggattctatttttatgttctttgattgcatactatatcctagtgttttttcaaaaaaaaaatgggtatgccggtgctaacccggtacaccccttaggtccgcccctgcgtgctaaacacaactattatgatggttctgtatagattcccatcaacttttgctttatctagctgtttatatatgttggttgaaatggaatatattttttatgtattttttctgattatagtgctttcttttcatatatgtagggttcaccaattaagctatgacattttttttattttaagctagagtaattttctcatgggtgaagactattttacccccccccccccccccattcctatcaactacaccgttcaaactagtctggaattcagaccttagctgtatgaaattagacatcacgtacccccacccacaaactatcaagtgggagtgtgtgggactacatacacttaggtcaagctatgaacaatagaaccaaactttttatcatctgcttttacttatgtactccctcagttcctaaatatagttaagtaggagggtttttgaaaggattcttaaggactggtgtgcaaggtctaaaatacctcccattatagtcttgggcaatgtgaagtgcatggccactctggtttgaaggatccggctcctctgcctttaggtgctaaaggcatgagcatagtaatatgtgccttgcgcaacagtgtggaacatatatttgcagttatttactgtttatgtgctactgtactggactgtagtgattgatctcgttcgttcactgtaaatcggacgactgaaaatattctaaaggcacaacactgtgcttccctggttgaggtgatgtgaacaactaggggtagtatgggaaatttagtgtacaatgtcacattttcatatcctagttagccatacttgtaaaagtttcgaatctgaaaggtagctatatttcgagatggagggaggcactcaattagtaagatacataaaatatatttttgatggcaattcaaaaaaattaaattaattgtagtggatctcagggtggagagatggggacggtggccgtgcgactggaagaggatggctcgatgtatcctagacagcaggtcagcgactccccaagttccaatcggcttggtttgttgttttgagtctttcaacacatcggctcagcactaaagaagggtttggctgcagcgggagagcaaacacgcgtcagcccttggggtggatagcgagccagctcggctcagctcggtcaagctcgttaggataacgagctagctcggctcggctcgttatcgtaacgagctagaaacccagctcggctcagctcgtttggaagctcgagctagctcgttaggctcgcgagccaacccatccaaaccatccagttggcagatgagaaggttggagttggggtcgatgtggaggtcctttcagatgacactgtggagaaggccgagcggcaggagaccccgaacgccatcgcgtcgtcttcccctcccgccaccgcggcgagcaactggagcttgtggcggaggaggagcttgaagaagatgttgtagatcttcacgccgacgcccggcatcgcctcacctcacctcacctcgcctcttgcctatatcccacggcgacgacgatggcgcggctcgggcggagccctaggctgtgcgggtgcggcggcggggtggggaggaagatgcggacggagagggaggagttggggtgcggcggcggggtggggaggtccttggaggcgacgccatccgccgcggagaaggccgggttcgacggcgccgtggcaggagaccccgaacgccaccgcgtagtcttccccgcgcgacggctggcggtggcagcgtgaagcactgtggtgccgtgcaacggctggtggcggcaacgtgaaagaggatcgagtgagagagtcagagagatgccgtgtgggtgctagggttttcctctcctcaaccgagttgggcttttgctgttcgagttgtgttgtctgttgggcttctccgcggctcgttaagactcacgagctagctcgttatttctaacgagctttaaagccagctcggctcattacgaaatttaaatgagtcgagccaagcttgtcacgagccgcacgagttaacgagtcacgagcttttgtccaccctagtcagccctctacgcagtgtcgcacatgaggcgtggtgcggtgcaaagaattttcttctggcaaaaactcaaacttaaacactacatacttcacagttcacgcagtcaaccagccatagcttgcaaaaagctgcctccagcagcaatactccccaaccacaagggaaagggatcctctgacttgcagttgagtgagaggat

SEQ ID NO: 21255 - DNA, 11006 bp, Oryza sativa
actcaactgcatgtgcagttaagtgagaggatctgcctccaaccacaaggatccaaaattatcaccaccttctacatgcgcaaacaggttcctcgatccatctgatctgagtcgcatccaattttggcgccaacacatgcaacttcctccctttttccccatggattaatgttacctcggtgaagcagcgatccgattaaactaaactaatttgcagccatgtacattaacgaacactccatttcaccggtccaccatgcatgcaccacccgccaccaccgcggcgcgacgccgacggcgacataaacaatcacacagaaccgcgtgacgccgccggccggctatatataccgtcctcatctgacctgctgccatcggctgcgaagatttcttggtcagttcagttgagttcaaccatgaacaccgccgtcgaggttaggtgcgccgccgccggcggcggcggggtgaatgctgcagcgtttggccggaggatgatgaggccggcgccggcgggacactgcagggtgatcagggcggcggcgacgtcgacggtggcgagcgggaggggggaggacgactactacaaggtgctgtcgctggacagggcgggggaggtgggcgcggaggagatccggcgggcgtaccggcggctggcgctgcggtaccacccggacgcttgcccgccgtcgcgccgcgccgagtccacgcgcctcttcctccagctccgccgcgcctacgagacgctgtccgacccggcgctccgggtcaggtacgacgccgagctgatgatgcgcgtgcggcggccggcgaggccggcggcggaggaggacgcgtcgtcgtcgtcgtcgtcgttggcgagggacgtctgggaggcgcagctgcgcacgctgcgcgcgcgctccgacgagcggcggcggcatggcgcggacgggacggctagacgcggccgttggttcgaggtgtgagctgtgacgagatcgatttctggtgttcttgacttggctcgatcgagcgtctgctggtggttgccgtttttgatattttcaattctttggctgtcattgtgagattattatttgttccggtggcatctctttttttactgtggcgtttgagagcgtgttgtgtgtaagatcaacgtgtgttttgattattattctgtgatgaacaattggcatttgtgattattggttttgatatttggagattatcgtcgaagtggttttggagataatcaattttcaggagatgaacagggtttactggtttgtcgggaccggtcagaccgggcggtggttgccggtcagaccggcttgtgttgagcggtcagaccggccggcccacggtctgaccggccgacgctgtgtcggtttcggtttcggattgtttctttggatatccgtgattgtttcatggttatggcttctagatggatactatacgtatgtgatactgttgttttgctactaatgagtcaagttggtgatagcttggtctcggaatatggtttttttgtttgtttcatgtgtaggtgactcgatgcctcgagagagtatttgcactgatggaccgggagtcggcttggtggtaagacaatgtccgtggtggtcagatatcatgcgggatactaaggctagagttgatgcacgtggttgatggagattccatatggcatacgatggaggtattgtgtgcgtatgggatacggagtcgaatttggaaggagtccaaatttggtatgattggttatgtagagtttgtttcttgtactaagaggtttcctatggggattaggactcttagtatgagtttggttcgtggctttaggttgcttacctcatgtataaatagagggggagcgtgaggcttcccggtatctttttggtatcgcttttcatagcgttgtgttttagggtttcgagtttagtcgagatttttgtaaggagtgctgttgttgcacgttgtaaacatagagagaagtaataaagttgtcatctacttttgagagttcttcgatttgtgtttcatcgggtacggcagtctaaccggcaactcaacggcggtccgaccggcgacaagcagcggttagaccggcggcatacgggcggtcagaccggcggcggcgacagcaagcggcagctgatcccggcggtcagactggagattgaatctcggtcagaccgacggcaaccaggcggtcagaccggtgcatctacttcggttagaccgcgatccatcgatttcgagggtaacttttatttccgctaaaagttttcggtttttgcgtataccaaccattcacacccctccccctctggttggcttagttcttgtgattcgatcctacattgtgcactgtaaactgtaaaacttttccaattctgcaaaagttacgtgtaaaccatatgaaattaggtggtgtttgaaactcatatagatgaatataaagataaaggttaagtgttttacgcaaatcaatatggtattaacgtataattagttgagttttaattattacaaacttgaaaaatatttatctaatatttagagaaacttccatatagaaagttttcgcacgaaacacatcgtttagcagtttgaaaaatatgtcgtgaatactccctccatttaatattataagttgttttaaactttgttaagtttgatcaagtttataaaaaaattaacaacatctaaaatatcaaatttgtttcattaaatttaacattgaattcgtgttgaaaatactactatatttttttataaacttgattaaatttaaagaaatttgattaagaaaaatatcaaaatgatttataatatgaaacggagggagtacaacacagcgtccggcaaaaaggaatggattggacagtaatattttgagatattatggatgtatcccagagattttagggagtgctgtctgtgataacattgaggttggctcaagtgcaccatacagtaaagaaaacgggcaaagcagagacaagcctaattctatcaaaaacttgtgaaaaatttgaatatacagatggacaagcaagttcaaccctggtccttgaagtttcttggtcatgtgtgaaaaattgatgcaatgaacacaacacagattttaagatatggatacccaaagcgatgaaatttgtgaatagacgaaacaagatggagagctagctcccatcctcacttcactagactagctcacggactacaccctccgtctaaaaaattagattttagctataaatctgaatatgtgtttattcaaattcatatttaggagttaggttttttttgaaggagaaaaaaagaaaggttgaaacttgtgcaaacatgtcgcctaccgagctaaccgattaatcatcatcatggataatcatatgtacaggcccaaagtgtggaagcacgggcttggtgcttcttgcacatccactcatcttcaaaaaagctggatctatcagaccagtgatttatctagtaaaaccaaaccagtctagttaattgtatcgaaagatcggatctgcattcaaactgtttagaaccagctgaaccgggcagttttgaggtgatcgaacaaccaccgataatactaggtagtttgtttgtggtgggttatccaaaggccagttcttccattatggcccatatcatcttgtatttttgaaataaaaaatacttgacaaatattggttgtgtatatagaaaacttataatatacacatttagtggaccacgatgcaaccacccgatcaccagctagaccgttggactggtgaaccaacaggttagctaatgttgatattttcttttacattgcatggaagaaacactcacaactatgcacgctcgccacactcgtcactcgttaaggtgccctataacacatgtttgaagagaaagaagtcagcggcaaaattaatccctaatcttattaaaatcttattgaaaatacgtcgagcgtacatgatttttggtgtgcaccaagacttaaactcttgtgtgtacatgatctttaatttcttccgtaaatccgtctatgttcttttggaattggggatgtttgatttgaacagatcacaatgagaatgcaaagaggtgtttcaccctactttcaatcaccgatcgatttcacacactagctaaatactgactgatcaggaagaatgggatgatcctaatctgctagctttgcgtggcgcctgatctttagactcagtttgcactcatcttatcagcttcttattaatatccacacaaaatgcttattattacctcatctgaaccgtgggtttggaaatccctgttctaaactttgtgggggcatgttcaattatagactctagtataaacctacagtacgaggttatttaaaaaccatgtctatacaacagtcaaaaggaaaaaagactctaaccattaactaaaaaaaaaatttgttgttatctttttttcactcatataaccttgtttccattttatggaggctaagtagatgttgagttcgctgttaacccaacaatgatgttttgtctctcatgtttctctcttctaaatctaaataaatattcttaataattagtaaaactaaaagtcatctattaatgatgattgtacataccctgataaataagtagcgaccaactttccatcagataagtctagcgaaagacgaccttttcactctcagtactccagctaattaaattcatacatacatggtataaacacagctttccttctgcaaaagccaagttggcacagatcgaaaagatgaacctgtttccttctctagttcacactcgttttcacgaatatggtgacgctgccatccagacaaacggccatcgtcggcttgacaagctgatgaacacccaacatcgccatctcctgcacaattgccacacagctatagcctgtttgagagggagtaagaataggagatgaagagtttgagaggataagtcatacggattatatacggtacatcaaattttaatcctggtttgtgataccaaccggtcccggttgttaacacaaaacgggactaaagatttgaactttagttccggttggagttaccaactgggactaaagatcccggaggggcctgacagcccctgacagcatgtgaaccgggggtaaagatcaaccaggactaaaggttatatagccccgtccttcttataaaccgggactaaaaaccatctttagtcctggtttaccgggattattgtggtttttggccgaccagacaaagatggtttctcaagtagtgctagctctaatgctcgatttctttctgcatcttctcctatacctcgctagccgctacgaataatcgggcagtcagcctcgtcgtgagatggaatcgagttttgaaacagatggttgcagaaaagttgagatgaaagttcatttgtttaagagagggatcgtcccaaattaaggaaaacgaagtcgcgggaactcgcggtggctgagcttgcaagggaggatatattctccctcgatcccttttgcttttgctcatcgcttttagaaggcgaaattccaaagcgtgtctagccctgaaatgtataaatcctactcgcgtctcgcttgcgattaattcaccatcgatcgcttttgagttcagtggtagtagctgataagttgtgttcttctaattccctgatcaaaatggcctcgattagagattttgccaagagatatgaagctgactgcagacacctcaaccaattcttttctggtacatatcaactgatgatatcagcaccgccatcttgtctcatgctagcatcaagaacagttcatcagtttcttttttcagagatttgaacagtttatcagaacaatctgtttacattttattctgtatcaatttctgtttcactgcactgttcaatgttcatacatgtttctgccatacgttttctttctaacacgactcaaacatggtgtcatgtcactgacatctccaaatccgtaatttaaccctttgttaacctttttttgacaaatctctgttagcttcattccttgccagagattaaccacgattgattatcacaaaatctgcaggaaatgtttccccgaacaatgcgagaccggtcctggagatcttcaccgcaaggagcagccaggagatgaagcaaatctgcagggcttacagcagcatgtatcgccaagatctcatccagctactgtcgcagcagaagaccacctttgcagtaatcccagcttctgatcctcttgtgtcaaaacatatttcaatcttgtctggttcgatcgccatcgtgcgccatgctagctgatgcacgcaaaaaattaatggtgcagagggtggcgtgcctcagagctagcgagccgtgcgtccgcgacgcagacatcgccagggacgcgctgttcgggcggcggatcgacggcgacgtgctcgtcgaggtcgtgtgcacgcggccctccggcgaggtcgcgctgatcaggcaggcgtaccaggcccggtacagcgccagcctcgaacgcgacgtctcgtcgaggacaagcggcagcctcaacgaggtgagagctgcgccgatcgcttgatcagattccgtttatctcgtgttcgatcgattggtgtgtgtatgtttgataggttcttctcgcgttcttgggatcgagcgggagcggctaccatggcggccgggtggacgcgacgatggcgatgtgcgacgccaagacgctgtacgaggcggtggagatcagcgcggcgcgggtggaccagaggagcgtcctgcagctgctgcgccaccggagcggcgaccagctcagggcggtgctcgcgtcgtacaggcggctgtacgggcaggagctcgcgcgggcgctgaagaggaaggacggcgacaccagcggcggcggcggtggccggcgaggcgagtcgtcgtcgttcccgggcatcctccgcgcggcgctgcggtgcgcgcagctccccgagaggcacttcgcgagggcggtgcgcgcggcgctggagcgcggcgagggaggcgctggtgcggaccgtcgtgacgcgcgcgggcgtcgacgtgcgccgcgtcaaccaggcgttcgcggccaagaccgggtggacgctggagagcgtcgtccggaacgagttcggcagcggcggcaccgggaagtcggacgacggcttgaccggcgacttgctcgtggagttgctcaagttggcctgaggacaagagattgagattttctgcagttactgtaccgtgcctttgtcactaacatacgggtccgatgatcttcgagcccacatatcagtgataaaggcacggtgcagtcgactgcacatgatcataatccgaggagagattgagatcctctacagttattgcaccgtgtttttgtcactgacatgaagtccaccctcactagcgggcaccaagcctcttgtctctcgagccgtcagatgatcgatcagctgcgaggatccatcacaatcttccattcttcctgcatgtagtggagattgcaactgatacatctcacgtttgtcaagagttagatttgttactgtattttggtgataaatataatgaaataatgaggcgaagaattatactgttatgtacacacagctatacatgcaaaccacatcaatgttcacaccagctacagttgacaaccatttacaactgctgcaaccacagcagctgtggctggaggcctgaacacactctatgagtgtgcctctaaaacaagcataaatagattgtttttccctattaagtttatgttcaaaaaaaatagagatatctctccaaaatgacaatggtttgttatgcttaaggctatcactggatttagtggagctacatgcacaggtgtaaatattttatgtttaaggtaaaggtttggtgcaacttgtaaaacttttaaaccatcaattttgtattagaataaattaattatatcatgatagttctttcaagacaaatatacccataccattccttttattctttttaaagctaattaaacatttgataacattgagtagttaaagttttagaagtttgaccaaatatatcctaatcatcaaatgtttataattggagagagaggaagggggaggagaaagaaacatggatgttaagcttaatatcaaccatgattgctatctcacgcgtacgcgccagcttgccagctgtgcccgcctcctagcgctctttctttttttctgattttctttcctatttttctgttacacgtttatcccatatcacggaaaaaagtttctttttttatttttcttttcttttctggaaactatcatgtgtgtttctttttcctttttttctgactaaaacaaacttttaagtaagatttgaaatcttctcaacttatattcgaaaattttcaattcaagatttaaaagcttaaacatatatttaaaatcattcaatatagatttgaaaattttcaagtttgaaaacttttaagtaaagattgaaatctttcaacttagatttgaaaattttcaagtcaagattgaaaactttcaactaagatttaaaaactttcaactcagatttgaaaacttccaagtttaaatttgaaactttaaacttagactcgaaaactttcagctcggatttgaaaatttttaaatcaagatttaaaactttcaattcggatttgaaaactttcaactgaagatttgaaacttttaactcaaatttaaaaactttcaagtcaaaattcaaaatattcaacttaaatttttaaaactttcaactcaaattcaaaaccttgaactgaaattggaggtgaaatattcaatttataaaatatagcatgaaaaaaatcgcacaagcacgtgaagaaaatatggggagcgattaaaaaaagcgtaaaccggaaaaaaaagcgaaaaaaaggaaaaactctcaggctatcgcgtctgcgcgtgcgtgggccttggcggcgtcgtaccggggctagcccgtgcgtgggctttggcagcgtctgcgccggcaacgcggttgcgctaattagttgcgccctatcaactcgtagccttgataaaataaaattttgctacatgaggatgaagaaaagaaaagaaagataatataggttatattgttagattaataattagagtcttctttgtagaagctaggtattttgttgaagagagtgactggaaggaaattcatatggtgaaccatgtaaacaatcattcaacgtgctaatttccaattgcatttatttatttatacgaaggcattgtttgattgttacaaaagatctgtttataacttcaggtttagaaaaaaaatgttaccaccctaatcccttgtaaattgtgttcagctactatttttggagttcttttagtgttgggtttggtttacactttggtgttcgccatagatacaaatttgcgctagatccaccattgcatatagtcaccacagtttaaatatgtaattgtaatcttcacagtaaaatgaaatgtttaaatttgaaggatactaaattgatactaagctagtatcaacttagatcctatttggcacaactccaaatcccatatccattgaatgtaaaaaaaaaatcccatatccacactagatctggagtttgaaagttaagctacaatggtttaaagtttctctaaaataggaacaaaataattcatccaaatgttatcaatgcagtcatgactctatatccatagatttctatgactaaatactcaactccaaatggatttggtcctatgtcaaaaaggaccttaatgaaatagatgcccaaattgaatccaagagaacttaaacttgaggtggtggagaacagaaatgaacctctcaccaagttttataatggaaacatgagggaatatacaaactatcggtggtagcaattagcaaataaatgatgcatatgcagggtaggaaacttcattaactccatacgaaacttgtgtttataaagaaaacatttagttgtacgcaactatggaattttcataatgttttcatagttatgaggaaacatgaggaaaattgcaaaatatttgtggtagcagataaacacatgcatactagggaaattcattaactccatgagcagtgcatcccctataaagaaaacatttaatttcatataacgggttttataaatgttaattagtagcttgaattttttgttgcgaaactgagctcgatggtaacacaatttaaaaaagaactacaattatcagtactgaatatatgtaaaaagatgtttactcctaaagaggggcatttaactatttgccacatttaagatgtggtaattaaagatttgccactcgtagtttatgacgtatgggtgttttctacaagtggcaattaaggatcttacaagtgacttgtaagagtgataaatagttaaatatctcctaaagaaaagcgcgagaagatggaaacaacggaaatgctaatatgcatgcaagggcaagctgagcaagttgcgagaatggggcaccctatttccggccatggccatcttcttatctattatatcctctcatacccccaaccaaccacatgcccacatcggggaagaagcgacaagaaattgagacgacggcgttgcacactgtaccaccactacttggcgccaacaacctcctaaaaaacgctagtgagcttgacctttacattgccaatgatccttgtcatcaacaccatgcctttcctccacattcctcatcctatccccactcccacagccaacgacgtcacctttatcatctggttgcacaaccgcctaccctaactagttggcggttgtgcttgtgttccccggttgctaaccctaccctccgccctctctcgatccccgcggcttcaatagcgtcgcctaagcctcactgcccacccatgactactaccttcctagctattcttagcctagaaacttaaaacccctcttcctctttccaacgctccttccctcgcttatctcactccata

SEQ ID NO: 21256 - DNA, 2020 bp, Oryza sativa
  unsure (1)..(2020): unsure at all n locations
cagtttactgataaaattgataaacacatctttatggccatgttctggtgcatatcatagattttataatgcttgagactaaccctgaaatctagggcatgaatgtaaatggtgatgtccttgtaaaaaccatgaatttcctggacatgataagcatgttttatctgtatttatggtataagtttttttttttttgctgttatcaggaagtgaaccatgggttcatctgtctcaaagcaagacgacgacaccgcattactgatctgcaaggatcggttgagacacattgaacaagcaattgatgcaaggtatgccctttcagctgctcaacttgcatacgagcaatctctccgcagtcttggcattgctctaaggcagtttgtggaggcacacaaggatgatgatgatatagagaggtctcctagttcttcttatgctatagtatcatcatcgccacctcaccgttccgatgttaaccatatgaagtcagaggcaagcacttctgtgacagtgacaatcaacacaagtcaggctagctctgttcagaaggagcagtcggttactgctttccttccaccaccgctgcagctagagttttgctcctcatgggatttctttgatccaactgttgttagtgaaaatgttgcatcagatgcctcagtgaacagccaaacatttgaattgagaacgttggaagatctgagcaatccaaatgaaatgggtttggcttcttcaattggaaacacaagtgaaattgttgaggtgcaagaagtgtttggtgcacctggatggaaacaggttcacaaaaatgataaccttcctgacttgcaccactctaattctaatgaaattcagatgtctggtactcatttacccaatgactcaagcttggaggaagagctcgagcaagtacagacgcaggctataggagggcagaattctaatgatgttagtgataatattaaaagtgaggccaaccatataaatgttaatgctcccaaaaatgaagaagccaaggccattttcatcactgactctgactcatccaaagattttctttcctgtgtgaaagatcttgaacgtcagttttctagggcagctgtatcctgccatgaggtctcgaggatgcttgagacgaagaagatccgccttagcatttcttcccagacaaaaggttaggacaacattttcatgatggtagtgtcctcgtgttttttttttctacttaacattggtgctaatttctcgaataaactttgaatagcaggaaaatcatcagatgtgctttttcgaccaacatttctcatcggttgcaaagccggaactgcagcatctgatggtatatttatcttctgcagacaaatactganatttgtgaacttcggtgtagtttatactccaacaatgtcagcctcattttgatgtttattgcaaaaatatcattcattcttttactgcaggatcagagaagcgtgtcacaaaagcaatcacttggaatcgctcactttcatcgcgatcatcagcatctaagaacccacttactccagctcaaatggacgatgaattttcagagatctgtagtgactttgttgaagagttttgtatgatttcaggaagccatgcatcctctttagatagactctacgcttgggaaatgaagctatataatgagttaaaggtgagctcatatgtgctcttcaatcgatgcttataagagaattgcactggcaatggatcttttacagcatctgtgtagaaccatgggattctgcttgtcttgtgttttattagaaatgtatcaaaacagattgtattatagttgttaccactattgtcaacaattcctaatgcaaatatacattaacgcaaagtcgcaaactcatacagaaaaggtaaatgtatgaaaaaaaatctttgacgcattagtatctgccttattatgtaacgcacagtccagatttggcaaaatagcatgcataactacttttaaggattaaataattataatcattctatgtat

SEQ ID NO: 21257 - DNA, 26816 bp, Oryza sativa
gtatgaacactatccgtccgaatccgctccgttttcacccctattagttcccgttcttttcaaggtaaacattggagtagtatttcacaagcccctaaacaacacgattttttttaacaagaacttataagcatttatcaaaaaacatttttaaatcaagtttttaactttttaatatttaatttgtttgtttctatacttgagtaattaccataaacttactttagtaacacttcacaatggatttttcttaactggcactcacctcactaggtcaccggtttaggtttagcactatgaaccatagtggaaaaaatcggaccaatagatgacccggtcatcttgctggttcaccgatctgacagtccaaccgtgaaccggccggtcgtaaccaatcaaccagggatcgactccccactagcgcacattttcattcgatttttgcgaaaaaaaaatcaagcctgcgcacaagtatggcccaaacacactaactgggccatcgtgtggcacattcattcactaacttgccttagtctggtccgaccaaaggcggtttattgcccggttcatcacaaaacaggccggttcaagcgatctgaagcggttcaattgtacgtccggtctttctattcgaccgaaccattgcaacctctggttccggttttttcgggttaaaccgctgacctagtctgattttttccactatgaaccctaccagcactagaccgatctttggttttggcgacgagccttgagagtcctcttggccgtgcatctctccctcttatacaagtgctagtgggcttgggggctaaaccgataaggatttaagttggttgttaactgatcaaactacctctagttcttatctactctattttatgttaggaagataacggtggaattatctatcctttaaaagtcatatgaatttatttttaaatttaaaatacttaatggctcaccttgttttatatatgctcttaattttttcatttccccctactctcaaattaagtggttacttggctagaagtccgtactccatagtgatggtgtgtggcaaagttacgatcattcgctccattgaaccgcaatcattctacgagcaatccgttaacaaatctaacaagagacacaaagcacgctgaacagtgaatcggacgaggagaaaatgcatgataattaagcactagccataggcgtggaaccagtgagggtgacaacaaagtcaactaataaccggtgatctggattattaatttgatattcttagttccagctaagtaagttccatctgcccagctgttttctgggatcaagctgttggtttaatttgatcttccagaggtcaggtcaacttccttgcattgcattatgggagagccaacagttacacatgaccaacatctttttgtccataacttatggaccattagtacattatgctagtagcatttatatattgattgatactttcttttttcctgcacttctaacatggacgcaattgaatacgagtactaattaattcactcgtttgttgtaatgtagtagtactaagatatttgttgtaatgtaagatccgggaccttttgctttgaccattaatagcttagattgtcaaatacgaatgctgtcatcattcatcagtagatttgtcatcaggcatacacttgtgtatcgtgtgtcacattaatttctgtagttaagtctattacagagacggaaaggtatattattggcaccactaattcttccctgggacaaatggcacaatgctgaccggttgctaatcatactataatcctattgttagcacttagttttcaaaatcagcaagtctctgaaatagcatcaaacgatgcgtgggtacatcactgaacacgacacgtcggtacccactgcgtgatggtgatgcaaatgtacaggagcagtagcagcgtcggaattaacgaggtggttatggcgtcgtacgtgcaacgatcgagacgtgtagagcaacgccaacaaatcgcaggcaatgccgtggccacgacgatcccatgcgtgctagcgatgaagatcgatcgatgcctgcatctgtaacatcagaggaacaatcgatgaagagagctacatagcgcaaacagaattcagaatgcaaaacaggagaagaggatcctgcgtgcattacatggctcatgcctcatgataggtcacatgctgatcttggtaacttgtggttttaccagctaaaatgttggataatagaggatagatgaaggacaaacagaggatttaattagcattcctttgggattggcaattgtagatacctttggtttaaataatttgctaccttgattttcagagaaatgctatatattacctcttttaagggtggattcagtaaaaaatattgcagatgtcactaactagataaacaatataatgttaatgttttatttttctttgttctaaagaatattctgtaacgggattagcatagggtcattgatatcatctaacacgacctaatacaattggatgcatatccatccctgccccccccccccccccatacaatttcacatgaaaaaaaaaatctagcctagtctcttgataaggatcttgtgcacagagaagcttctagctctctctctctcatcgccactgccgctttggttcagctattgcaatgggcatatgtagacaacagagtaagaatgggctaacactggctatgtgtcgagcgcaaagactagggttgtgtttagttggatccaaagtttagattttggttgaaattaaagatgatgtgattgaaaagttgtgtgtataacaggttaatgtgatggaaaagtactaaagtttggatccaaattttagatttaaagacagcctagctatagttgctagtggagagctagcagatggatgtagtgattgaaccgagcgatgacataataggatgatagttggatgcatcgaacatggagaacacaatcgtcacttcgatcatcatcctcgaggtcacaacttctgtcacccccaacaaactatgcccatcgcgtcgtctttgagcgctttgatctcaagtccccacgctagttgacattgcttttctatatttgttatcgtctcgccgcattcctactgctattgttactcccacagtttatgcattgtcttacatgtactccataactctatggatgagtatacacttgtctagtgttgcttgccttggagtgcgcatgtagctagtgacaatttaattagttgctggtcaatgctctctattctctccttttatctcaacttatcttttctgtcagcatgaatgaatcataaccatctaaattatctgactgtatttgttcttatgtgacaatggccttcctgcaagcatatgggattgcaataaattattgtcaagttttacaataaaaaataagattaacatttccatatttcaaacactgtatcctaaaaaaaatctatgttttccaataatctgtttcacacgtataatctgattctaatttttcaaaattttctatccagcatttgaatggtgtttccggatgtcaaaactcaaaacacagcaacatgagagcaaaacacactgtaccaaaaagtcaccggttgcgttaaaacaagaaaaatacagggcaacctgctgaccaaaaggaagttcatcatcaaacacacaagacacaacttgcccctctatcccttctcaaaaaaaaaaaaacttgcccctctacaaaaaagagaaaaaatgcacaacttgccacggccggatacccgtggaatattcgcgccagctccaacgccgctgcggcgcatcgaacaccaaacacaggtatagtccccacctcgcaccctgccacgtcacccgctaaccggaagcaccggtggacgccgccgacacgtgtcgacctcctcaacacgtggcgcgcgcggggtggaaccgcacggctccacccgtcctgccgccacgccgcaccggatccagtggaagcagcgcccagtgtcacggcctccacgctgcgttgccgcaattatgcgtcaccgcgtggggcccactcggcagtgagaccatgcaggctccgctgctgctgtcatcgcgagaaagcgattagcgggaggaggagtaacatcgaaggaaaccactaatcacggattattttgagcaattaccgctctaatccggggcgataagacgagggaaattactaattaagggaggggattaaccggtaatggtctttggagctggagagctttgctataaaagagctccaatggcgtccctcacacctccccgcccaccattcccactttcgcccacacacacacccagatccacagccatcctcccaccgccgccgccaccatctccaagcccacgaacacccacagccaccgtgagctcgagcgaggtaagaaaagctttagatctgagcgacttcgagcgtcttcaaggtaaagttttctcgaaaccctcttcttcttcttcctcctctggctcccccacctgttcttctacggtttcttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagtagatggctgcagctatagatctgtcaggggaggagctgatgagagcactcgagccttttatccgagatgcctccggctcgcctccggtttgttcccagtttagtcccacctcgccattctccttcccgcacgcgttcgcgtacggtggcgggctggcccagcagccagagctcagcccggcccagatgcactacatccaggcccgcctccacctccagcggcaggcggcgcaggccggcccgctcggcccgcgcgcgcagccgatgaaggcgtcgtcgtcgtcggcttcggcggcgggggcggcggcgacgccgccgcggccgcagaagctgtaccgcggcgtgcggcagcggcactgggggaagtgggtggcggagatccgcctcccgcggaaccgcacgcggctctggctcggcaccttcgacacagccgaggaggcggcgcttgcctacgaccaggcggcgtaccgcctccgcggcgacgcggcgcggctcaacttccccgacaacgccgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggccgagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattctgcaccgcacggacgggcatggattagcagttttatagtccctaatccttttggtttggttcgtttgtgtacgtagatcgatctctctccggacttgtttcctctgtagatgctagggttggttggtgttcttcctcaaccggagacgccgatgctaccggcagccggcgtttttgtgtccggcgtgcgtctccggtggccggtcactggtcggttactccggccgtggcgtccattgctcttctaaagtctgttattaccttctactgctgatcttacaggttgtaaacagtagtagtagcattattattattattatgtcttgtaatattattagcgtgttataagaacttgtaatgtgaattacctctactactactattattattatttagcgtcgttgttaaaattgttgtgtgtaatctttttctgatttcaccttccaacttgcgaagatctgcctgttgagttgcttgtgtgtgggggcagagaaacacttcgctttccagaaaggagaagacgaacaaactcgtctgtctgactgtctctgcatcaacgtcactggatttcggctagcggatgcagatctcatctcaacggcgcgaagcttcgggcgaagatgttcttcaatattttccgcttaattttctaccatgttaatccgaaagcgacgctacccgtggaccggtcagagtgaggctctcagcgggggcagcggcaacgacggagcacgtcgccgacgagatgctacgccgtaatgctttttttttcttttttcatcgcctgatttggatttcgcatcgctcccgtcaggatgtactacacggaatcgcgttctttagcctcggtttcaatgacaggacaccgttgatctcacgcgaacgtgccgttgcgttttactgtgtgtactacaaggaatcgaatcttgcaaggtatagtatgatatccgtgacgggcaacgacgataccgtgacaggcaggctcggtgcatcgatttcttcttttttttttttgatttgaatgttccgggcggagttggaaacagaggcgcgagagtggaggaattccccgccaaaaaatatcgagagattcgtagcagtaggtacagcacccgcaatgtaaagtaaagtgctatctataaaatatgtacatctcagcaatagactagattaatagtaaaccacctcaataatatgtctacatgggtatctataactctctcatgtattgccttaatatctttcaattagaaaaatatgctgacatggatatgttgtagagagtttatatataactgttgtgggtgtcataatgcacatgggtggcgggaaaccgcgtagcctcagcgtccgcgccagcgacgactctcgtactctctctctctctctctcctctcgtctacaaaaaggatgggcctcattggccccacccacgtcgccctctggatgagggtggcattgaatgcgtgtgttggtgggacccaccaccacgcaggaggtgggcccacctgccagtgtcacaggggctcagtacgcagaaagagagagagatcaggtaaaaatggaatggaaaggagagccgccaaggcggccacaggtgaaagccgacgacgaccacgaccaggcgtttctctgactagtgagtgatacactgatactcctacaattaactgtggtgctttggttggttgctttggcatgtggtaactggcaatgtggcacgcgcgctgtccgtcactagcgattcttgtagagtgtagtacaactatctcatcatattttcacctgatctaagggcccgatcgagagcaggccattagcacatgattaattaagtattagctatttttttttaaaatggatcaatatgaattttttaagtaacttttatatataattttttttataaaaaacacaccgtttaacagcttgggaagcgtgcacgtgaaagacgaggtggtggggacgtttgcccgtgggaacgagcgcacacttaaagccgtgaggcatcatcatcaatccggtggcaagttgggcttgtggcactgtctggctgcacactccagtagcagtagacgttactccttaggccatttgccgtgcatcaccgtggcgttctacaccgactcgctaaacttgggcatgtgttcttcgtcagttttagcaggcatgtgtcaaagcgaggcgaggaactggcgaggaacggtgcgcataacacgttgggagagggcgtgggcctgtgcttcgtcgctcccaacgcaacggtggccggatctgatgacgtcgatggcgtgggcatcggcggcctggggagaaaggaagatggcggcagcggtggaagaggaggcggtgaaggaagaggcggcatcatttataggtcctaacctcgttctcgttcccgttccgtaccgtcaacctcgtcgtcatcctccgctccaagccaccttggccagtccgcaacagcagcttgatgatggcctcctcgagtcctccgcctcccatgcttaccactagatccgtgccgtcccattctgtgccaccccgctccatgccgctgagcggccgtcccgctcgtagtctctgtctctccgagctccacgccggcgcgccggccaaggtaggatggacgccggtcgtaggtcaggggaggagtcctcggtcgccggtagggggaggagtcaggacatcagccggtgaaggaggggagggagccaaagtcgctggctcgttgtcgggagtgagtggaggagaggtcgagaggagataaggggggagagagacgggggagggaggaatttataattttgttttggagtctagggtctttggtataaattttgaacctctacccaaaatgaaaaaagtatgaaaactaaatcaaataagtggtagggactgaaatataaatttaaagccacacctaaaaccacaaattttggacctgtgaccctagcctatgtggcagtctgaggctcctcatttgactgggacacaatgtgaatggctttagtagtttacatcttttgattcttttagttaaaaacttattttatatatagagctctaagaaaacttacaccctctgtgctatgagaaactaacttatgagaattaatctggacaaatgtttatctaaatttatcttaaaaatagttttttttaactattctaggaatcaacgttttttctcggtgcaaaggtaatgataccgagatgtcttggtgtcaatatcgccaataacgttagcgttgacaccctagccccatgtgatagctaaatcattgacgtttagatgttggacttcgataacaggatcactagcgtcgggaaaaaaggtctaattttaaatatgtgcttttaagaatctatttacaaaataatttttaaaaggctcgaaacataatagaatccgacagtagtagggtaagtctggttgcttggctgggcttggcgttccatgacttctatccttgctgctacacgggaaaaatatacagtgcaaaccacatgacacatatgtagtggaaacctgaaagctatagttacataaaaaaatagacgtattcgtccacgtcattatgagtaaaattttgacccctaatgatggtagttctcgatgcaaaggtattcatacgtctattttttaatttgatggtagtttttgggtgtctactatatacgtaatttccggtgtatatttatactactctatgctgaatgctgaagtaaatgtgaaatggcaggcacaccagccactggacaaggaggtagggtcggcctcatctgcaactgatcaccggtcaccaccaccgttgggtaagtagcagcagcgtgtagtgggcaagtctcaaatacagtgatccttggtggccggtacaacattcttgatggcaaagtggttgctcacatacagtgatccataactagtgctttatttttgttgggaagtccaaatgatactcttttttgttgaattgaaaatagggccaattggtttggagccggtttttttgtcataccaaaatttagtgccaaaatgttggtatgttttagtaccactagattgatagtatagaatttgtatagtatgtgtaaaaattgatagcaaacaaaacatccatataacattattgaagttgccaaatttttttggtaggacaaagcactataaaaaaattattttcccatacaatcaaaaccaattttcgcatgtggttgggtcgccgcctgctagggcagcgcacctgtccgcgaaaatccgccttctgcgggcggtaaattatgtcgcccaccctcggaaagaaaaatcgctaaaaccctatctagctcccatccacaggtgacattaacactatagtctgctatcgctcgtcaccgtcgttgccacagaggccccgcagctcatactcatcgtcgtcgccctgcccccatgccttcaccacctccaccgttgccccttctcaccccggtagcagcggcagcgtggatccgcctgtcacggggatgctcgacagcggaacccattgcggcgccacccgacggcggatcccgcctagaggggagttagctgccgaatcctcgtgggagaggagttgagagagaagggatcgactacagtcaccgtcgccgagcttgagcacgctgtcagctgctcgggagggggaggcgagggagagaggaggtgagaaatgagagagagaagagggggggggggggttgagagagataaggatgaggaagagaggaggtgagaagataaggatgagaacttataaaattttgaagatgtggaaaggaagagagaaggacggtcaaacttttcgtaggcggacctcttaatcggcctcttgagataatgtattttcgcatgcagtctttgaaccgaccctggggaagcaactttgcatgttggcgcagtttcggcccgtcttcagcctagagggggtcttgtacagaaaaatcgattctgtagtagtgaagatttattttaatccaaacaagcccacaatcttaataaactttccaaccatatattatgtagagagaaacatgactagccaagtcggacatctcctaaatgttaaagtatatctacgaacaaccaatttgctcaccagcgtaatgtatgtcagcttgagcttcgaatgtttgtaatccatcccatccataatgtaaccattcgtggttgcaatggtgaccatatcctttactccttccctccgaaaaaaattaaactctaggatcatgtttttttataggacggagggtgtagatgtaaaccttagtaaagcaaatgtagagcgtttagataagtaaaaatattataatcaatactaaatcaaatttagtaagaaactagttaatcttttatcgtacacggtgtctttgtcactgacatgtggacccagggatcatcagacctacatttcagtgataaagtcatgatcatcaagcccacatttcagtgataaagtcatgtgacttcgactatagaggatcctgatccgattagttggcctctggcgtagcgttggtattggttgaataatcagtttaagtcttatctctctctttcatcgcatcagtatgtcttaacccgaaatcatacaaaataagtactgtatcaactttgccatatgaaaataacataatttcaaatattgttttcacctggaaagatgtgtaataaaaagttgcttttgtcaatggccttgggtaggttgtatcacccagagttacattctgcaatgtgacagtttgttttcttttaagacccaacgttttcgatgaccagagagagatagagtgagagagtcgttaaattgtggcccgtatattatccgtgaatcgttaaattgctgcagagcagaacaacgcaagaaaagacggaaacggtgccgccccactacgctacgctagtgctgttcctcctggtttttgtggacttgcagcaacgggcgtgcatttgtttatctgaattttctgattacatttcggcgtgcgctatggatggaggaggatcttcagatcaatccagcatccatcctttttctaaggccacgaattttcaggtttattcttctggatcatgttaagaggataattcagcgtcctaactttcagcttttctttctctgtgatcggctacgaagccaacggtttggtaaagaaagaaaaaggcaaagtctgctgctgctcatcactgtccactaatagtgaagttatggatcaaacatgatcagggttttgctgggggatttagcccggctaggcttcaatatgttgggcttgccgggcttcaatatggtagcaacaagaatgcagcctgtctggacaaagttgggagcctactcgtactgaacggcgattgttttttttaattgctcccactgatctatttatgttactatgtataactgatattggtactattcaatttcaaattttgacaacttcttttttccctaaaatatattataatacttgatatatattatgttatattaccaaagtgtgtatacgtagtgtttcatccatcatactctaatcattaaaaagcaatttattgttaaagtgagatgcatggtagcagttgacagtgtcattacaaaattataaagatggtcattatgctttaggctttatgcaaacaattaatatgctatattcggataactatatgggcggtcaaaatttggtacgctaatatttttaatgtattatttgggtaggtaaatgcaccccctttgattataaatatttttcatatttgattaaactttaaaatttataaccaccaataatttcataaatatttagtttaataaaaaaaagacactaacacagacacgtctacctgtgttacatctataacgggttcaaccagcaattacaaccaattggttaaaacgtggccaatcatcactaacggttggaggccctttacatatgaggtggctgatgtctataattgcttctcaactggagccgttacagataagtgctaatccctaatggtttcaatattgcccgttacagatgagtgatttgtaacggctcgcttaggcccatcgcatataaccgttacagacgtgagaatctaagctattgaaaataatataacagagttgccttgaaaagatatatattatactttataaacatgctttaatacaaaactactccctcagtctcaaaataagactcttttacttcatattttaaactagatgggtgcttattttaggacggagggaataataattaaaattttaaaggtttaatcaaattttattttaaatgttaaatatttatgatagaagaaagcataacattcttacctaggacacatctgattttggaaataaataaatatttatgccccaaaattggctcatggttttcacaaaaccagtgtaaacaaccggctgtctagatcgtagccatgcagctagctggctgccagggatcagtagaagtactctgtgcagtgaacagggtgagccatgagcatcatcactgatggttctttttgagtggctaagcatgtcactgggatagcccatgatcattctggatgcaatgcatggctagcttcaaagtgaataaaactgatctagaaacatctggttcttcatagccagagaccaggctacaccatataagagaccactatgtactttcttggtcacaaaaatgatttgcatgctcaactaacatggtcctagatacgctctgctgggtccagagacaagtgtctagatcgtggagaggggaatttcagtttatgggtccgattccattgtaaggattgcccccaacaccgttccatcacaatctagtgaatcttgggatttgatctaaggaggatgtctctactcggatgtagcacaacagtttgtttctgataagagatttgatttatagagtggactctgctcgggcatactgcaaacgttttattctgattagatagcttattcttttaggagaacacggaataaagggacatatatatattctacgcacatcaccctcacacagatcaagcttagaaattgctagcaaaacccaattgcccattgtatagctcacatatatactatcatggaatagcttacacattgaacatgtgtagcactaaaattggtttgtgccaaacttaatggcgcgacttaaaattggagtaatattctatttagttcggactacatcgtcgaatgataagtacggtatcaagtttatcgaaggtgatgttttagaaaccatatgtattgggtgccacaagttattcagatttgtttcagttttttttcctttcttatttttcctgcattcctagttagtgcagatcgaggacatataagtattttttttgtgaggatatatgtatttttttaacttaataaaatctgcattatctcgttctattattcatcgtctgatcacatgcatgctagtttctgataagaatagtctttcttcaatatttgagggaggagaggggattgcatatatgcaagtgcagaatttctacaacaggatgagttgtaaagcgcataataattcaccgaaatataagaatgcacacatgcaagatagatcgagaattggatagatccaagaatgctcaggttggtatgtattaagtccattgttgtggtcgtcccagagcttagctattgtccttttaacaaattctaatccccttagctttatcatcaacttgcatgctctgcgtgtgcaagaggattccagaaaagaagaaaaaatgtgctagagtggttgtattaaggtagcagatttggtagtcctagctttgcttgatccattgctttaggccatgaaggcatataacggcagggataagcccagattagcaccacatgacatggaagtgaaaggcgtgtgctcaccaaccatgtaaccactcaaaatctcacccttttcttttgtccacaaagctttttctatatgcaactatagtcttaattaattaattcaacaggaggcatcttattaccatttgaaagctagatatatgaccaggaggcatgcatgtacacatatatagctagctagctatttgatttgaacaatataaaggccttgataagtgctactaatccataacaacactagtagtatccgggttctcaatcacattgtggaccattttggcatatcattttgtgcgctcaatcttgataagtactcccttaagtttttgtttgcaacgtttgaccactcgtcttattcatttttttttgaaattattatttattttatttgtgatttactttattatctacagtattttaagcacaacttttcgttttttatatttaaaaaaaaattgaataagacgagtggtctaacattacaatcaaaaactcaaaattctgggacggagggagtagttatttgtgcctttaatctgacatgctagaagggggtagggggagtgtattaattatattgtgtaactcattatctgattgcactaagaacgatctagctttgcttggcttgatagctgaactgctgaagtgcatttgccatggcagccatgcaaatccatactgttatactagtttttattatctcatactttccaaaagaaaaaaaaaaaggcctttactctccagcttttgttttttttagaaaaaaaatgcaggcatttgtcgttctttggccccacttgtcccaggttaatgtttgggatttaaagttttaacctcatttccactaggacattacgtgttgctttgtatccatcgttagcagagtagagagtgtgaatcaagcgcacatgggttaatccagaatttcagatccatcatccttgtgcaaaggaaaggatatatgatttcaacatacacaagagctagtgtgaccagtatagcagagtgtgcaaattacccccttccccgaactatcgcggtcgatcgaattaccccactgaactcgaaaaccagatatcgctcaccataaactttcaatactggacaaaagcaccccctaactcaacatcgcagtggttttggtcctaagtggcagtccagtcaacaatttttattttaaaaatggtggggcccacctgtcatagtctctcctctctatcccctctcacctctctatctctctcgtctatcgctcgctcaccgctgagaatgagtggagcacgcgccggcggtggttggcccgacgcgatgggacggctacagaagccggcgaccgtggaggcgaaggcagcgcggtcgaggactagcggttgcgagtctcctcgaggcggaggccgaggatgaggcgtgccggcggtggctggcccatcaggctcaccaggcctcgtcctcctgtggttaggggagtagcggccgacaccggacttacgcaagaaggcagccatggcggggaagaggggaaacgcggtggggcggctgcggaggccggtgaccacggaggcaagggaggcgcggtcggcggcaaggccgaggcagctcggggtcgcgggtgagcgccgtcggcgggtgaggcagctcgaggtcacgggtgagcagcaaagagaagaggagacgagtggttcaccgtcgccattgaggtcactgttcggcgctgaggcggaagcggtggcgctgctaattctcccttccctggagacggcggtgaggcctccccccctctctctctctctccctcctccttctccactcaggcaggcggtgagcgacaaatcctcctcggggaacgcatggcgcgcgtggtgggcagggcgaggcgggcggcaccgaggacattggaggcggcaggctatcgtgacgagtttgccgcccatccccgtcgtccccgtgcccgattgttcctccgccgcctccgctccaatctcctctccttcccgatgccctcgccggcggctctaccccactggtcccgtcacgacgtgccctccgcaatctcgccgtgcaccagagggaagaaagagagaagagagattttagcagtactccgactgccgccgcatcctctgcgtgctcgctacgccgcccttgtctccgcctccatgccgctgccggcacgtgccgccctcgcttccacctccttgccgctgccggtagtgccgctctactgtgtcgctccgtctccccctgccgccgtgcgctttagaaggagggagaagagcgccgcgtcgttccctctccccagccaccacccgctttagaaggggatggagaatagagaggtggtggggattctaacgagtgggatctagcgattttttttaaaaaaactgatgattggactgtcacgtgtgctatttgaatcctaaaccgcttgcaacagtgagcgatatctggttttcgagtttagggggtaattcggtcgatcgcgatagattaagggggtaattcgtactttcctttatattatggattgagaacaagaggatagcttattcttcaacgcatccttgtgacaatctcctgcactcccagataaacagatcatgcatgagcatatatatcgatcttgttagaagatatagctagctttgattgtcagtcaaagatatggctccctttttatcaccatcacagtcaggggcaacatggctagaggtcacttcactatcaaaggtcatggatcgagtatactgatccacttttaaatgccgtatccttacatactccctccgctccaaaagtctgtctaaatttgtattgtagtactaaatgtgttatatccatccaaaaatctttatatatttggatggatatactacatacattttgtcctttaaaacataataactaataataactagaaaggtggcccgcgcaacgcgcgggcatccatattatttaaatataagattatattttgttcgtaagatatatcttataaattaagggcaactcaaggtcacacgtatctaaaaaatcattcatcgaaattttaatagagaatagattaaggtcacatgacatttgaatcaactgaataataaaatgctgctaggtaattatcatctctatcatttatacacatagtgtgacagtgtgaaatatgtctaagctaaacttgtgagagtaaggaaatcaaagttctttggattgaatcgtctcattaaggcacatgatatattgacaaccaaattaaggatagatcaaatgtttgattttttttcctatgtagaagttcaacaaattcattttttttcacagttttgaagaaatttaatggtatgttcagacacatatcactcacacaattcattggcttggtaatgcaaaatattagcaattgtttcaagataatttctttctttttttcatgcttgattgttttctttgaaacaacatttgtttgaaataagatcaaaattgtataaatttgattagtatgtgtagtgtacttatacatttgaagtgttctatagtaaagtttgcttttgtcatataatccaattgtatcaaataatattgttttatcatgtaaattataatcaataagttcaatatgattcatatcatcataattaatgaaacttagttaaaaaatatgactacctaaaaattattgttcgcttattttgttttttttctccttacttaatggtgcctttgtcattactctgaatcaaagaaaaagtggcacatcataccatggctcatatatagctataagctattactctatgtccactcattgctcagtagtgtccttcactcaccgattatcttgtgatagtcatatagacaatatttatcaatttgtttagtttacataaagggcaacaccacattgctcctttctcatgcatggtcatagagtccaaaatgatttttccaaataatgctctgcattaacacatgtatctagaacattaactacataacatatacgtgtggaacacatggtagttttcgttctagattcacccttatttacatacatgtaaagagtgtaatgacaatcaatactgacacctattaacaattgttatatacctaattagaatatgtcttaattatattcatctcatgactctgactatctttgatcaccttgagtagtagaaaaaaataattgtactgtgggtttaggatgggtgaaactaatggattatttgatttttatgatatctatttgagggtataaatgaatgaattaacttatacaaatttgaaatgttgttctggaaaaagcgctttaagaaaaaaaaaatagaattgttttcccgaaacacatcttttaggaacatgggaaacatgcaaatgaaaatacaaaatctagatcgaaaaggaaaaacagggagtaagactcccttatattatataagtacaattaggtaatcaacccttcgttttagcttacatagagttgcatgttgcaaaaacttaacccaatggacttcattattttccttctgcaatagtcgttcaatttgttttcactttattaacaaaacaatcattatccattgatgatttgttgtgtcctcaccttggcaaactggtacggtgtggtgatcgtgatcaccttacttgcctcaatctggtgcaccgcattgtcgtggcgcacgcatgcatgtgttgtgtagaggaacggactgatgtttttggaggatttttttagaaaaatagatctgatggtttattatctatcaatttaaatgaaaatcgatagtcaaatattttagcaacaatatagtctcaaatattgggcccacttgttggtttaaatataaattagtcgatatagattataaattgttaatttaataggtataaaatataatggtgtaaaattcaaacaattttatatttgaaaaaaaaattaatccaccagttcaagtaaaaaaattatcttatattattaatttaataggttaaaaatacaattttttaaactttacttttaaacattatagagctaatttttagttatatttatttgtaaagagttaatttatgatgatatatatagtctatgtttgtaaaattataattattttaaatttattatcactaatataactgttttatcacatgtacatggagaaagttggaaaggagagagaagcagatgtatttttttaattgatgtatataatttgtgtttttatgtttttttggctttaatcttcttttattgatagtgcgttacttacgtactttgtattttgggggtttttttttacgatcagtactttcgtgaacgggagattataagatggaagttttttaaatagatctaatctaacagtaaataacagatcaggtgttttgcttgtgttttgcttttcttttagaatttataggaatttctttaatttattaagtgccacataacagcttgagagcatttgtataaaatttaataaactttttatatataatagataatagattgataaatacataattgaaatatagaatgataaagagtgttgattggatatcttatatacgatctagtttaaccgcatatatttatagagcgatatattttatttttaaatagtagaaaatcctactttaaaggccatcaatttttttaatgacactacgtacgtatgttttttctttactttatcgcttttatccggtgaagagtagataattaagcttcatcgtttttatttcagatgtatgtacgtactgaatactttcctttttcttttccgtcccacaggaggaaactattactttttaaaataatacatctaatcgaatggtccataatatcgggtccaccaattttaatgaaaatcgatgctaagattaaatacgtgacgacctaggagtgtttctaggagcgccacatgatggcttaacagtgtttgtaggaagtttaatggacttttagtatataatagatagatagatagatttctgactataaatttagacatgggttattgaggttcatagctagatttttttttaagatggcttgagtatatgcaacgagaaacaaaggcatgcatacatgtcatcatttggttaattagactattgcaacttgcaatagctacctacctgatgtacgtcgaagcaagtacaagttgcatgcaagctttattgtctgtgtctgtctttaagaaaattaaagcagggagactctaggatcagaaagaagaataagctgttcaaaatagaccaactgttcatgatgcttttcaccttcctttcgttaattagaagcatataatcccagagatttcagcgtcaaggggaaaccatttgtagcttggtagcacaggttatataattaaagccaccaaccaatcatttgggctaagatcgagcgatactgttacggtgctgttgcatttacttttgactaattaatctgcgagctaccaggccaaatggatcagccccaatgattaacaacgctcatggattggaactaattacacagattcatcccgatctgcaggtaacaaaaatatgcgaacctttctgcagccaatctatgcaatggtacagaagtgtaaacagataattggtggcttgcagagaagatgaatctgaattatataagcaggttgggtgcttcttgttggtggccatgtgagtatcagtatgtgacccaggatgactcggatgacacagctctgctcgccgaccgatatgaaaatgacggtgatcgactgcgactgccaccagttggcggcggccgaacgagaccccccgcgtcgttcctcgtcgtcctccaccttcggctccctgcttaaactgcttcgccgacctgttaactatttggcaatgtacctgtgattggctccctttcctaaaccttccgatcctgtttctataaatcggttgagcgttctatagaagcttgatgcctatttgtacagctaccatgtatcaacatgcatgattatcgcattgagctgtatcatccaacattccctgctccggcggacggccctgctcgccaagccctggctctgttggtctctgcctctgtctcaaacagatgttgttcgagccattgactggatggctaaaggagaacagagagaaggaaggatgataggacgacaggtgggccctgtaaattcattattattatttttctgattgggatgtcatgttggcaccacgtgtaccagtttaagtcaagacaatccataagggataatttatccggtacaaaaagcttagggtgtaaaatatttggttttgtattttccgggggtaaatcggattggcacaatagttcagcagtgtaattcaaacttttttttttaaaaaaaagttgttctactattttttactctctatcccaatataactgcaacatagtaaacataggctctatttagttcacaccaaacttcctccaaactcccaacttttcatcacatcacatctaaaacttttctacacacataaactcccaactttttttttccaaactaccaactttccccaaacttctccccaatttcaggaactaaacacagtcatagtatagatgtgatatttgtactaggttgtatttatattgagacggaatgagttttaaagatagtcaattcgaatatgctaccactcggtgacaatgatgcatataaaaccatctatgtaccctctatttaggggggtttgagattctgagaattaaccaatgataatcacttagtaatcaatttagcgaagctgaaaaatgcctttagtttatttttattccacagttgctgattcttcaaatctagattgtttggagtagctgtagagatttactaatacacattgtgctgcttgaatctttttcaaacatgaccatagactagatgataaataatcatgatctctctttgccggagcaatggagggactgggagaacacataggtgagagtgagtcgatcaaacgaaggacatggggtctgtttacttcttgccctgaaaatcttgcctgactcagacgcaattctccgacatctaattttgtgtctgcagctggatcgacctgcctgagcgagagccctcaggtcaaccaaacaaggccatgatcccccgccgctcgtgggcgcacgcacaggccatgtgacccatgttagtaggccgccgcgcatcgatctggacgcgcgactgcacctacgacgttcgcctgaatgcaagcatgatgcatgcacccgtagacgttgctattggagatatatcctatatgcagtgtagtacaagtactatggtggtagtacgtactatattttgctgcttttgataacagaggattatgagaaaaaaaataccagtaagaaaaggaaaagaacatacgtgttcccagtagattttggttgccaacagtgcgatgacatagtaattaccggcgaattaaccatgacaagctgacgcccaatggatgaagtggccgagctagcactgcagattaaacaacaaattaacctgcaatggccaactaatttagctagatagccaagtttccgtgtcagccatgtgcgcccgaggagggctaccttgtgcagctgccggaggatcgatcaatgcagacatgcgcacattcatgcatgcagctgcaggagcatgcaacggcggctggtcttaattaatttgctgaattgagctgatctgcatgcatgaacgcgtgaaggcacaggcagagggccggccgttggtcgcaatgcagaggcagctaggcgcgcgtacagtgatctgcctcgataccgcgtcgatccatccatcggctggtccgtcgtccgtccgtccctgtcgcccacgccggagcctagagatctgtcggcctttgggcagccacccaacagtcaagcgtcgtgcgtggtggctggaccattttctcgtagtaccaaactgcgtaccaaaccgatcgatcattaactaccttcaagagtactctctttactgtactattcataatcggaggccgtatgtcgactaaatgctgaggtggagaaaataagaaaggagagagaggtgaagcgggctgtaaacttacagtcggcttggatgcaagaaccaaaaaattctgtgagagagacaagtgcgccatatattaattgtaagagtaaattgcgttgacggtacaagaacttggcgggtgggtgcgattaagtacaagaacttgaaaattagacatatcgatgcaacaacttggctaggtgggtgcgtttgtggttcaaaagactgccacataagattttttgccacgtcagctttccaccttggacaaagtctacgtgagggccctttacacatcatattaattttgcacaaatcccctgttgtttttcccatttgaggacattttctagtacggatcaattaatcaccatgagggataggacctcaaatatgtagcttccggctgcagcggtcggtgggactcaaagccggcgtgcggcagcagtcgtcgggactcaaagctggtggcggcggtcctcgggactcgaaaccggcgtgggtcagcggtcgatgggacacgaagcccggccacggcagccgtcaggactcaaagccagtgcagggggttgttagacctcgaagccaccatcgctgcccatggccgtagtaggttcccttcaactgatgagaatctgaaccttccatttttttgtgctgtaattttatgggattcttcgtccatagtggaatcagcatcatgataactgcatctggtgtaccacagtgagaggactctttgactctttgttgctgtcaaagcagtatgtgagtgaataatggcaatgtaggtgcttttgtaaatactctggaagtgcttttgttatataagggatacatgaattttttagctacttaaatgaatggtgaacacgatgtagcaaatactgcttgtattctctcttttggaattgtatgtccaagtgataacctgaattttgctaacattgctttgaccagtagcaatttctgtacagacatatgtggtatgttttcttgtccatagacaaatcctggcagaaatgtgctcctaatattctgaaatgttttaccataaatagctgttgtataaacaggaaaaacaagagatgttcctgaattggaacttagagcaatgtaacagagcacagtccaaaatgaaacatgtctgattggttggcaaaaaataaacagaacttctggctaaattataagctaatcctttttatcaagttgaatatattgttcactttttctttgtctcctcccttttcttcaactctgatttcttattgggttgcgtatttctcttccttggctcagcttttctcttccgaattgttgccctgccctctttggttgctgtcgttattggcggctgcactgcagcttttcggtttgtggcaataaaatttgattccggcagtggaccaaggtcaaatctagaagagttgtttataatgttctgcagaaagtacattgaaattgtgaaaactgttttataaagctataaaatggaaaattggcaaagcattgtctaacctctctcgtcaaggaagacaatatggtattttgtaactgatcatagctaggttgtgtcacgcccagaaattcacgaaccagaatttctaagctgaatgtgtattaaacccctgtccaggaccagccagggtacacaaacgacaattgttgacatacggatccacgtcttacaaaaatacaaaatattacaaatgcagcgaaaaaggtaaaagcgagctaagcctgaagacttgactcctgcagcgggcaattccattccacaggcaacccttgacggcagcgacgaaaccaacctcttcaagacatctccaactgagaagaacttcaactctggtgtgggggaaaagagcaagactgagtactacccactgtactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttcattaagctaaactaggggtgagactaatcacggtgaatctggtcgaccacccataaccgcgggcacggctattcgaatagttttactctgatcagaggtgtacaactgtacccacaagacacagccccacgacacgttcccatgcgccgacatgccaccacgacataccggaaagaggccgtgacaggacctttcgcataaccctttttaaccgatagcaccacaccttagggttcgcccccgtccccagcaggcaacgggcagcccccctttcgtgccgcggtgaatccggaagccgatcaaccggacaccccggccgacccaactccatcacgcccaccctcacctgggtacgtcggctagagaaaagctacactacaagcccagccgttgcccacgctggcttgtggtaagtacgataagttcttccagggcatcccgcgaaccggtccttaatcgccatgggcacgactagcaaaaccatgcacccacagcccaccatgtagtgtattttaattaaccaacaccattgtggtggcactaatccaaagctattgccaataatcaaagtctatgctttaatgtgatccccttttgtgcactagttgaactaagcatggctaagcatctcctaaaccaatatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatgga

SEQ ID NO: 21258 - DNA, 11538 bp, Oryza sativa
agggaggggaacttcaggcgtgacaggttggctggttaaaatgctagtctgactgttcagaacttcaggcatgacctgcagaggcataaaatcttcattaccatgttgttgtgaaggagcagcactggcttgctgcttttctgctcatatatcttccttcctcttcttgcagcccttctttttgtgattaactccttgacagtagctacaatgcatttgcacaccatgcttggatatttttgttcctccttcaagttcatgtggctgctttcttctacatctcctaggccttccaactttcttctcataaatcggtgggttcaccttggtccattcatcttcacccaagatgccttgtccctaacaggcattatgttaaatccataggcctccatgtatttttcagttgaataatagaaggataccacatcttcaggttttgtcctctcactcctcaagcaagaaattgcatggttgcatggtatccctatcaattgccatctcctacattcacagtgttttgccatgaggtcaacaatatattggtgttctttatcagttgcttggaacacccctttaccagcaggtaatatatagcatgtatttgacaattctgcatttttatcaacctttttctatatttttgggcatatgtttcccgaccacttctttacacactcctcttgtttggtatgtatcctattcatgatttggctcctaatcttttcaagcatggataaaattggaagctctctggcttcaagaatgtacttgttgaatacctcggaattgttgttgagtagaatatcacacttggggaaatcactaaagaatgctctgcaccactggttgggtggtatttcctccaggtaggcataagcatctttgctaagagacttcatcttttccatgttaaattcccactctggtatagtacttgaccttgcaattgcccacaactgattctttagagtctcccctttgtatagaacatgaaaattttggtacaaatgcctaacgcaaaatctttgttctgaatctgagaatttatccctcacagctggtaccaatccctacaaaatttaaaaaggaagggtgagtaccaatccattgaacagtaaataattcaaatattttaaaaatgacaagttgaacaaaatcaaatatgatggaataaagtcacaccttctgcctgtctgtcatgatagtataaggtccagtgttgtcgataaggagatcttctttcaaagtattcaaaaaccaaccccaactagctctactctccacctccacaacagccatggctataggatagatgcagtcattaggatcaatgcctactacagtcaacaaatgtcccccaaacttggttttgatgtggcatccatcaaggaatatgataggtctacaactacttaggaatcctcttttgcaagcatcaaatgacacatagcatgtatggaagcacatattttgtaggttcaagaaaaatttactacctggatttgaagtcctaagctcttgtccataatcccacaacatatcgtattgtgctatttcatcaccatatatcgctttcatagctagtttccttgctcgacctaatttatgtcttgatggtgttacatttagttccttttgaactaccttagagaaactcttgagtgtcatcctatcattatccctaaagctttcaacatatctatttgcaagatacctagcagttacataattcaactcccactccttctgacatttgtggccatctatatatctttttaccataagacaattcgtcctgctgtcctcagctacatccaacatccatgagcactcttctttacatttagcctcaatttttttcttggtatttcttgtaaatttaattgcgactctattcttcacactgtattgttttattgcttgcctaacttcaatagcatcagagaacaacatcccaaccttaaagattggtgactccatgtccacagcagccacaaagttcttaaatttcaacttaatgccttcattatcttcatcagatgactctggaagcaacaagccttcatcatcagagtcatgttcaggaagcttaacaaccatcttgctgctagccacttcttctatctcaacacagttgtcaaaaacatcatcatcccccttgttagcctcataatcactgtcaacaaagtcaggatctacatcgatgtcatcgtcatcgtcaatgtcatgaccttctataggtataacacctgaatctttttgattcattgtagacctctcacggctagccacgataggtatagaagcaggggtagaaagagcaacatcatcccaattgatggattcaagaatgtcttggtgatccacatacaaaagcaatgtcctaaaccttggtgctaatacaaccatgctgttagtgcttgcatcagagttaattctccttagcccatcactgaatgtcttcccaggcaataaccaataaaccttggccttctcagacatatcatatcctagttgctcaataaaatcatcaagccataatgaagaccatgtgtcactgtcacaataatcaaaccaatccaccttttcattcaaataaattttgctactaccaactccagagaaaaaaccaccatgatgtagttcagttgtgaactgttcatcctcgcagcctatattacaagacaaaccattctgatgtgtcaaatcgtaaataattatctgatctattatacacaaaaagattatacagagtacatattcatgcttagagcaaaaattatttctaatcacaaactattcgtgaaggattacttatatgacacctagccttataaaacaccaaagcagtggcggaggcagcgccgggccaccataggcaattgcccaggctccatgcatacaacaacactgccccaatgcatatacaacatattactcattaatcatatacttaatcactttgtctcataggttataatggagattaattagatgaataaatagaaacgaggaagcaaggaccaaaccatcaaactgtagctacagagaccaaactatacaatcacaagattcaagaaaaaacagagaaacatgcaattaccggtacaaatcaatgaaaccctaactttatcaacaacaatcaattgaaccaaaaacgaaaatatgtaatcactagggagttatttaccataagaaggaggggacgccccaagaattcgccgagtcggcgccatcccagcgcacgaggcgatcacgtcagatcagttcgtaggtctgaattactaagcgcaccagtttgggatgatctcagatcagcgtggctcatatatgatgccctcgcaaccggtgcagaggcgatgcagttttgctgtgcactcgctgctagccgccgtcgcctcttgatctgttgaggtgagtaaatcacggatagaaaaacagaaccaaggcacacatattttttgctatgttaaaacaaaagaaccaattagaatataaaaactactaggaggttttttgtaaaatgagatgggatatcactccatgatgctgatgctaacgtgggactttgtccaaggtggaaagctgacgtggcaaaaaatcttatgtggcagccttttgaaccacaaacgcacccacctagccaagttgttgcattggtatgtccaattttcaagttctcgcacttaatcgcacccacccgccaagttcttgtaccgtcaatgcaatttactctaattgtaaatagctaactattatatgtgtgtggctaagagaatgtggcaaagaatcttatagccaacaagtcggctgtattattagccttgctctaagtagtagtaggagatactccctctcagtactcataaagaaagtcgtataggataatgtttaaatcaatcattgggaataaaatcatgaataactcttagtttgtttagtttgaaaatgtaaaaattatatgaatagatttgtcttgaaaaatactttcataaaagtatacatatatcacttttcaataaatatttttatagaaacaagaagttaaagttgtgttttggagaccgtgtcgctgtcgaaaacgacttcctttacgagtacggagggagtattaaattccgacaaataattctctaaattattacgagaatatccgaccatcgtaatagtttagagggattaatcgtcagactttaatgtcttctactactcatcattcatgagctcataaaaactaaaatttatgaatattccataacctttctacttttcaaaccagacaataagaaaaacccatataaaactagtcggcggtagatttggtctaagctgacttacttgatacaaacgtgacagatcaattagcaaaaagcattaaaaataattcatagaacacatgtcatatgcatcacctctccctctctttatctccttctattagacggaggcaactggaggcttataattaggtcgaggacaacgtctgttggcacaggtggaagcagttgaaagctcaggctgtggagctcgagctcttctctcggggatttgcatctggtttaacagatactttcacctagtgccaagtggagcaaaataatggtcacacacaacaccatatcataaaaggaaaaaagatatcacaaacttatttttctcaccatatcataaaaggaaaaaagatatttgtaaaacatgtgttctacaaaattaaactattgcttcacccagtcatatgcaatattatttgagaacttattttaatctcttagagagatgtactcttattttttacatgtcatatagataattaaaaaataataataaaaatataagttagattaatatgtgatatatcattctaattgtttttttttaattttaacttgtacgagtgataatttgcatgcttgtaaaatgatatatcgcatattatatattttattattttttaactatttggatgatatttttttttagaaaatggattaaaatccggcattacatccacaatgaacttacacagccggccactatttggatgacatatatatgtatataagaaatgatgagatagtttagcatctattttcgtattatttcctttgcagcggacatagtacatgacccacagttaatttttggaacgagtaaaaaaaataaaagaaatgatcgagatgacccacagttaatttactcctgactgaatcaccggcgggcaattcagctatgcaagtttgtcgtgcatagcagtcactactgttagtcctgcataatcagacaaagacgcatacgcattgtcgtggagtgagctagagccaatgtgcggcagagtgtgttaccacgactgactgtcactgcatgcagcactaataatcgcttagcatgtgatgcacgtacacattattgtcagtcaatgtcatgtcatctctgcacggaccaatattatctgcgccaatcaggaatataatcaactcagctagtactaattgttgattactttgatcttccctttttttggctgtattcttctcctctctttttttctttagcttagctagaccagtaggagtacgttgtcgtagtaatagacgcatccaattggcttgatttgtctcgagcatctggtttccttttctaacaaaaatcattagcgcataattaattaagttttaattattataaatttagaaaactgatttatttgatatttaaaacaacttatatatagaaaattttctcacaaaacgtattgtttatcaattttaaaaaatatggaaataaaaatcaagataaaacctatttcatatgtccctaaatataagagattttgattgaatgtgaccaatctggataacttgtccaaattcgttgtaataggatgcgttacatctaatcaggtactccctccgtttcgaaatatttgacaccgttgactttttatcacatgtttgaccgttcgtcttatttaaaaacttttgtgaaatatgtaaaattatatgcctacataaaaatatatttaacaataaattaaatgataagaaaagaattaataattacttaaattttttgaataagacgaacggtcaaacatatgctaaaaagtcaacggcgtcaaacattttgaaacggatggagtatataataacaaaatagcacgacctagatccgaacaaaatctctccaggctccatagtatttatctgagcaacttgtgtgggcggcgagaggcagctttacgctcactcaccggccgctgatgctgcccatgtttcatcagtacgaggaaatgcaatgtatactactatctacatattttatcttggcacacagatcaaggataaataattctacttgtcatctatttaaacatgctactagtcattcctcgtaaataaacaattcattaatatttacatttctcaatgcctatgtagccaatcatgtgtggaagaatggagagtcacacattaaatccgaaaaaattattaaaatgatagattgttggattgaaatatgactactaaaaataattttttcagatttagaaatatgactatcaaaaataaatggagggagtactccccaaaccagctacacacaaagggagtggtcaataattacctggtccatcgatcggttccgacgattagtcagaaaaagaaaaataatcaagagaaggccaatgagcatcgcgatttgtgttcgttcagatcgccaatcgatcggtaccatgattgtgattccaacgacggaattgttctcttcctagcctcagggccctataggcaattgattaaccgtcacctgcatggatacactgtacagtacctgagtaccatacggggttcaccaagaattctgtcaagttgaacagtattgtaagtgcaagtagaataaaaaactataagctagctaactacaaagacctgtggaggaggaagaaaaaatggcttcatatttattgtcagttattaatagtactgtagtactccctccgtccaaaattatagggcaaataaacccggtagcttttgactaataatcatactaactatatctatactaattattatgtacattatatcactagatttatattttcaagtactgatgttaatttcatatttcttggaatcatagaataaaaaaatactagtcaaaatatattattgaaaaccgtgtaaaaaaatataggttttataatttggaacaaataaagtatatatttatatgaaactactatgtgtaggctattatattagttataaataacatggttaatttttagagctatcagctgagtatactattaaacgttgctcttatgtcgttagctgtgatatgctgcctcgggcaacctagaaaaactcgaggagtcgcgcggccacttgcggttgcgggggaaaaaaaacacgaaagcataggcatccacgcgatcctacgatgccagcgcgtgcggatgccgcgcccaaaaaccggtagctggtttcgccgccccgtagggagcgcaggcagtttcacgcgcgcggcccttgtttcgctccgcgcaacgcgcgcgcgagcccaaaaaaaaaaaacgacgggggaatcatcgcctccgctgctgggttgtggcttttttgccttttggcgcctagctacgtaccaacccacatcacgcgcgtgcgcgtggtggcacactggcatgcatatggttgcggggggaaatcggggaaaggaaaacgcgcggccctcgtagactcgactctctacactcgcgcgaggcgagcgatgttggaggggaggggggttgcgtgtgtgacaccgctcgggttgtccctctctcgctcgcggatgattccctcgcctccaccatcgatcaccaccaccagcagcaccaacccaaccacagcctacgcatacatgcagagcatatatgctgctttcctttccatagcctgttgacaactagaggaacacccggggtttttcggctagcttcataagatgattagtctagatgaactggattcaaaacctcacccccttttaattatttgatattagattattttctaatattcgtgtatttttagcctatagccattatatattatgatgacgataataatccgacgacgtctaaggatgaggcaggttaattgggatttgtcctcgcaaaaaaatgaaaaaggtttattgggatttgtgaggaggatacgactacgaggacgatgtttgcatgttgacctttgttgtggggcaggtcacaccgggcaacaatcatatgtgccgcaccatgctagagtgctttattttgtttttgttggttattcgtgtgagttatttaatttgctccacgctttttaaatatttaatttatctctataatcaagaagataatccatcaaaataatatgcttaataatcatgtgtgctgtgatatgcggcattgttgtttttgctagtattccataaaaaatattacaaaagccaaaacataaatcaaatatgaaaatttaggaaaagcaaaaccataaaattacaaaatagataaattaattacacatgataagctagtatgcgttgatgctgagattctagaggattctttttcaatttatttcttcaaaactaaaaacatttttatgctctctctctcccctctttttaaattgtatttgacatgtagatctcacggagtaggttgaagcccatttggactaacccatgtcatgttcagggactcaaaaaattgttttttagagtgtagagattagatgtcatacccacataagtttagggactgcccgtgcacttcacttttttttatgtgtttgtgaatgtaaacacaaaaggaacacaaatttagattaatgcatcgcatctcatttgtactacactaaatgaatatcaaacaaaaatttccaaggtactgcacccgaagagatagggaatagaaagaacacaattttttgggaagatagttagattagaggaagacctttagttgagaaatatccaacactgtattacttttaccaaaaacattactagctgttgcaaaggaatttaaggagggtgggggaggggctatcaaatttagaaagaatatgcgaagtgagatagctcatctgtttagtttttctagaacctatgtacccggatttgagttctaaacttggtctttttataattctatggagagtaataatctgcaattccctttctcagagatttgaatgttgaaattacctttcaaaattaaggtggtctcatatatggttgctccttagaaatggtatccttaccaaagataatttccttagatggggctggaaaggggataatttccttattggtataataatctaattgtgaaactattggacacttatttatgaaatgtgctcaggcttgatttgtggagaacgtaattaatatcactttcaatttgggtgcaatttagaatatcccacacatatttgagggatgaaacaattttggaaaagaaatgaggaagctaatagaggtaggtgtataaccgttgttccgtgagcaatttggacaaaaagagaaatggtgcttttttttaaaaaaaaattactgctaatagaggtaggcttgattactcgcccgttggagcgaatcagacatgtctatttttgagtttcattccaaactattttaaataaatcacaggaagagacataagaaatataattttatgagtgagagatgtgggtaggtcagacgctaaataggatggcaagtgacatatatataatgcgagatatggccaacgaccttggagaagaagactaagatgaattctctaagtcttggcatgaaggttttatttaagaagaaatgagtgaaagaagtccagggttttggaaaaatgctacttatgtcatctaattttggaccattttctatttttcggttgttaaatacaatacttatgttaagtgttttttctctctgtagagcaacttgaaagacaatgggatggcattattaagtcaagtgtcgttgataatggattatgtactatttgcccatttatgtaaatagaaatgatagaggccttgacctctctttttggaagaagataacatgacttgagaagcatactaacatagactatcttcatgatagtgtgagtgtgatgtgacgtctcaatgccatttgaaatctgtaggaagccaacgacatagtctatttgtaccaccataaacattatctgcatacatattcatactagtaccaagtttaaaatgtcaaatgaaaaagttggagagaaagataaacatatattggggttgagagagggacaatacaataatgggtggagaaagtggataagtaaaggaacaccaatatttgtgtggacgatgaggctatcatgttacgtatttttacctatctcgactgagggaaactattttaatcccttgaggggatgtctcctcattgtttgcatgtcacttaaatggttatgaaaaaattgaaaaaatttaagaagatgtattaacatgtgatatatcactccacaaacatgcaagttcaaattcaactttcacatctcacaatgaaaaaaacaaatttgactgtgaatatacgttaactagttgtaatttaatttgttttttcgttgccaaatgtaaaagttgaatttgaatttgcatgtttgtggagtgatatatcacatgttaatacatcttctcaatttttttttaaattttttcataaccatttgagtgccatgcaaataacgaggggatattctctcgagggatcaaaatccactccccctcgacagataaataaccatttttttttgcgaagaacaataactttttatgacattattaatacagatgagttttatatttataccaaacttcaaataaaaatatttagcagtatttgctactcgtgttaatctctacagtacaagttctcaagaaaattacactttgccccgtggggagttctaatcttccagtatttctcgtcgctctcgatgcaattgaaaaaaatacacacgagttgtaacgaacaaaaaggaaaaaccgcacgggtttatcatcaaagctggatctgcacaacaaacagcctcgcaacagaaagagaatcaccacgggacaaaggcggtgacgtgtcacgcggcgcggccccacacgtccgcgtgggcccggcacgtgccccgcggcgcgggggccacctggcgccgagctgggctcgcgcgggtgtggcgacgtcggacgcgtccaagacatcggcgtggcccgtggccaccacccccaccggcgggccccgccgtcgccgccgccgccgtctccctcctccctctccaactataaatacctcactcctcctcttcccgcctccacacaagcaaaccaatcatcacctcttcttcttggggtgttcttgactggaaggtttctttggtgatggcgaaggcgagcgtggtggtgcctgagcaggtgggcgcggcggcggcggcgcaggtggggtgcccctgtccgggcacgacgctgttcc

SEQ ID NO: 21259 - DNA, 5017 bp, Oryza sativa
  unsure (1)..(5017): unsure at all n locations
ccgccctggccgccggagtcgacgaggagcacgccgcctggatggtccgtttccgttcaccgattgatcgatgttcgtcgcgttcttggcgcgcgcgcgctgacactgacatgaaccgtgcatttccgttcgtctttgtgcaggcgaggcacccgtcggcgctgggcgagttcgagaaggtggtggcggcgtcgaaggggaagcagatcgtcatgttcctcgactacgacggcaccctctcccccatcgtcgacgaccccgacgccgccttcatgagcgagacggtgagcttgagctcccctcccctgtcacctactctgctcctccactcatcatcatctcacacctctctccttcctcatcagatgcggatggccgtgcgcagcgtggcgaagcacttcccgacggcgatcgtgagcgggcggtgccgcgacaaggtgttcgagttcgtgaagctcgccgagctgtactacgcggggagccacggcatggacatcaagggccccgcctcccgccacgccgccgccaagtctcctccccacaacaagggagtcctcttccagccggccagcgagttcctccccatgatcgagcaggtgcaccagcgactcgagcaggccaccagctccatcccgggcgccaaggtcgagaacaacaagttctgcgtctccgtccacttccggtgcgtcgacgagaaggtaactgatcgatctgcaagctcgattggttgattggcttttttcatttggtgatcaattgatgatggaattgggggtgcagagttggggggcgttggcggagacggtgaggagggtggtgagggagttcccgcggctgcggctgagccaggggaggatggtgttcgaggtgcggccgaccatcaagtgggacaagggcaaggccctcgagttcctcctcgactcgctcggtacgtgcagtgtgttactactctacaactttgccattcctcgtcggcaaaaaaacccattggctctgctccgccgcaggtttcgccgactgcagcgacgtgctgccggtctacatcggcgacgaccgcacggacgaggacgcgttcaaggtaaataaatacttgtactactaaccgacaaaaattactgcatgctgccacgctacgactacgtgtagcagcagcagtaacacgagacgctaccactacttcgtttgcaagtggttcgacgaacgtacggccggttcgtcgcgtgcagctagcgacaacgtacgtcttcttctacgttggactaatcggcgagccgtgtgcatgatccgggcaggttttgcggcggcgtgggcagggcgtggggatcctggtgtccaagcaccccaaggagacgagcgcctccttctccctccaggagcccgccgaggtaattaagcaaaaccactcgtacgcacgcatgaaaacgttcgtatcactctgctcatgtttgtgttgcaattgcgacaacaggtgatggagttcttgctgcggctcgtggagtggaatcgcctgtccaggacacggttgaggctgtaacaattgaatttaaccggcgaggctagctagagagaagcgcgtgatctgggccgtccaagcgattacatcggcagggtaacccgtgacgctgatcgatcgtggattctacaccaacacaggtgctcgaaaatggtgtccacattgcagaagcgcagagagctaattaatcaacgacggacgagagaaactgatggctgtctggccattgttgtgccataatcctgtttagttcttcacctttctcccttcttcttttttcccatttggggccccccttttggtaccaaccatgtaaattccgtactactagtaccttgtcatgcacaagaggaagatcaatgcaaataatgaagagcaactaatgcaagtatatactcatcagcacattttctttctgctagcttagctatagctcttgctctgatctgatgcaccaatgatgcattacacatttgctttagctgaagaaaagctcagtgcactacccactgccggcacaacgtagcaacaggctgaaccgcatattggtcaattgggtgagtgtaaagcttgatctgctcgttgatggatgttgttaggacgagcagtaaactgggcctcactcacatgatcggtagcacggagtggtaccacggcttctctactgctctctgtcaatggatccaacgacacattgccttgtcatgttcttcctgtgaatcatgtcctcatctctgaagaagggcctgccagagcaacctctttcagcgtgttcttggtgggcgaagctttcactgatgcacaaaatgagcagcaatctttgatgaggttctgtgtgctcgttgaccactaatttgttcggatcgaaagctcgacaatgtcagtaactatcactgcatcatgctctcgcacacatcgagtgaatgagacatcctcgatcgactcatttaagtagattgcagtaataactgaaacgagcatcgattaaccaacttggatcacttgcaaacaagggaaggtaggtacgacgctgcatgcagattgattgatctggtcagatcataatagtctcgcttaaaaattgcacatgaatcgcactcattttggatttggatgggactgatctcgattgtacacgttgatctgccttgaagagttacacgacaaacacagccggcccacaggcaaaataatccttggaaataatgcagagaaaagattagcatctgcaagaacctcgtactgagaagctagctgttggatcgatccatggtgcatttttctgcatccacagtggggtgaaggacttaaggacaaagtgagcaatcatcaacagatatactagtacgagttaatcataattatgtgttagatccagtgctagctatgatctagtagttaaaatcatttcttcctcctaacaatactagcatatgcaccgataataatcaacgagagaagtgctagtgctggttctacatgcctacaatccacgcatcatatcaatcattaaggttgatatttcagtccaatggcgcactatgagagagcccaaaaagtaagaaaaatgaggggttaagtgattttactacacacacaaaacgactgtccacagaaaccatgccgatgtcactgataggtgggccccacgggctggttagacttcgggggcccttttgtcggcggctatataagaaatcacagtacacatacatagctatttttttcttttttttataacaaacttaaaaatagtcagatatttaaactgttgtcgatttgcactctccaaaaagtttaaactgatggtgaagtgatcaaatgccaccatccccattggccagccccacatcagaaaggagcaaccaattggtggaatcttggataatgtatcttgatatacacaagacataatatttaccatttggggatatcatctgtgaatcacagttagtgtgcttatggagaccaagtccatgtgaagggtagtgggtgccatggaccccaccaactagcttatggagtagagacaaagtggcaagcgaactgctatagaggggacagcgaccgaccgattgatccatcgagcgaacgatcgattgaatgtagccctactatcgagagacgtctggcagttcccagcatacggcagactgtgagcagcaacttgtcatgccttgncaatatatatactgtataccatactataaacagactgcaggcggttgcgcatgctgactagaacttctgattggcgatagagttcaaagtgccatacgaagaataagctgaaggagttctttcttcttgctttcgaagctcagctatattgaccgagtagcagcagaactattttatttctcccatgatgtgggagctggattgagttgacttagagttgggaaattatccaaatgcattgtgaatcacaaattggcacgaggcaagttaacagtatgacaaagtgttactgacagattttatgtggaacagggccgggttgctttgggaacaatttggggtttttccttaatcccttatccagatacaagccaatagtagtagcaacaaccgacctgaccgggatctaattaagtcaggtcgacattgaacatccttatcaatgccacttttacataaaggattatgaggctaagcaaatcaataatcacctctctcattgctaatggatgaactgttaattggtggggaattaaacagcgcatatgaatcaaatccacccatctattcgctgaattattttatccatctaatcttaaacaggattgtgccctagctagcatactagatgtgcttatcatgatagactttcgttccaagcaattatcatgataaacatgccatgatcatgaatagttagccttaaagcgcgagaaaacacataattgaatggctggcctgttgttaatttttaggtggctccatggagccaatcatatatatgtgtaaatggtttgataggatattaccgtggatcaagcattaattgcatgggaaacattagaaaaaaggagtacatttaagtttgatctcctgttcttaccaacttgaaccccataactttaccttttgttttactttgaacctctttccctcgaaatgttgccatctccaggaagacaaataaataagatgttattagtacggtgatggagacgagagtagcatggccagtaaagagagcgcgctagtacaccaagtagagcttaaggaaaacaataaaatacatagtgaaaaagagataaataaggggttcaaagtgaaagaagattaaattgggtctaatgtgaaactctagtaaaaggaagcaggggcaggcccagaatttttgttgggtattcgaaatagaaagggataaaaaaatacaatatcaagcctaataaatgatatgtatgtatagtttcgtatagttatacactatataatatataatggctataagcatattttcataaattcatagaattggccatgaaatgaatt

SEQ ID NO: 21260 - DNA, 3456 bp, Oryza sativa
cgatcaatccggttttttttttgatgattttcaatatttggttggttcataagtagtgctatagccgtgccttgcgattgcagtgtcgtccgtgacaaatggcgatgttgggcctaccactcataaatctttggctacatagttaggttaaaacaagtttgtttggtagagtttcaacttttaaatttaaccccaaaagctgagtttaaatcggagttgtgaagcaaccttaaaccatgcttcacttttctagtttattttgtcagggcacttcaaccgattctattttctttttgagtttctagtttattttgttagacacttcgactctgttttctttttgagtggctgaaactttatgattgggatctaacaccaggaaaaatagaacagaaccaaacgtacccttaaaagttatccacctttcatggcccttgagcacccggccattggtggaccgcccagttattgctggcctccaattgggacgagaagcctccgggctccagacataatcactcacccaacccaagcagtgtccaaccgagcagcccaacaatcaaactgagtgccattttgccacaaagatcaatgagagattgagagtaccaaccaaacctgccagatcccatcagggcaagcaaaacttggcatgtcactgcctagtgccaacatcgctgcttgctgcatgactgcatcagaaacatataaccaacacaacaaacagcaggtaaacttgtctacaaacttcacccagaagcataaacagaatcaccatttcagttacaaaaaacgctgactggcctagtcaggagccaccaacattcggaacacaaacaggtaaaaggaatgtacagttgacgggtataccaccaccaccaccaccgaatcaccatctttctgacgaaacttatttctttttgtcctatataaactgaattcaaacaaatttaccaggtaatgggtatgatcctgtaacttaacctgaccgaccaacggcatacgcctcgcgggcagcctcggttgagttcttcacgctttcagacaagctggacatggctgttgaaaactttgacagccgatcgaacatggttgctaaaccggcctgcagggttgccagcttcgatccagtctccggtttgttaccttctgcttgatgattcttgaacattttcttgagatctgacatgatgttcttgatagagcccaaggtttcttcacccgggagtgacgcgattgctgaggaccagtcatcaaggagcacgaacatgggaggagcaaggtgccggcgaggcgagagcgtcagcctccttccccgggtgtgatcgtaaggttgcagcacgcatttctgcagccaggagtggagaccatccacatagcatttgtaagcagcaatccaattcgtcaagctggagtagaagaaacccatctcgttgacaaggttcaccaagggctgcttgtacggctcgccgcgaggagatctcaggacataaacgatatccgacgacgagacgatggtctgctgaactcggtgaatttcatgcatcattgcccacatgcgcgtcaacctatgtcaagcacgataaaagaagtatccaaatcaatgccaagaagttaccaataagggcaagcttgatcttggtttgagcgaattcgcatttgatgaaaccatgaatactttgttgaaagggtgcagcatttaactgaaaataaaaggaaacatagttctgacaatggacttacccttttaatagttcaagaagttggggctgcagctcttcatcccttaacttctcaattattttagagattgaatatagcacttcagtttctaccttgagccgcgaatacaaatctttaacaataactcgagtcttgtcaacttgtctggcactcgcatccctttcaaattggtgccttaactgaacgcatttcttatcatatatcttcttgagtgattctgtaccctgcagttcataaagtagctaggttagagtacagaaatccaattaagcagaaaaatatatagtatgcctcttacacttagacatagtaaaatactgtagcggttctttcccccatttttttgttactcctacaagctattctgaacccaaaaagatcatgacactaatgaggttatatcctaatgcaatttctgcattctgtaacctgtaggaacctctaatagataaatacaaataccatatataaccccagatatttaagacattattacaagggagtgattataaagatttaagatagtgaaagaaacatatatggctgtgtgcattcatagttgatgcagaggctcgaagctactgccactatataaaagaagtcaaaacaaacaaatcagcatgttcccttttttcaccaaggcctccctgaccactcgctaactcacactcctccccacgcttcccaaatctactctccaacataaccttcttacgtacttcgccaatgtaatcaaagttgccttcagccttacatagcaatcctctgcccccaatgcataacttatttctctaacacatcctatgcattactcaactcattttttatggtatgcccataaatttaggcacttgttttttgtttagacgttagaaatgtgctacctccatgactccatcccaaaacatagctacttctggctatgtacctggacaagtacttgtcctggtgtatagccagaagtgctatatttcaggactgtggtagtatataagtatcctcactttaagaaatatctatgctaggggtgttatatggttctcaaaagatagaggtaccttcagtaaaaagtggttgatgattgcaatttcctttaaagttatggtacctataatacctttcaaacaccgacaaacatcgcttttgaaatataatacacttttggtatgtgcaataggtcactgtccgatggctgttatccagaaagggttgaataaacatgtcaatacgtcatggtccccacataggtaaggcgaagtgtgccctaggctaacacttgagcaccctgtcgtttgtgggaagaagatccttacaagcatactataaagctcaataataacatctaaagctccacctcactgctcactgccactaaaattagagaaggtgagcaaggaaagcaaacgtgacggtggtttgcacctagacccagttgtgacaaaccgacaaaaagacttgggcacacccaataggtggctttaaaattagatgttctttcgtcgacctaggactaacacgccaccgccattcgccacattctctctggctttaacaataactatgtggccttaacaacatatgtatcttctctcggccataaggtgaggagatacctgcgatggcagatcttgaatgccttaataaccatatagttcttggttgaacaccttaataaccatatagcgttagcccatttcttcatgcaaatgtatg

SEQ ID NO: 21261 - DNA, 1074 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggcccccgcccgtttcctgttccacaagaagaatctatactactccttttacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcttgcgcacgatcgtgtccatgttgtcctcttctgggg

SEQ ID NO: 21262 - DNA, 1779 bp, Oryza sativa
cgtaaattttttgaataagacgaatggtcaaacatgtacgaaaaagtcaacagcgtcatctattaaaaaacggaggtattaaaaaacggaggtagtacttgataacatgccttgttgttgtgtttggtcacagattacttgtctattgcctactacatagagcctgaaacaacagctagaaagttcaatctatcaataccttttagctgtggtgctaatattgttgtacatgcaattaaatgttctgcttttactttcttggtacttgatccaaacaatctcttgaaagatctattacagatgtactttggattatacacgggggagaattacacatactagtttatcatttaaatcttgaagatactgtgatgtcgacacctcatgcatagcatgtttgttacaagagaacattttcatgtcgattttttatccattattttagttgcgctgctaacatggattcgttttcccaggacctagttcggcacaatccaatgtttgctgtgaagcactttctccctctcccctgtatagccttgatcacaaaagggtgacatggtgaacctctcatttagctctgccaccaactgattccagctcctgttccccgctcctttgtgtgtaagaattgagcaaaactgtacagcgcctcctccgatgaaaattttccagctacgattcacttgcaattttacgatcacagaattctgtggcaatgtctatttgatgtaccaaaactaccttgtagaacaggtcctgtaggtagggatgaaactggttcggatagtttccgtccgtctgaaccaattttcggattcggaaaaattcggtcggaactatccggaacttttcggattcggaaacgaattcggattttttttctcggatacgaaaacgaatacagtaagggtgatatccgatggaaacgtaaactgtcggaaactatctgggatttttcatcggatatccgatattttagcaaaagagagatttttcagccaaaaaaataaaaaaaccctaaaaccctagccggccgccttcgcgccgcccactgccagccgccgcatggccggcgatagatccgcgccgctgcggccgcctgccgctggccgtcgcggggctgagcgccgaacacctccgtaggacggcagatccggcccctcccgagggcggcgccgctggatccgccgcctgccgctgtcgcccaccgacgctgtcgccgcgcatcgaagccgtcgccgtagtcgagcccgctgccgccgcccatcgccgtgacccggccgccccaaggccggcgccaccggattcgctcatcaccgtcagttgcacgtcgtcgcctcgcgccgccgagccctcgccgtcgcctcacgacgtcggatcccgcggctccgggaccgccaaccctggatccagccaccacgaggctcgcgtcgccgttcgccgcacgccgtcgcctcgcgccgccacgccccagtcatcgccattgcctcacaacgtcagattgggccgctccggggccagcaccgtcgaatccgctcgccgccgtccgttgcacgccgtcgcctcgcgccgcggagcccacgacgtcggccaccccgaggccggcatcgccatccggcgcacgctgtcgtgggaggaagggtggcggctaggagagtgggactgtgggagtggccgggtagggttaggtttatgtatccctctatctaaatgggccaacgggcctaagaattagctaataagtctatatgtactccctcaacttcgaattaaatt

SEQ ID NO: 21263 - DNA, 725 bp, Oryza sativa
gccttggtctggctgtccggctgctgctcgatccgcctcgactcctcgtcggtcaccgtcaccaggagcacattggcatccgggtattgcttctcaaactcctgaagaatgttcagatcatcgcaatgtactacaattcgatgtgagtggattgtatatattgctgcatattttgtacctgccagactccgtagtaacctctcctggtgctcgcgtagaggaagaactccctccctgccccttcgggccagaatttcttggggaacttgacgaatatcttggtgtacacggccatgtcgaattggtagatcgcaagaatcttccaagactgatggaaacatgcaagaaacgtaaagtaaatttgactgctcgatatgcacatcttaatttatatttggaagaggatatgttgaacatgcaaggacatttggacatagaaactgacacgcagctgtggcttgaactgtatgagatcgctctgcaggactcccaagctcacagaaaccatgacatactctgcctggtacgtcgagctgtcctccgtcttcacggtgacgccggtcgaggagtaagagatctcacgcaccacctgcatcgatcatatataccaccatgatgatcgcgtgcttaatcagttcatcttttctgacaaaaagatcatggcatcagaagtgatatgatcaaccttggtgagcttcaggcggcgttggcgatgttgccggact

SEQ ID NO: 21264 - DNA, 55066 bp, Oryza sativa
tccatggtgaataaggtgttctgcaacagtagtatgagtgattcaacatctcaacagcttacatcggatactacaatcgaggtaactaagtcttaggctctctcctgactctgtctttgtctgaacatcatccgaaattactggacacaattagcttcttgtgacaaatttccaggttacaattgatataccatttccatttcgagcattacctgttgaagccattgaatcaagtggcaggcagttcttgagcaactactccgagtcatgcttccacgatttttgaagcaggttagttaaatacatttttttgtttccagttaaaactttgttgcaaattctaacaccagtcaagacatcaagtgaaggcagctacttttatttctctcgtattaatttgacacctgatgtatcatagatagttcaccactatctgttttctattgttccatgttgaattttaggcttgcattcagctctatacctagattttatttccaacaaattaatcaatatttgaagtcccacgggtgctttagtttatagtttactttctatttgtacaatgatataactaagaaactaaatggtctgaaaaaaaagaatgatacatgatagtatgaataagatttatgttgagcaattgccaatgtgccggctagaactttactaggattatttgacatgagtagcagttcctatgattatcctaatatttatcttagagattatttgtcaactgagaaaattattttgctctcagcttgttaaagactaccaagcatgggcttcgggtgattcttcaaggaaaccacttggcactggtgaaatatgaagcttcgcagtgtctccattaggcattatagtcttttcttgttgcattagttattgcttgatggggtatagaaaagctgtttatacgtcgttttgctcacaaaatccatttgcttctttgtggtctttgcctgaagatgttctgtagtgtgtatggatttgtgccatgcgaccagtcacatacatttgtaggttgttcattcacaatgtgttgttgtaagattaacaatatccgaccaaaactcttctgcctccatacacattacaaattatggtcctgtgatataaggattgtctatgcaaggaaggggtcggatatggttttctgatattgagagcaatatgtgcggacaacgaaggtgactactgaccagatcggatggccaaggggaattttggctatcatgttcatttaacagttcttaactatcttttccagcctgggcgacggttgatgtttttgtagcttgtgttatccataaatcatgaacatacatagtctgtctaatgtggaaagggatggtttagcaatcagatgtaaaaagtaataatacagagcttcatcatgcttaattatctgactctgttggatcgaagctagatgctcttcaatgatctgctttcaagaatcaagatatgcctgatgatcagatgacgcaatgctatgaagcgttttgtgctacattttaattacctacctgtgtaaagataagttatatttgctcaaactaacacagagctagaatctgtgtttagttcacgtcaaaattggaagttcgattgaaattggaacaatgtgatggaaaagtttaaagtttatatgtgtaggaaaattttgatgcgatgaaaaagttaatgaattatgcgcatttcctaaaacttcaaaaagcttcaaccaccgactagctctacccttgactttcaagaggagaaaaaaaatcagaacaaaggccccgttcttttttgctataagtagtgaataaaaattttcatcttcatagcacattttttaaataagtttttgcttataatgtttgaccacctatcttatttaaaaaatttgtgcaaatataaaaaacgaaaaaatatgcttaaattactttggataataaagtaagtcacaaagaaaataaataataattctaattttttttaataaaacgaatggtcaaacagtgcaagtaaaaactcaaaatcccttatattatgagacagagggagtaaatgatatgtttcgtaccgaatatttttatatgaaaattcttgtaaaatattagataaatctattatttaagtttgtattaattaaaactcaattaattcgtcgatatatctcgttttccgtgcaccaaaattataaatgctatccattcggtctatgagcgagagagataaggacccgaagcgaggccatctcaattctcaaacagatgcgtttccaccggttcgttgtcgttgtcagtttccttcccgtccccaccaccgcggcgccacccgtatgacctcacccgccgtcgtgtcaccgccctcggactcgacccttttctgagctgtctctcgcctccctctccctctccctcctctaggagagagttctctccttacttcctcctctcccctccaccatggctcgatccgtggcgtcctcctcctccatctccaccatgccgtcctcctccgcggcggcggcggccgccgccctaggtgacgtctccccgcgcccctccccgccctcctcgccgcttccgagcacgctctcattcgcttcctctcgtggctttcagaggccgtgcaggtcctcgtcacctccctcgccgacgaatcacccgtcgcccgggacgccgcgctcgccgccctccgcgagatcgcgccgatgtaaggggatcgcttccgccgcttccattcttccgcgtgaagcttaattttaatccgggtaaattcgttgcgtgttgcgttgtggttgcaggaacccgctgctcgtcctcgactgctgcgccaccgtctccagaggcggtcgtcgggtacgctcgtgcgcatttggggactaaaattcacttaccgggggcactgttttggggcttgtttggatttggggttgtgaagctttttttggtttgtctgtattgcagcggtttggcaatatagctggggtttttctcgtgatggcttctgcagtgaaggctctcgatcgctctgatgctgagcgtgaatttcttcggaaacttgcgaagattgcaacagcagagattgttagctcaaaggtatgggatgctgccagcctgtctattgtgttcttacttctgagctgaacactgtgagttcaagcagtaaacaggagcacttctgagcactgttttgtagcccaacgtaatgccattatttggggcagattgctaaacatacaacgtccaaaaactgacataccatggggctatgcttatgatacagtaggtccagcagatgtatgattattactttagattttacatttttggccttttcgggaaacaaaaccaattacagctgttacggtaagatgttatgaaaagagcaatggacatggttctttagcaaataattattatcactatcaaggaaatggttcctgttccaccttggaagccaggaaattagggcatatgtttgtctcgctcttttgttttgtggttttttgtttttttttctgcctatgcttatttagtttatctaaattattgttcattggtgaacaggaactcaatgtcgactggcaaagagcagcagcgagtcttcttgttgccatagggtcacatgatccagacttggtatggcttcacctccatacattatccttttctgacatgaacctttagtgttcttaaaggagaggaatgtacttaaaagctgtgactccaaaagctacattattgtctccttgcaaagcttggactggctgacttgactttaccaaatctactcggcttccttcccaaacctactacttagttctaacatctaaccattaactctatgttcaataacttacagactttgtgtttactaactttatcactaacctgccaaaagataactctatatcaactaatttatggatttcattgcaacttgtctcatccacccatcgcagccatctgtcatggatagaattatcagatgcattaactaatataattaagttcgtattcacattcctacataggaacatgttttgtagatatgtggtctacaatagagtggaacttgtaaaataagaaattgatgatagttttttttggttatttcaataaaaataacagtggataatttcagaggatccaacaaaaataagattttatagcatcatctagcggccatcctttgtaccttttttttatggtttcacattgagaatcccttatatcttgtttcaagtatagttttcctgtttcactattgtcaggttggtctcattcttcatttctctgttggctttgggtgctcgctgctagcaattctttactaccatgtggcctagcattttaataatgcaaatctgttactactcttattctagatgatggaggaattatttctttacttcgctggaccaacttctgctttgccagccatgttacagatacttgcagattttgcatcagctgaaggttaagcacaacttttagtttaactataatctgatattgggttggactgctgaatttgcaactcggtcttgcttatttaaagccttgcagttcaccccacgattaaaggatgtacttttgcgcgttttacctatcctgggaagtgtacgggacgctcaacgacctgtttttgcgaatggtactgcatatgaatattcctccaattatcatttctagttactcctttttgttgttgagcaaactgcattttggttctcatgtttctggaaagacaaaaatatctatcaatacaatgttccttttgcagcattcaggtgttggtgccaggcagcatggcagtacataggagatgccccctctgagcttcctttcgatactgacgtcatgtaagctttcaatatggcaaataatccttttttgagataacttaatcttttatgcaatctatcttatatttcaatgataggtcctttatgaattcagtatttgaattacttctaaaagtatggacaggttcgcgtgatctaaaggtaagctttggctttgacttgattcttttatttgctgatttgttactatttagtatttacaccctttacaaacagcactgcccaactgatacgagcaagctgtatatgtttggatacgcgtattatgcctggacctcgaaaatagttttttgtacaattgtcagaaacacatacgtgcctataaaattgatacactttgataaatttgtacatatcaattgctcagtttagtgattaatggtgtagtcaataagcatcatgatgcattgatgcaccctatccagctttatgaaataatgtggcgaaacgagactggattttaccatctaggagtgtattctgtgagtttccacccaatccaaaggatacatttagagatgggttaattggattcatgccacgcccagtagtgcagatcagatgactgtttgttactagccaattggatggacatgaccgtgagttcacatttaagggaagctcctaccagatatggctgctgggccctggcccaaactggagattcaatgtttgtcgctccttgtatgatggaacttcttccttcataacacggcagacttgctacagtttgctgggatgttattagcttagcgactgcttttgcagtaatatatatatatccatcttctgaattcattccaacataatattgcatgatcaaatttacctgtaatattttcatcaggtgcggttgtcttctgttgaggctttgggagaaatggttggtcttgtcacaagatcacagttgaaatcagcactgccaaggatcataccgacaatgttggacctgtatgtatgggttctattctactccctccgttccaaaatataaggatttctgcatgtttcccaaaatgtatctgcacattttggaacggaaacagggagagtaatatatttactgaagatatttgccaaattctcacagacattttttttgctcatgtagatgtcggaaagatcaagaaattgcttttgttgcatctcacagccttcataaccttcttaatgcatcattattgtcagaaagtggtcctcctttacttgattttgaggtaaaataagatcatgcttaatacatgttttctttactatatgtggtggctctgcatttttgtgtcaacttttggtactctgcgttaattgctacggtaatgggaatcacctaagatgctctttatagggaatatatcaaatgggaactgcccacaaaatacaactagcaacattgacaatcagatcagattgtggtggctcagagcctcagaccatccactgtaatctaattgagttcatagttactgttttgtccttccaccatgtagtgatatgtgctacatctagcagctctccctttgatagatattgctgatgcactgtcctgtgaataccatatttctgcttggaaatatccatcatgctgattgactaatatcttcttttagtacataattgatatgaatccagatcatcaaatactccctccgtcccagaatataagcatttttagagttggacacggttattaagaaagtaggtaaaagtgaatggtggagggttgtgattggttgagtagtggaggtaggtgggaaaagtgaatggtggagggttgtgattggttgggaagataatgttggtgtagaagttgttatattttgggacaaatcttaagagctaaaagttgttatattttgggacggagggagtatataatataaacacgttcaacatcttatgttgatattccttgtgtgtctgctatttctcttgaaacaatagatgagttgaagataataagaatgccttaatctttggtagaataaagacattagttttttttagacatcttacacacatgtcaaagcatgatcagtcaggattttttgttccttatgtggcaggagcttactgttgtcttaattacacttcttccattagcatcggccaacaacagcaaatttgagcattcgtatgtttcaaagggactgaaggtgcctgccttaaatctttcacacctattctggttgaacatatatattcattgatttgcatcctctgctggctcattctttttgtactttatgctgtcacaatttgaatagtaagatatactaaataatgattgacgcgttcatgaagtcagggttctttttggtagttgattggacacaccagttgttagtcgagggataagtggggactggagagcgatacaaagtggtatgatggcaacatgccaactgcccaacatatacctcaaatttgtctcagcctagtaggtgtcctagtaggaaattgttcatttttggttctgctctggcacatgcactgaggatcaggatgaaatgttgtataaactcctcaaatagaccactaagattcagcttagcatctgttttggtaattggaagaagcaacctagagttggaccttaatctgctgttgcaaaacagcactgctattttatgagttaaacaatatttgcatgaaatgttgtggggcgatgggatattccttattagccactttgtgcaattgtgcaaccatcattagttagcatcaattgtgctgtattttcttgtcaatgccacctgcataatgtctctcatgaagcgattcatgttgctgcatggttaactactggatctgtatctaccctaaaaaagagaggggaaaaaaatactgaacctgtatccagtttgttcctgggaggcacttgtacttttcttacatttgagcaaagctatcagataatcagacttattccatttgtattgctgtgcaatagatgtattctgctgttgataaaacatttactaaatactaatcatgtgctcgtgcctttagacatacaatgaaatccaacattgcttcttggtaattagttcagcataccccgaggatttgtgcatgttccttttgaatgtaagtatagagctactattttttccacctttaaataaagccaaaatctattggggatggattccctagtttgtgcttacaaaaaaggcttatatagactattgctgcttccatgtactgcctacagaaatgcaagtcaaaagacgaagcatctattgttggggcacttggcacaataaaacatctattgcctaggttctatttctctctctatctctccctctctgcgtttttgagttgtttgcagggatctctataacatatctatacaggttgttggaatcatggcatactaagcaagcgttacttgttgaaattgtgaaatcacttttggaggagcagagcttgggtattcgaatggcactagctgaggtagtaaattctgtattaactttaactagcatatatcttacacaatattgtagatgataatgatctccctaagattatgcatccaattattcacttaatactaattcaatgatgtacagctaattgttgttatggcttcacattgctatttaagtggacatcctgctgagctggcagttgagtttttggtgcgtcatagtgctataactgatgatgatctgaatgatcctaacactctgaaaaacgagtactttcaggacaaaagatttgaggtctcacttaatcttagattctacaaatttacttaactattaagtactccctccgtttcataatgtaagactttctagcatttcccacattcatatagatgttaatgaatctaaacacatatatgtctagattcattaacatctatatgaatgtggacaatgctagaaagtcttacattgtgaaacagaggaagtatcaattatttcagtgatttattttctgttttcatttgccagatgaaaataagcctatctggtctttcagagctaagagctgtatgtgaaaagggtttgcttttgctagcaattaccattcctgaaatggaggtaaaaataagcatgatgttgtccttttatgctatgcccatgccccatctagtcagaaaattgatctatgaagctaccatcatatacttttgtcatggtaaatcaaatattcatagttatgtgagtaatgtgctctagatttttctattttccagcttgttctatggccatttatcttgaaactgataattccgaagaagtatacaggtgcggtagctacggtgagtacttttatgttatttgctacacctggaaaatatttgttaaaccaatgtgccttagttttttttactcttattatttagagtagataaataattaaataatcaggttcatatgattggtgatacctgcagatctgcaaatgcataactgaattgtgcaggcataaattgtctcagacaaacccactatatactgaatttaatgcttcaaatgagatccccaatcccgaggtagtttacttgatcccagatgtattttattctcttccttggacagttctttcttatctaagtatggttggtgcaggatttgtttgctcgtttgctcgtgcttctgcacaatccacttgctaggggtcaacttgccacacacatcctgatggtttgtcttcttagttcttattaattaaacctaaaatcattagaagaatatttacacgaaagaagcttcgccttaggcccttagctttgaccatgcttttttttaataaaaaaaaaccacatgttcatgttcatccatctattttcgtgtggtttagctttccagccatctgtatgtttttcctctacagtaggccatataaatgctttgcctctttacatgagtttaaaaaacggtgtaattatgaacttcatattttgatgactagttaccatgattcttgaaactttatgctattgatacagattttttattcatagaaaattgagcatttgcttgtttaatacgagaagaggttatatcacaatagcttcagatttctggtcaactggagtagcttctgtcattggtagtcaatgggctgcctgatactattagttttactttatatctggattatctagtaacttgacattgttttgtacttgattttcattacaactgtcgcaacaactaatttgcatgtttgactgcctcaaattaagtgattccatctgttactggccaatacttagatggctcatgacatctttatttttgtttacagtctcttagctcttctaggtcgctgttgagtcttgactcacacaataccataacattaagtttatttgtttccattcgtcagcactcattcctcctctcatttttttcttgtaggtgatgtgttacttgggtcaacttttcccaagaaacctttctttatttttacaagatgaggtaattcgcttcatttatttgtttagcacttgagagttctttcttatttagttctaagtgtaaaagaaagaacatacaggttgtatttctacactttgggggaattttctttgcatatttttgcagtaatcatgtcttactttttttatgataaaccccgaaaccgaaagagaataaaacatgtgctgcccaacctggatgtgtcctggaattaatatttgcttgtcctgtgcatgctttatgtataatgcatgactatggaactcctgtggtgatctacttaacagaaaagaggccgagagagcatattttatagggaaatgctaatatttcggcttgtccttatcatgttgttaaagtggcttaatatatgcatcttttggcaagtattaggtccctaagatgaaagcttacatcggtgaccctgaagaccttaagcaagatagcacataccaggaaacgtgggatgacatgataataaatgtaagtctcttattcttattgttcgaggataataatgatgccattgccaaaatctatacttattaactataataatggtggttgctttggtaaaacaaaattatagctagttgagtggaacaaaaatgcagaaaggattgtctcatgtgaatcctcaaatgctacctacttctctggaaagctgatcatgccatacctttcagtttttagcagaatctttggatgttgtgaatgacagtgagtgggtaatatccttgggcgatgcatttgctagacaatatgatctatacgctacatgtgatggacattctgctttgctgcacaggtaaagttttgttaccccttgtacattttctatagaacttttagtttgaatactttggaatgtctaaaccattctgtactggtagatgcccatgcaatctttgtgcttgaagtgattgttttaaattttattttgcagatgtttaggaatgcttcttcagaaggttgatgaccgaatttatgtccgtgaaaagattgactggatgtgtgcacattcaagcatgtctattcctattaatcgccttgggcttgcccaaggcattggtctggtaagcgggtttaaatgaagttctactttttgggggctatcgccttttggtactgaacttgcacttgcaggttgcagcatctcacttggatacagttttggagaagctgaagaacatattggagaatgcaggacagagcgctctccaaaggtaagtgcattaacttttttgtttacagtagtaacatatgttatcttgtccgcccagtgttagccatgctgaagcagcaacttgaaacttaaattggatctataactttgctcacgtgtataaatgtattcctgaaccttatttctcacctccaaagcactgattactttccattttaaccatttagaatagattttcttgtattgtgattaaaacttctatataacccacttaaaacatttctgtttatgtccttgttatgcattttagttattcccatactgtttttgaagaaagataaattgaaactacatgtaaggtggatccaacaatgcaactatctttagcttgttagttcattttttccaggccatgtgtctagtttgttccttttattaattcttatggaacctttaattctgcaggttcctatcacttttctcattgggagcaaaagttgaggatgttgatgacacatatgcagccctggcattgatgtatggatatgctgcaaaatatgctccatcaacagttattgaagccaggatcaatgcacttgtggtatgctgtctaattccaatctatcaacaaacttgtttctgatctgttaccttaacacgacaacatgatgagtgattattacatattcccattaaagatgattattacataatcatttgtggtcaactggtcatgagaagaacagcaaaccactaggttgggctaatccttaggtgtcagaaataggatcggcttcttgggcttctctgggaaattgaagccccatatacaacacttcctggttcactctagcaccctagcttgaatagtacatttatgatctttattgtctggccattctttaattttcagacccaagaatccatccactgattgtatgtgttattgtctgctgcttatgtttctgtgctgaccttattttactgcattgtattttaagacaaagacacgatcatttcatatgttcttgatttcttagcttatactccctccatccaaaagtctaggtcatatttcattttctgtttttccaaatgagatggacaatattgttccttggttttgtcacatggtagatgtgttaattcctccttggtcttggtgataaaagaaatatgccttagacttttggatggagggagtaaccgaataagctgaggctatgcctcttttaagattaactgcagatacgttctattttggttttctagattgaggaatgttctttacttctgtactcaggggactaatatgcttggaagatttcttcatgttcaacatcctactgcaaagcaagctgtcattactgccattgaccttttaggtaatttccttacaaaaaagctgcatatcccgtcctgttttttggaatcaatttttcatttggtagagaaattgatcttcaggcacacattcgtttgtttccctgcctctgtgtgtgtgtgttttcctgggaaattgtttccctgctttgtcacaattggtattttgctatttgcatattgttattgactcagtaaccttgaggattcttgggtgatgtatatatggatgcgatgtattttgttgtggaggtggtagcctagaaaaatatctacaattcacaaagttatccatacaactcttatgtacatatctctctggtgaattgttctttaatttttaattgcattaaatatcttgaataaaaggaagaggagaaatgacgttgatatgtagaggtccagaactagattggcatgtacttaaaaaggtatttactttattttaggattctacaacgaaatcttacaagtataattatttcaaagaaatatataaatgatctatttgtcggcacaagatcccaccagctcagaacatggtgccagaccgatggaatgctggactaaccaggagaccaggaccaccaccactaggctctttgtattctcaatataattttcttctaattgtacctcatatgttgcccacatctaatggttcgcacgaatagtttgcttgattgcatttagatccgagttcgcacaagatacatctccatgtaaatattgcattgatagttagtgcccgtttgatttgtatttacagtatcatgaatcatctatcacaactcagtaaatgtatgcaatcgtaaatttgttaattgaatcagaatgcaagtatcaatatttttgtgctagcagttaagtttccgaggttaacttataatttacatttttttttgtcttactaacatatttttttagataatggaagctttatttagactcagttaattacgtcaagatgatacaatcaaactgagtcacccccggcctccgcataaaatgcacacagccaaaaaagaagaaagaaacaactagaacatcttccaagcacaaaagtttgatagaaacatatatcttagtggctatcaatccgtagactagaccgccacccatgctcctgggtaaaaaactcctgcgccacctggtccaactgtcgtgataccaccgtaatagtatcccgcagtcccggttggtggaggatagcccaggtacgtagccagcgagtaactaaggtgataacctgcaaaggagaagacaccatcttgttataaaaaattactccattcctgcttagccaaatagaccaacacagagctgttgcacccatcaaaagcagattcctcatgtcttactaacatatgctattggcattattgtttaggccaagctgttattactgctgctgaaatggggatttcattcccactgaaacgaagagaccaattgctggagtatgtgctaacgctaatgggaagagatcaaaatgatgaccttgttgatttcagcactgagcttctgcacactcaagtatgttactaagttttaactcttgcttttgctaccatttgtcaaagaaattcttcacactggctgaatcctttacatccataatcctatctttaaacttgtattcacacttaaatacttcatttcagtgaatgtttattctacctggattcctcttacatatgttgatatgcagagtctagctttaagtgcctgtactactctggtttcgatagagccaagattacctatggaaacaagaaaccgtgtgatgaaggtttgcatctttgcatcacagtagtgcaacgccacaaaaactttgctaataatttgactactgtagtttcagttaaactgccttcatatgattttcatttgttttttctattttcaggcaacactaggattttttgctttgccaactgagccctcaaacattgttgagagcctcataacaaacctgattattttgttaggggccattctgctaactaggtaatgctttaatctctttttaattttatggttccattttggatcgtcttattaataacgttgcagtttgttagtttttgtcctgctacttgaatgaaatggcgatgtatctagtattgtttttccttcttgtattgtgagaacatctatttttcttgtacaccaaatctatctgactcttctctaatagaagtgacgtggcttcaccaaaaaggagaaattcaatatttgttgcagttagtggggactgtttgtttagatatataggattccaggaaatgatgtcctaaaattacaagcaaaccttgttgaaaacattatccctagccctgtgacttacatggtaaccacaaacacaacttcaaccaaagatttcaactacaatccagattcacacaatgctaatcatgctaaaacaaagagcactcgaagcagatagctatctaacaacaaagcactatctcctctgccacctgatgtttatgcttagctgtacaaaccaaactcgtctttcacctgacttttgacatttcattagaagagttctgcaataacgtgtctccatctagtattttgagatatttcctaatatctcaagtgcaatgtttacttttgattagtgttcaaatgattttactcattaactcttcctatgtttgttcttttccttggcagtggtgaagatggtagaagtcgagcagagcagctcctgcatattcttaggcagcttgatccatatgtttcatcttctgccgaacaccagagaagaagagggtgtgctgctgtaaatgaggtgttagttaagttccgcaatctctgttctggtggatttggtgtgttgggttcttatccaacattcacactgaacaaacaaattgatcaggcagcccctaggagcttgtcaagtttgccatgtatgttgatttttttctaatattactagtgtgactgtttgatatttgtgatccagtagcattaaaaaaatgtctcctatgttatcaccagctgcatttgtgttgcctacccgagattccttaagcttgggagagagaataatggcatatcttcctcgctgtgccgatacagatgctgaagtcaggaaagttgctattcaggtttgtgtggaagtagctgatcctggtagcagaactttccttttggctgttaaaactctatttcatgcgtagtgtgccttttttcaagctctgaattgcaacatgtcacttggaatgaaattgtgacattaatttcctaattgttctgacggtgcaacatagcatagtacttatataattcttttggaaaatagtaatgctattcagttggtagcacaagcacacacaccatataactgaactgttaaggttatatttacccgttgaaactgagttcataaatttattccctgcttttcttgttgcagatacttgcacttttcttcaacattgcattgtcacttccaaagaagaaggcgtctgtgaacgacattgatctggagtcttcatacagcgctttatcctccctagaggacatagtctctatcattagaagagtgggcgtgctatcttagtttggtttctgttaaagtgtgttctgtcaacaacttctgatttattttgtttgctgttctcaggaggcatcaattgaccaggccgaagtatttcacagggttgtctcctctctgtgcgtcctattatcgaaagatgaggtaacctctctgagcagatttgatattgaaattgaagagggagataaaataacaattacaattttctgtgtacatatatagcttgttgtcttgctacactcctgtacattagcagcatgtgataaagtaaagcaatcatcagatggttcaattcaagctattatcatgtttattatcagaagaggcaaggagctacgtgaagctgacgtattgaggttagtaactaagtaggaaattagctcagaagattacaaaataaggaaagaacagtttgtaatagattgtctcagcttgatgacactagaacacattaatattggaaaataaccctgctaactggaatatagcaaatagggccttaattacacattttttggagtaacactgaccctttttgagaagggaaacatagtgcattgagctttttcttgaaagaattgaatatttctaatatcctattgctgatgttataggacaacacaatctttgctgtcgtctgcagtctcgcttaccaacaaggagtcacgccgagaagttctcaatgctgtatccatgatcgatttattattgcatctatggttcatttttttcaatctcaatattcttgtctaggattacaccctgagttgttttttcccttgactgataatagatatcgtgcttagcagaaaacaccaatcacaccgtcgtgtttaatgaagttctatttgtggctgggcgggatatttgtacaaaggacatagcaagaattcgtggtggctgggctatacaggatgtttttcatgtaagttgggcagaggctgggcacttccattatgtgattctagtcacttgcattaggaacattcaaatttaaaatatatatttaatagatgcatgcatatattgctttatatgaatgatgtttgcataagtggctgctagtcctgctcatgacccagtttgttttggtagcttttaggagaattcttgtaaagttaattaagcatatatattattataatcaggattagtcagataagagtaaaatttttcatacttttatccataacgatgaatttctcgggggaaaatgatgcatggttcactgggctagatctcctattctgaaatgggtgctatatccctcctttgagttttttaaagaaaaaacatgccatatggtagaaatgttgtctcaaaactctagcactgcctttatatagtttaattgaaaaaagttagataagtgcgagcattctacgtggttgcactgttagaaaacacttgcaggactaatgtgttaaaccaggatctatatgtttcatctgcatctgaatagattatttgtcatggtccactgttgcctataatagaccacgtatcatagcggcaatggatggtagttcacctagactcatttgcctaataaattattccatacttcaaaatggctagttaaattctagagctacacttcctaattatgtttttgactgtatgcccttgaattcaggcattctcccagcataaggtgctagctattctttttctggagtacattttgtctatacttcacaaggaacctgtggcaacaaatgattcagaaaagggggagatcacctctgagtcatcagctgatgactgtattctacaagcaactatgtttgctctaaatgcatttatgaggtactggcttccatttgatggttgactaatggtggacaatggtcttcttttgatatgctaagtttatgttcttgaaaacaatggggatttacaggggtggtggaaagattgggaaacaagcagttgaacaaagttacccttctgttctttctgcccttatactgaagctgggaagtcttcatggtcttgctgaattgggccggaatgaacttctacggtgaatatgggactttttttttggaatctcttaatatgtaggctgcatatgaattgatgatatatttttttatgatctgcagatcattattaattgcgtttcagtcattttgtgactgtgttggtgatattgagatgggaaaggtgctttgcttaatgtctaggccttgccaaacatttgaaacaactttttgattgtgtaaaatccttgcctctccatagatattaacccgtgatggcgaacaaactgagaaggagaagtggattgatcttgttcaggaggttgcatgcagttccctcagtaaagaggcccaaagaggtaacctctagtattttcttactactagtacattctgagacctagtagaaagcatatattaagctatcttattactagtaagagcctaagaggaaatcaagactaaagaaagtactttgattatgaacttcgctgtttacattcaaataaaaaaggcatggtttggcagtcaatgatctttagttttgatgcatttgatgttttatgaaatcattgtactaaagttattgataatattatcataggttttgccaacttgcagcatcttaagcaaagctctcaacaaaaaccagagggctgaaagggaggctgcagcagccgcactgtcagaatatattagacacaggtaacaaattagccttcaataagtaagtctgtagatagaaaagcagtgctggaacctttagcttctgatgcatagttagaatcttaggtcaatttcccgtaggatgtcagctagctattggtgattactggttttctctgattaaggttgttgttccccaaaaagcagggaagggagacccatagaaatataatcctgttctttacattgaaagcaaatattctagacactatcattctctgattcttaggtagataacatagaagctggaatatataaatggaacctgaatgtaactcttaatttttattaagaaaaggttaatcctgcatgggtgggaatggaactgagaacctcacacatgcgcatccaaactccaggcccctaaacatttttaagacttttgggcattctgggttaaaattttccaactaagggccaaaaggtactattctcgagaaaaactatgctcataaagttgtattcatagtttatctgttatccatggtcaaattattttagtttcaactaattctattgaatatgcccacaatctgcattataatttgtgaatatgcccactacctgtattggcacatatacacttttatcatacatgaacttgtcgttcacttttttttttgattttttttactgtgcagtgaaaaagaacctatattgcttgaccaaatggttctggagttgtgtcaacatgtctctgatgactcgccaactgtcaggagtctctgcctacgtgggcttgtgcaggtcatcaatctaaccatagcaattttcttaggatacattttctcttccttacatattgttggactctttgactaacatagatgggtaatattgtttgactaacaattttgaagatgcttataatgtttatctttcacaaatcacaatcatacatcatattagcatattgcctgtgtgttgaacagaattttaaaaaagaccctactcatcaatccgtttttgctatcactatctacatatctcctctattgataggtgggccatttgaccccagagtgtactgttttcttttttcttttttcttcacaaaatgtagggagttggttggggggggggggggcagattcaccactcacctccaccatttgcttctttcaaagtagtatatattatctttatgtgcagaacatatcctgcatttccttctcaatcttgttttgtgatgtgcatatttttcttgctagctgagtagttcatgattcaattgatgccttttgtgatattatttattgggcgctgaacctaatttatcttttgtatcatctctttcagatacctgagagctgtattcctaaatacatccagcaagtcttaggggtaatattagcattacttgaagacaccaaggagtctgttcaattaactgctgtccagtgcttgttaactgtgagttcttcaattgattacaatgcaaattgcctccatttccatttattttccaatttgactgaataattgaatgccaatatgccatgaaccactttcaggttcttaatgtgtcagaacaagatgccattgacccagttttaatcaatcttttagtaaggctacgcaatctccaggtaatcatttatgacaagcatactgacatgctcgcatgcattactgtttaatggcattatgcagaacgatttgcattactttaccatgcttattatggaacatgtggggtgcatggcttatgagttacagagggttactttggaatttattttgcatatgggattttaagagacatactaattgcaaagtgcacatgttagcaagttcactgtccgggatatatcctcggtaaattttgaagatgtatgcactgtctccatgctgcctaagctcgacatcgtcatgtagttgtaatcatctttgtactttatttttctcccaaagcttaatgaaattggtcggtcgtccttttggccgacccggcaaaaatgcactatctcatacaggaatgttcaacccaaataaataatgaaataaataaataaatcaaactctcattttgtgccagtgtattttgatcacttgaacctttatattgcattatttcttttatctgttggcattttcctcgtgaattcccagattgtttgttttaatttcatcgttcttttcagttttcaccgtagtgtttcaattatttatctccaaatgttagaagctggtggcagtaacaaagctacggttgcaaacttttctgttgctttttttgcttcaggtttcgatgaatacgaaaatgaggtccaatgcgtttgcagtttatggtgctttaagtgcctatggtgtaggttcacagcagtttcttgagcaggtagtagcatgcaaagtcagcttttagtgtgttattagcagtgcgctgctatcttgcaagccatcttatagggcactgctgtaatggttgcaggaagtgctaagtagttttggattattttcttatgttatgtgtgttaatctgttaacaaattcgttgcccctgttgcagattcatgccactcttcctcgcttgatcctccatcttcacgatgatgacctaagcgttcgccttgcctgtcgggtaggtagtcattacaaatcagacaaattaatacttcctccgtttcacaatataagactttttagcattgcccacattcatttaaatgttaatgaatctagacatatatatgtgtttagattcattagcatctatatgtatgtgggcaatgctagaaagtcttacattgtaaaacggagggagtactttgttttcccttggctttgcctgttgtgtaggtattctttacttattattttgttttcccttgctacacagttgctttaacttgaattatattccccccccctcaaaacagaatacgttccaactcctagcgcctttgatggaagtagatggtttgtcttcactcctcagcaaaaaatatttcacctctgatcgccggtttgtgttgaacaatttgctagccatttctactgggatttgatattttagttacgagtgaaatttttacttgttctaatgtgctttgtctacagttcggattatgaggacttcattagggacttaacaaggcaactctgtcgactatctcctgccagagtcgacagctactttgaatctgctatccaggtaccgtcttcttgtagtcatagcctgcgctttgtgaagtatgccaacactgattttgtttgtttcaggcgtttgatgcaccttggccagtcatcaaagcaaatgcagtttgcttggtgagctgcatgctatcctttttagatgatcaacggttcctcgctccttacttctcccaggtatccttactggattctggtagttcacttgtttagaacatttcatgtttaaggtattaacacaattttatgtcgaaggtgtttgctattttggtcggtagactgagccaatcaccagatgcagttgttcgagcagcatcatcttctgcactgggccttctgataaagaggtctaacgtggttaagacgttgactccgaaatttgatcgggctgattcatcccagaattttcaacatggagatactcgtacgaaaacatcatccgagcctcaacaggagactatagatatgccaaacgatacacaacgagagccataaagatggtcaaaaccaatctctgctagatgtaactctgtaaatcgtgtatgtacggtttagtcgtgcatgtgcatgactgtagataatagaagagtttttgtgtaggacatgccaataggctttcggtagcgagtggcggctgtacagaaatccgtcacgttcgttgattgttatttcttttattgattgaattcgctcagcagtaagcatgtaaaaagatacctcagtgtcttgtgtgggtgatatgtgtggatcagtggatggatcgacatgcttgttcgcgacgaataactacaaaatttagtgccaccgtgaggctagcattaagagcaagttcaatagtatagtccactaccagttccaattcatctatagctaatctaatagctaatttatataatagttgcttactatactattaatatatggtcccacctgtcatacacacctttcgtattggagtccgtactggagctggctataaatctatagcccgctgctcatctctctcatcctttatcttattaaaatatgtttataactggcttgccattgtacttgctcttaggttatctgaattcattccgcgtggaaggctcctatgggtactgtactcctggaggcgtgcttgtctcctggatttttcacattttggtccttttaaaaaacttatttcgcaaatagacccctgaaaaaacttatcccagaaatggtcctttttggggcgccagagtggttggcgcgtcatccaacgggacggcgccagcctctcctcctgccaccgtggcgcactcgaccgccccagggaggagggcgccagccatgctggcgccgccgcctccattcctgtttctctgtatggagttgcaacggtgtcatttttattttatttttttggatgtttttttacactcaggatcacgatacaaccaaccacaaaaaaaatttaaactcgaactaccacttagctaagtttaaaaatatctagtataccacttagtctactttgcaccttcactaaaattagaccataactcctttagtaaaaccctttgatcaggatgttaaacataatgcactctaccactatatgaaattacttaatctaatttaaaatataaccacatgaaatgacatatatataagttaaacagtacatagagatgtaattttttttatttttattttatttatttgatattttttcacacttaggagaacataggaaccaaccgtataaaaaataaactcaaacggacaaaatatgtgacatgtagaattttccaaaactctatcaaaacggataaaatatgtcatctattaaaataggtgtaactttctcatacggactcggaatcaggcaaataatatatgcacggacatctacagaaaaagttacattcgattctcccctctttgccgggttaggcgatattaaaaccttcaaattctgcttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctctctcctctgcactagttcggagagaggagaggagaggaaaaattctatatgtcacatattacgtccatttgagttcaatttttctatggttgattcttgtgtgtccctaagcgtgaaaaaaatatcaaacaaataaaacaaaaataaaaaatttcggggggagggcgccagccactggggggcgccagtcactctggcgcactccccctagccacctcagcatcgccccgccacgtcggcagggggacggcgccaaagaggctggcgcggcagccactctggcgcctcaaaaaggaccatttttgggataaatttttctaggggtctatttgcgaaataagttttttaaaaggaccaaaatgtgaaaaatccagtacttgtctccgtgtacatcgcgtagctctagcacctccctgttcccaccaagtccgacggcgcgacgctgcgaaggttgacgtgcgggtgtgtgccggtggacgcgtatcgcctcctaccgaggcgacgcagcgaagattggtgaagcgcgtggaggacagcttcaaacaaaactcacacaagcaaactaaaatgaagctcacacaagctcaggggtatattttgttcaaaataaaaaaatgaaatgcaccagccgggaatcgaacccgggtctgtaccgtggcagggtactattctaccactagaccactggtgcttgcttgttgaaatttttctaagaatttatatatcagcagcatcgttcatcaatcaaggcactactcataaaattcagtatcacttcaaaatcaatcatgggttcagatatcactaggctcaagttctgagttacccctaaaccagcccagttctaccctgtaatggtctatatatggggggcatacgactatgctatacacactaccaaggctaccaagtacccagctagtatttctaaatgataaaggtaagcaatatgcactgacacatgtcgacaacctaactgcaaaaacacaaatttgctgatacacatgctccattcatagcaagtggagtacaccttgactaccccaaaaggaagcacatagtatatcagaaagcactcaagccaaactgtagttccacactgaccccccatgacactgaaagtctgaaccatattagttttagagcctagactgacaccaccaccatctcacaagtgatctcacggatcatatttgtcacaccttggcgagcaaagagcaggaggaggttgacgatgacaacacaaagctgctgcccccttctcccccttgtgatcgagttgtggttgtgacattgaagagacgagcacccaaaagaggagcaagaaattgaagttcgcactagtcgcggagtacctcagctcggatatcctcaagatgccgctggggaaagagcctagctcatgtggacgccgagggaaagtgcaacaaaagagagaaagccacgccaaagttggtggcatcaccagcctcgaaactcgaaagcgctaatgctcgccgcatatcctttggtagataccgttccctcttctcctgcacatctccctgaagattgcgtagttgctccctgaactacaccataattgcagagataagcaaagcttaattgcgtcttcaagtatttgctttgctctaactgatgatctgtgcacttggtttatgctaatgttactctgcaaacaggctcagagctgcttctttcagctcaactattttttgctctgttctactggtatgcactctgtactacatacaagtaatacgtgtgcaagaattattacagacatggctcatgagggtgaattcactgaattgtaatcattgagagtattgtggagcaggtttcagttaatggaaagctaatgtctgttgatgcaaaattgcactgatttaggtacaaaaggcacttttaactaaagaaatgatttcctgcagaaagcccctcaaatctcaaagaggcaccaatacttccaaataaaagcacccaatgggagcttcctcttctcccccctcttaagcccacgtatgctcaagggcagggcacactccacattatccatgcatatgcatcatgtaatccacaagatcttcttagcttatgtcatgcgataactaccatcatcttgttcttaattttggagtgtgtccgtgcaatgggtggccgtgcttcacacgcctatagagcgtgggctaatggtggccatggaggctagctaagctacttcttcttggggaggaatggctatgcatggcctccatagtcgacgacttttacctctactaaggtagggcaacttgtatcctttggcaattattcggtggatgtctgttggtggtggtgttagggattggagccggatgaatcttgagtttgatcttggctgtatgatgttagacataaagaggatggtgaaatggtatatggatgtacgatgtttgtgtttcggtccttgctctaataatcagttgttcttagtgttttgttttttttttgccctctttgttaaattgtaaccaccctacatatatgtactagtatcaccaataaagtgatgaatttgatattagtaattaagattgtgtgtgcaaaatctgtgttgattcttccatcgataaacacgtccatcattcatgtatgatcttcaattccccgagttgtgttgtctactatgagcatgcagtatataccaggcagcagccgtagtccgaatcagaaggtgttcgtgccggccaaacgtccacagattagctgttcctattatgggtagttttatcagtcttaataaggtacagagatatttctagtgtgaaacttgggtatctctagttacttcttggtatctcgatgtatgaaattttacagttcttgaaaaattatctcgagttacctaaattttacactaaaatttttgatacctaaggtattaaattttacactagaaaatatggtatttctaagtactttttcaaacatggtaaaattaccctcctcttaatatagcattagcaaatgatggcttggtttaaaaaaatctctctcttaatccctttgttccaaaatataagtttggttggatatgtgacatatcatagtattatgaagctggacagaaactaacttattcagatcagtagtcctatgatatgtcacattgtcaattagaattatttcaagttgtggggagtagatcccatcccggaggtcatcgagcacctctgacctctcaaactcgtgccactcccgctgatgtgggactacctccaagcccccaatcacctgctcgtcgtcgtcttcaacgacgtgcccgtcgatcaggtgcacccgtctcaaccttggcgacgccttcatgacatgcttaacaaagccgatctgccaccccactgcactgaagccgacgatggtgagatccttcaggcgatggtacagatgctgttgtgcttgcacctctagccaagaagccatctttaccgacccattgtcaatctgcatttaggtttcagagttcatgtgaattcacagatatattccattccgtaaaaaaaaacagatatattccacaaaaaatgaagcggatctttaagagaaatgacatggttgttaggttataatatatatgatcaataaatttgcatacgtgaacatggcatggctccagggcaggcgcagcatcaagcaggaggacaatccagaatatatcccaattcattggcacatttgcaatgaatagcttcttgagatgaagcaacgggctgggtaaagctattggctcaatccaaacctgcacacaagaaaaagaaacacaattttcacttagagacaagagcccattactacacttatatttttcatttcaggaacatatgatttgcccacctccggccctttgaactgtagaacgaggctctctatcgatggcatactcatgacgaatttgctgagtcgatatgttgtgttgctaactgcagaaggctcaaccttggtttttaagtagtccaaactgacatgcctaagtcgaggcacctcgccatagtacacctcggtaggctgcacgccccggcaagcaaaagtttcaagccaaggcagcgaatccagatagatttccacaaattcgcagttgtcaaccagcaacttcttaaacccagaatctggcacactgaactgaagaataggctgggagcttcggcaatgtctgatactgaagtccaccagagacacacagtttgacagaatacgactagcccctccataatacgaagctttgcacaactcgagcttggtgagccaccgaagcatcaagcaatcaaatataccaatcggcttgcagttgatcagcacgagccgctttagccgcatgctctggcattcatccagcacacggaagtcatagtcgacgcggtgctcttcgacgtcgagctcgagatcctcggctccccacctgccgatcgccgcggtgacccatcgctggatgcactcgctccacctgccactgccgctacgggtctgaagccttagctttcggatagttctgcggacgccgtcgtcgggaggcggcagaaggaacgcgtccacccgcttgacgtagcggcgcatcgcgcagcgcttcgcgcagcgctcgtagcgtcgcatgatactttccaagagcgggcgggtcctcctcgtccactgctgcatcctctccttcgtctcctccgtggcgctcctcctcgccgccaggtacgccgccttctccgcctcgtacgccgcgctgccctccgtccacagccgcgcgcctcacccggtggtagcgtgggggggaggatgtcgtcgacggcgaggtcgtagcacgtgtgggagcgccgagggagacgaagccatcgcttcgagaggatggtggtggctatcgtcgatcgcgcgtctagcctgtcgaggatcaggaggagtatgccgtcaggtaagctgctgatcatgtcctcgtcaatgttgtgctgatcttggctcatacgcatctagggaagaagaagatggaaccaacaagattacggtaattaacgtgagttcttgcagaaaatgaggggagtggattctaatccctcgaggggatatcccctcgtatatctttcaaattcgatgcaaatagttgtgaaaaattttgaaaaaaattgacaatatagagtataatgatgcctactaatccaccaaaattcatgttcaaattcgatctacacatcgagaaacaaaaaagacaaatttagatataaacagtacgctactattcatacgctgaatttgtcttttttatatctcgacgtgtgagttgagtttggacttaagattttgtggagttatatatatgtgttgtatgaatgttgtcaaatttttctaaaatttttcataaccgtttagatggttgttaaacaaacgaggaaacatctcctcgagagattagaatagtttcccgaaaatgagggactaaaaagtttctacagtaaaagtgaaaccctattttttctgtacccgcttggaggaggaggcgccggtgactgtgcagacgtcgtaggcttcttgagacggcggtagcatcgtgcacttgtctcctctgaagccatctgatctgatcgtcagtggctgaccgagcgagcgggcggcggcggcggatctgagggtttgtacctgcatatatgcacggaagagtttatgccggcgtgctggaagttgcaggacacgggctgcccgcatgcatatgtttacctaaagccagcttataagaatctagaaaaactaggtttctcagcttcgtttagttcattttctgaattctacaactgcttgttagaatctagactaaaattaagccggactgtttgagagagctgttgattctaggagaagctgcagcagctagaagctcccccaaacaagacattccagaagttcccttacatatatccagccttctccctaataatctaagatgcaagtgtctaaggttggagaaataatgcaaaatcgcaaaccgaatccaatcgatttgtatggcaaacgtgttaatctgacaagatgaacttagtttcttttggagaaaaaaagaacagaaaatcggcgaccgaatgggacaaaatgattgaaaaaaacaaatctaaactttgtgatcttgcagttgtataaaaatgtagctagaacttttgattcatactccgtcttaaattcaatcaaaaaagacgcgaatattaagaaagtgtctaatatcaaatactaattagaaggggtgaggctacgaacccagatcgtctagcccatcaccatgtggaactagccgaaagatctctaagcatttctcatcttaaattcaatcgtaaggtctttaagttttgtacatggtctaaattacgcacggaagaaccacccaacatggaagagcacagagttcagtaaccaaccagaacaaatctgaactccagattgccatagcattcttcagttcccccccctactctttgcaacttcaactttcaagaaaaacacagaaaaatgcaggttgcttcgtctgctatatctgcattcgtctcaatcaccctccgctcagcgacaacaaaaatgagcaagggcaaagacgcagcagcatgaacaaataacacacaagttcatttacaggtcaaacatcattttatactacactgttatgcataccctgtggctcagttaatcagttcagaattatttcgagttggggcgagctaatcccatcccagaggtcatcgagcacctctgacctctcacactcgtgccactcccgccgatgtgggactacctccaagcccccaggtacctgctcgtcgtcttcaacgacgtgcccgtcgagcaggtgcacccgtctcagccatggcgacgccttcacgacatgcttaacaaacccgatttgccaccccaccagctcattcaggcaatggtactgacgctcttgtgcttgcacgtctacccaagaagccatcttttccgacgtgttgtcaatctgcattcagatttcgaaattgttggtacagatgtaatcaagaagaaatggaagtgtataataggagaataaagacacgtttgtgatgtatatatgatcaataaactgcatacatgaacatggcatgactccaggacaggggcggcgtcaaggagggcgacaatccagaatatatcccaaatcattggcacgtttgcaatgaatagctttctgagatgactcaacgggctgggtagagccattggctcaatccacacctgcacacaagaaaaggcaacgcaatttcacttagagacgagaggccaaatatactgttagcacatttcaagaatatatatagatcgctcacctcaggccctttgaactgcagaacgaggctctctacaggcggcatcctcttgacgaatttgctccatggatatgttgtgtggctaacagaggggccaatgttgttgcctgcggtttacaagtagtccaaactcacatgcctaagctgaggcacctcaccatagtacagtttggttggctgctggccccggcaaacaaaagtttcaagacaagggagcacatccagatagattttcccaaatttgcagttgtccaccagcaaattctttaatctagatgttggcacattgaaacgaagaggacagtcaaatactggatcatatctgatactaaagtccactagatgcacacagtttctcaaaatactaacagccgctccaagaaatgatcttttacccaaggagagtttggtgagcctccgaaacgccaaggaagtaaatataccaattggacagcactagccgttccagctgcacattctgggatccatccagtatcttgcgaaagttaaggctgacgccgggttcttcaacgtcgagctcaaaatctttgactccccacctgccgatcgtggcgataatccatctctgaatgaatacactccaccctctgccaaaggtatgaagccttagcttttggatagtccggtgcacgccatcgggaggtagaagaaacgcattcacccgcttgacataggaacgcattgcctgacgtttgtagcgttccagaatagcttcgagtacactgattatcctaatccgccgatcattgtggtcctccgtggtgtaaatgtcagccagcctctgatccatagggcccttgctggccagcttcagggcatccttctccgccgcaaacgtcgccttggcctctttccacattcgcttcaccctatggtagcgtggagggaggaaatcatcaacggtgaggtcatagcatgtcatggagcgccgaggaagatttttccatctcttcgaaatgatagttgcgattattgttgtgtgtggatctagcttgtcgaggatcagggcgagtatatatcatcaggtaagctactgatcatgtcctccccctcgtagtagttgtgctccttgctcatacgcatctagtgaagtttgatgagaaaggataatgaataacagtcagcgatctaagccaataagtaatttccaggagtgtgtgaaaaaaaaaaatcagagattaatgccttcgacacaggatccaactcaacagcctacatggcgacacgagcaagggaaagtgtcaactcctctcacagatcacaagaacagataggttatcgtcgactcgacccaaccggatcgagcgccgccgccgccgccaagccgccaccaattcaattcatcgatgattcgagtcacggatacattgagtgttttataccgtatcccttctctctctctctctctcttacagccaacagtattacagctggcgaattctttccctattacaagaaagatgttacttggcccacattggcccactatagcgagggttaggaacacgagctcgaatgggcttctttgctgtagcgattgaagtctcttctatctcctgctctgctgctatctccagttctgctgtattgttctcctgttctccatcaggaaagatcttgacaaccccctccccttgaaaagtggcttgcccccaagccagtgccattggaaaacgctgctgaagatcttcccgatcctcccaggtggcatcctctgcaacagaatcagaccaatatacaagaacttgagaaacagtgcgattacctttcctgatcaatcgctggtccagaatctgaagaggatagacagttgatttcaggaatttgggcagccgagattgaacttgatgcttaaatccatgtgcaaccttgagctgggaaacatggaaaactggatggatagtactgtcatctggcaattgaagcttataagcaacagtaccgacccttgccaatatctgaaaggggccatagaacttgaaagccagcttatgacaagctcgagatgcaacagacttctgaacgtatggttgcagcttaagaaatacccagtcccctactgcaaattctctgaatgacctgttcttatcagcatgaaacttcatcttttgttgtactcggtgcaaatgctgttgcagcaattctgccatcagtttcctctcatgaagccaaacagccagatcgggaatcgcacaagtttccatagtaacacccaactgaagagggttatggccatagagtacttcgaatggtgtcttgttcaaagcagaatgaaagcaagtattataccaataccctgctaaatgtaaccaagtaacccacttaaaaggggctgcattagtgaaacaacggagaaacatttccaaacactggttaaccctcttagtttgcccatcggactgtgggtgataagcagaactaaggtgcagggcaatgccagatttcaagaaaagaaattcccacaatttgctagtaaaaattttgtctctatcagagatcagtactttaggcatcccatgaagtttgtagatgttcttcatatatgacactgcaacatctagggctgagaatgggtgtgacagaggaacaaagtgggcatacctggagaatttgtcaaccaccactagtatgcaattgtatctctctgattttggcaatccctcaataaaatccaatgagaccacttgccaggcaccttctggaatcggcaagggttgcagcagtcctggatatttagctaggtctggtttcgcttgctgacagatagtacaattctttacccactgctgaatcattttcttcatctgtggccaagcaaacagtgcttttactcgctgataagttactgggaaaccagaatgtccacctatagggctggcatgcaaggcagtgactagctgttgctgtaaggataaattatgcccaatccaaattttacccttgtaccgcaataccccttgcactaaatgaaaatgttccctggcagtaggatgcaatgccaattcagttaagagttgctgagcctgctcatcagtttcatacccttttaccactgctgttaaccaaaggggttggcattcggatacagcccacaattgatcatttgtctcttcatcccttcttgataatgcatctgcagctgcattagaggttccccttcgataacaaaccttatactgcagtcccatcaacttagtgaaagccttatgttgcaacggagtatgtaatctttggtcagtgatatgcattagattgtggtgatctgtgagtatgacaaactcatcatgctgcaaatatgatctccactgatcgactgccaataggatagccaggtattccttctcatatgtagacagccccctggtttttggacctaatgctttgctaacaaaggcaatagggtgcctgtcctgtgacaaaactgcccctattcccatatcacaggcatctgtttccacagtgaaagtttttgagaagtcaggcagtgccaaaactggggcactaaccaaagcttgcttcaaggcattgaaagcttcatccatttgtgctgtccatttaaagggcacccctttcttaagcagctgggtgagtggtttgttgatagttccaaagtttctcacaaacttcctgtaatatcctgccaaacctaggaagcccctcaactgcttgactgactgaggaattttccaatgcagcacatcagcaatcttagaaggatcagtggttactccatccttgccaatgatatggcctaggtaagccagttgttgttgtgcaaaggaacatttactcaacttgactttccattgttgagcttgaagtagttgcaaaacttgttctaaatgctgaatatgcgatggtagatcagggctatagattagaatgtcatcaaagaaaaccaatgtaaattttcttagcactgtcgctagggtatcattcattgccttctgaaaagtagctggtgctccagtcaacccaaaggacatcactcgatactcatagtggcctgagtgagtctggaaggctgtcttgtgctcctctccaggttgcagccttatctggtgataacctgcccttaaatcgagtttagagaaatacttagctccagaaagctcatccagaagctcatcaatgacaggcaaagggtattttcccttaattgtaattgcattcaggtgcttatagtctatgcaaagtctccaggtgccatctttctttttgactagcagtgctggtgatgaaaaagcactattgctgttttgtatgactccagactgaagcatttcagttacttgacgctcaatttcatccttgagtgctggggtatgcctatagggtctgaggttgactggacttgctccttccatcaagggaatcttgtgatcacaattccttacgggtggcatttctgtgggttcttggaacacttcctgaaacctgtccaatacatgcttgattgaatcaggaatcactacatcagatgtctggtcagtcttctgaatctgtagtacatgcattactgactcagtcttcataagccctttgatctgcagagaagtaatctgagggtagtggtcagtttgaggctagataccctcaattctgatcaaccttcttgccagaggaaattcgagccatttctgcacccaatccaccttcatagggctgaactgttcaagccagtccatccccaggatagcatcgtaccctcccaattgtagatgtcatgtgggggcgcacgtatgtgcgacgccgcagagcgcgagacgttcgccgagctgcggaacgcgcggcgcgcgcagaggcagaacgcgcggctgcggcagatcaggccacggtcagtggctaggatggaaaggataattagtttcctgttattagcccttgcatttaggagcaattagctctttggttagttgggccttaggccatatatctctgtaatcggcacattccagaaattaagcaatttggttattgtcccaattcttcccttctctcgtaactctcaagcctgcggcggaggggcaaacctcgccggagaagacggaccgtggctacgaactccgtagccaggggccagctaccctagggatcaacgcccttgacaacctggtatcgcggtcacgtcgatcttcgtcttccgttgccgactccacctctgccccagccaccaccgatcccatctacgactccaccaccactccagccgccgcccctgctgtcgctccgcccaatttcccacctgctgccgccgcctcccctgcgtcctcaccctcagtcgcgtcctgctcggcccaccacatgggtgacgacctcaaggcctccatcgaggccctctccaaggacatggcgctgatgcacgagtcgatcaaggccaacgccgcctccatcgcggccaacgccaaggcgatcgctgcgctcgccaccaccaccagttcatctacgtccggcgcccgccccggctttggcgatcagccgccagaccggccgcccaagcactggcgacccgacttcccgcactacgacggcaagagcgacccgctaatcttcatcaaccgctgcgaatccttcttcctgcaacagcgaatcatgcaagaggagaaggtttggatggcctcccacaacctcctcgagggcgcccaactttggtacatgcaggtccaagaagacgagcgcggcacgccgacgtggactcgcttcaaggagctcctcaatctccgctacgggccacctctgcggtccgctcccctgttcgagctgtcctcctgtcgccgcacgggtacagtggaggactaccaggaccggttccaggccctgctcccccgcgccggtcgcctcgacgaagaacagcgagtgcagctgttcaccggaggccttcttcctccgctcagcctccaagtccagatgcagaatccccagtcgctggcggctgccatgagcctcgcccgccagttcgagctgatcgagcagtacaccgccgttcccgccaaagctcctggtcggggtgtcctgccggcacctgcgcctcggccgcaactcgccttgccggctccagctggggctgccaagcccgcgccgcccgccgccaccgctgctgataaccggccggtcaggcgcctgaaccaggccgaacaggaggaacgtcgccgcctcggcttgtgcttcaactgcgacgaaaagtacagtcgcggccacaacaaggtttgcaaacgtctgttctttgtggacagcgtggaggacgaggacgaggaagcgccggaggacgaggtcgacgcggaggcaccggtgttttctctccatgccgtggccggcgtcgccgtgggacacccgatcctgctccgggttcagctgggcgcgaccacgctcgtcgccttggttgatacagggtcgacccacaacttcatcggcgagtcggcggccgctcgcaccgggctatccgtccagccgcggccacggatgacggccacggtcgccaacggcgaaaaggtggcctgcccaggcgtcctccgccacgcacccatcaccatcgagggcatgccgttccacgtcgacttgtacgtcatgcctctcgccggatatgacatcgtcctcggcacccagtggatggccaagctgggccggatgtcctgggatgtcaccacacgcgccctgacgttcgacctggagggccgtaccatctgctggcagggcgcgccaaaccaggacgggccggcagtccgcgcggccagcgcagacgactccctattgggggggctcctcgactccttcgccgacgtcttcaccgagcccacaggcctgcctccacagcgcggccgtgaccacgccatcgtcctcaagcagggcacgtcgccggtggctgtccggccctaccgttacccggcggctcataaagatgagctcgagcggcaatgcgccgccatgatctcccaaggcatcgtccgccgcagcgactcggcgttctcgtcgccggtcctcctcgtcaagaaggcggacagttcgtggcgcttctgcgtcgactacagagcgctaaatgcgcttaccgtcaaggacgcttttccgatccccgtcgtcgacgagcttctggacgagctccatggcgcgcgcttcttctccaagctcgacctgcggtccggctatcaccaagtgcgcatgcggcccgaagatatccacaagacggcgttccgcacccacgacgggctgtatgagttcttggtcatgccgttcgggctttgcaacgccccggcgacattccaagccctcatgaacgatgtgctccgctccttcttgcgccgctttgtccttgtgttttttgatgatattttgatctacagtgacacatgggctgatcatctccgtcacctccgggctgtgctgacggtgctcagggagcacaaactcttcatcaagcgcagcaagtgtgcctttggcgtcgactccgtggcataccttggccacgttatctcggctgctggtgttgccatggacccggcgaaggtccaggccattcgggagtggcctcagccacgctcggcgcgtgcggtgcgcggcttcctcggcttggcggggtactaccgcaaattcgtccacaactacggcaccatcgctgcgcccctcaccgccctgctcaagaaggaaggattcgcctggaccgaggcagccacggcggcgttcgacgccctcaaagccgcggtctcctcggcgccgatcctcgccatgccggacttcaccaaggccttcaccgtggagtgcgacgcctcctcccacggctttggcgcggtcctcattcaagacggccatccgctcgccttcttcagccgtcctgtggcgccacgtcaccgcgccctcgctgcgtacgagcgcgagctcatcggcttggtgctggccgtccggcattggaggccgtatctttggggccggcacttcaccgtcaagaccgaccactacagcctgaaatatcttctggatcagcggctgtccaccattccccagcaccattgggtgggcaaactgctgggcttcgacttcacggtggagtacaagccgggcgcagcaaatactgtggcggacgcgctgtctcgtcgcgacaccaccgaggacgcttctgtcttggtgctgtctgcgccacggttcgacttcatcgagcggcttcgccaagcacaggacgtcgacccggcgctggtggcgctacaggcggagatccgctccggcacacgcgcagggccgtggtccatggccgacggcatggtcctgttcgctggccgcctgtacctgcccccagcgtcgcccctgctccaggaggtcctgcgcgctgtccatgaggagggacatgaaggcgtccagcgcactctccaccgactccgccgggatttccactttcctaacatgaagagcgttgtgcaggattttgtgcggacctgcgaggtctgtcagcgctacaaggccgagcacctccagcctgccggtcttctccttccactgccggtgccacaaggagtgtggactgacgtcgcactggactttgtcgaagcgctgccccgtgttcgcggcaagtccgtcatactgactgtggtggacagattcagcaagtactgccacttcatccctttggcgcacccatactcggcggaatccgtcgctcaagtcttcttcgccgagatcgtccgtctccatggcgttccacaatccatggtgtcggatcgcgacccggtcttcacgtccgcgttctggagcgagctgatgcgtctggtgggtacgaagctccacatgacgacggccttccaccctcagtccgacggccagtcggaggcagccaaccgtgtcatcatcatgtacctgcggtgccttactggtgatcgcccccggcagtggctgcgctggctcccgtgggcggaatttgtcttcaacaccgcctaccagacctcgctgcgggataccccgttccgggtggtctatggccgcgaccctccctccatccggtcgtatgaaccgggggacacccgcgtggcagctgtggccaaaagcatggaggagcgctcagagttcctggaggacattcgctaccgcctggaacaagctcaggccatccagaagaagtactacgacaagtcccatcgtgcagtgtcgtttcaggttggggactgggtccttctgcgtctccgccagcgcgccccagcgtccctgtcgctggcagtctccggcaagctgaagccgcggtatttcgggccctaccgcatcgcggagatgatcaacgaggtggctgctcgcttggcattgccggccggcgcccgccttcacgacgtgttccacatcgggctgctcaagaagtggcacggcgcgcctccagacgctcccccgccgctgccgaacgtgcaccacggcgcggtggcctgtgagcccgagcgagtcatcaaagcccgcttggcccgtggggtgcgccaagttctggtccagtggaagggcacttcagcggcgtctgctacctgggaggacagggagccattcttcgcccgctaccctgctctacagctcgaggacgagctgcctctcgacggagggggagatgtcatgtgggggcgcacatatgtgcgacgccgcagagcgcgagacgttcgccgagctgcggaacgcgcggcgcgcgcagaggcagaacgcgcggctgcggcagatcaggccacggtcagtggctaggatggaaaggataattagtttcctgttattagcccttgcatttaggagcaattagctctttggttagttgggccttaggccatatatctctgtaatcggcacattccagaaattaagcaatttggttattgtcccaattcttcccttctctcgtaactctcaagcctgcggcggaggggcaaacctcgccggagaagacggaccgtggctacgaactccgtagccaggggccagctaccctagggatcaacgcccttgacagtagaactctgaattcagttctgaaagagcaaccttgtatccaccagttgcagttaggtatgcttctatcacactgcatggttccaccgtcagcaatcttaatctgcactggatgtgataaggtctgaattcctgccagctttctagccacttgctcatcaatgaaggagtgagtacttccactatcaacaagcattaagagttccaagccctgaacccaacctctcaccctaatagactttgaagattccactccagctattgcctgacttgaaactgccataagagtgccctcagcttcagccacaatatcatcaccaactgggtcatcatcttcttgcaaagcttctaaaagctcttccatgacatgtaactgtactgttgaggcacatttgtggtcccttccccacctttcaccacaagtgaaacacagccccttagattttctgtaagccttaagtgaggacaatctatcatctctgggagtaatcttagctgcttcaggggttttcttatcctcattcacaacaggtctcactggtagaggtgtcaaagaaacttgagcagtgttcctgaaattggacttcactggagtagagaactccaaccttcgagttcccagcattgcctcctcctgtaataaagccaaagagcaagcagtatccagatcttgggggcgttgcaccataattacagtgtgaatagcatcctttaaaccctctacgaacttagtgacgaagtacacaggcttcagttcactatcgtaagcaatcaattggtgcatcaagctatcaaacttatccacatattcagttacactaccagtctgtctaatgtgtatgtattgccttatcagctgttgatgcctatccctagaaaacttagcacaaactttctcacaaagttctacccaagtgactcctattaattgggacctaactgactgcaaccaaaatgaggcattcccagaaaaattgagggtggctatcctaacccaatgagcagggctgactccataagtatcaaagtaggcttcacagttttctctccacatttgggggttatctccatcaaattgtggacatggcataggaggtaaaccagtgcttgtgcccacagcactaccagtaaaagcagttcgcatggctggatcatggaaataaggagcaggtgtggagaacaagattgagttcgtaccattggccgggggtggtgattggggatgagacccaagcacctccgcccgtatttcagcagcattgcgggcgcccaattgggcggtaaggtcaggcttcggctccgccttgttcaggagttgaagctgatcgaactgaagctgcagatttccaacggtggtcgccagatcagtcaccttcttctcgagctgtggcttccacgaatccactgatgtcttgaggttcagcatatccgcgcgggagttcttctccagatccaccaacttggagtccgtctcggtcagcttcttcaggatcagatccagcttggcctcgttctccatgattttgaacgcttgcttggtttgataccttggcttttctagtttgacgcaacgggatccacttcccctgttcctaatccagcaaaccgagaggggcaagttaccttttcgcggatttcagctgcaagagccgatctccaatccccaatcggaacccttttgctgccggatcaagaattgggtgggatagtaggctctgataccaagttttgtcaattcctctcacagatcacaagaacagataggttatcgtcgactcgacccaaccggatcgagcgccgccgccgccaagccgccaccaattcaattcatcgatgattcgagtcacggatacattgagtgttttataccgtatcccttctctctctctctctctctctcttacagccaaacagtattacagctggcgaattctttcccctattacaagaaagatgttacttggcccacattggcccactatagcgagggttaggaacacgagctcgaatgggcttctttgctgtagcgcttgaagtctcttctatctcctgctctgctgctatctccagttctactgcattgttctcctgttctccatcaggcaagatcttgacagaaaggtttaagcgaccgaatttttagactaaattaagactttctacagtaaaatgaacacagtgagctgcatttctacaagaaacaacaaagtattgtttcatcaatcatcttgaggccgccatctgatggtgcaatccaaaataaaggggtgctaaactagtcgaccattattaaacactctaatcctacaaagtacagaccagtaaaaaaatgcatttttttcttcaacaatataactgtatgagctttcaatcaaaagccgggttagcatgctgccttctgtctaagattaaaaaaagaaaaaaggatactgtaacagtaggacgggggagaagggatacctacttgaaggtcgagggggcaacggcgatggggacgactgtggagacatcggtagccctcttaagtcggcggtagcgtcgaggggttggctcctcagtaccatcggatggatcttgatcgtcgctggctggcggaccgggcggagcgcgagaggcagcgacggattggaaggggcggaggcacggagaggaatgggaggggcggcgagggatttgcagggggaggtctttccccgtgtgccattaaaaaagatggtggctgtctctgtgtcactaaaaagttcgagcctccctctataccatcgtcgaactttatcgcgtcctccacaccactccgtccgtttttttcctaacggtgggtaacggtgcagcaaaatgactttgttaccctttgaacaagtttgctcccttctttgctcttgtccggatttggtatagaagcaatttcgagtgattattttcctttttctcgaattgtttttttggtaggtttgtttggcgtgagcaatggtgaacgacaacgagcaggtggtgagtggtgacgatcgccaaggccagcccggacacgtccgagaggaattgccgcatctgctacctcggcctcgacagcgccgccgccgagtccggctccggcatgttcctcgactgctcctgcaaggacgacctctcctgcgcccataagcaatgcgccgagacctggttcaaattcaggggcaacaggtaatctctggaacgccgtcgtgcccacggcgctctggaacgcgcaccggagcgacgccgccacgacatcatcttcctccccgtcgatctgcaccacgccaagttgagctgccgcgccaccatcgtcgtctcatcaccacgaccaaaacccctcaagaacccccaagattgatgcaccatggacggagaacggcatcatcttctccaactccggccgccggcgtcaaacgtcgattccgcctcctccggtgagccactgtacaattcctcgcgcacacaccatccctgtggcctcactaacctcgtggacacacatgcatgctagatcttggagacgtttgagctgtcgccattctcccggagctccgcatcgccgtcgagccgttccaaccgaagctgtcgccgcgcaggaggtagcgtcggccgccgcagttgaacctgcgcccagccgctgcgcagcgccggtcgccacctccatgacgtcggtgccggtggcctcgcagagcgcggagatggcgttcaccgatgacaccctctgcaccaagaacgcgttcacggcgagcttggacagctccgccgaccagaggttggtggtgatgatccggtcgacggggacccattgcgcgtacacgtccttcagcgcctgcacggcggcgatgtcgcggccaccgatgagaacgcaggtcagcgacggccgtgccctccgccaggaactccaggttggagagcacctggaactcgacgacatgggcgttgtgcgcgaggatcttctctatggcctcggccgtcttgacggggacggtggacttctcgacgacgaccttgctggagcgtgacgagtcggcgatcatcctcgccgcgctctcccagtaggcgaggtcggcggccttgccggcgccgcctcgccgccttgccgccacgccacgcctggccgcttgtccaccggtgccgcctggcctctctctgaaacaaagcagagactgcaaagggcaagagcgacatttttcctatccagacccacatgtcagagctgccaaacggttaaagctatatagaatagcgacggaatggtgtggagggcacgataaagttcgacgatagcatagacggaggcacagaggatgatcgaactttttagtggcacagaggcagccaccatcttttttaatggtacacggaaaaagacctccagggggaggggattttcgcttgttcgtggagctgcgagttcgcgggcggtccacgggcacgtttatgcaagtatctgaataaggattttgccttgtgtgtaacacagtccgcgtcggattgcatttttaccaaaaatcagtaaggtttggggctgttcactttgaatcattttcaaccatataattttttgtaaaattaccaaaaaaaatatctacatttgatttgttgtcaaatttagtaaatatataaaaaatactgccaaaattttgccaatattaccattgctaaaatttggtaaggtttattttggctacaatctaagcggacctttggtttcttttccaaatcacatccgacactttttttttaccaaaaatcagtaagactaaatctcgaatagccatatatcttcaaatgtttcttccagcaaatattgagcagataaaattcctgatgtaaaatattttttatggatggagtgcgtgaaagaacagtacacatcctatcttactgtaaagttataacccactaattctaaaattcaacatgtaaacatgtcagctcaccatccactggcaataattatatacaaaacttatgtaagcatgcaacatcatatataattcattgaattctacaaatcaacaatcaatcatcttccttcacattatttttcacaatatttttaacatatatatccaccatttttaatacttaccatatatttatccatataatcatataatcacagtgcgggatatcatatttcatctagagtctcatacagactctactaaatttattctctcttaacataggctgagtttgagagagggggataaagaagattggagagatacgcaaaacgaggtgagccattagcgcatgattaattgagtattaactattttaaatttcaaaaatggactaatatgattttttaaaacaatttttctataattttttttttgcaaaaaatacaacgtttagtagtttgggaaacgtgcgcgcggaaaacgagtcacaatctccccaatctctccccaatgtcctttgaaagaacgcagccatagtgtgacaaaccagttttatttgttgttaacacctaaaataatttttacttttagcttaattattaaaaaaataaaaattatttagtaatttctacagtaaaacgcggggaatcatctagtttccttaataatggagataaatgaatcgatcctaatgatatccccatcggaagactgtcagcttcacactgctaatcaaatcaaacagccaacaagcatgaagaaaacttgatattttgcataagagtcataaacgaatgatatgcatgcacattcctatctagtagaaagctacggattattatcacgatcacagcacagccatcaagcagcacataagcatcgactatacagaggttggagagtaccaaaagcggctactcactggccgaagatcccgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgatgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatagactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgatattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggcccc

SEQ ID NO: 21265 - DNA, 19416 bp, Oryza sativa
  unsure (1)..(19416): unsure at all n locations
ccctcccagagggcggtaggcgactatttccgtcaattttcaaaatggaaaattatttttgtaaaacttttaataagaaaaattataaataaaaaaaattcgaagatcccgaagcagctagtcgacggcccaggcccatttaaagtcgcttcccttcaccagtgtggccatggcccatttgagaggcccacggcccacatagaatccgtcccattatcgccattctcctccccgccgccaatctgctccggcatcaggtacatgtgcctcttctccatctcgtttgatcgaaagcaaattggtttttctttgtcctatgtggtagtatttgttaggctgttgtgatgccatctggcttttgaaggcacatctgcagctagatcaatcgcacgcaggacaggacgatcgatcaatcggcttgggagttgggagtctcatctgtttgttgtcgccctcctcaaacagaagccttgctggaggtactcttcttccttgcacatagctgctagatctaggtagctactattgtttaaatcgagggtttgcctctcaacaattcaccttgttttgtccttgcctttttcttgtaactaatctggatgtgtattttcatccctcgagaggatatccattcgttgattgcatgatatctaaataattatgattttttttaaaaaaaattgacagcatagattaatatgaaatatatattcagttcaaaaaaatatgaaatatatcactccacaagcatgcaaaaccaaactggcaaactcaacttctgcaagttgcaacaaaaagaacaaattaaactaaaaatagttatcgtgcattcacagttatatttgttataacttgtagaagttgaatttaaacttgcacatttgtggagtgatatatttcatattaatctatgttaccaatttttttaattttttttatgattatttagttgagacgcacgaaacgagatgatatgctgatgaaatcactctcccaactaatttcaccttttctttttaccccttggactgcgtggtatttgtttgtcttttctgatgccatctcgcctttgagggcacatcacatctgcagctagatctaacgcatcatatataggacgcacaatagaatttggagtctcatccgtctgctgtcgcctgcaagaggtactcttccttgctccgagttgctagcgctatttacttgtttgctctgaattgctagatctaagtaacaagtatctaaatctcgatgagttgcctctcaacaaatcctcatctttctattctctcctctctgtactagtaactaattttgacttgataaatatattttgtcctctccgttgtaaccaattttgcctttttcttattttctcctctcacagtcacagtccgtctgtatgtatccgatgatggagtcgactttgggccactcgcggcgatttctgaatctgatcgtcggcatgtctggtgtcaaatcgctctgctgcatcgacctgatgcaccagccgttgttcaatccaacaacacctactacacagccaccaaacggcaacggatcgcaatccgtcccccagacaccagcggctttgatgatggagcagcttgtggttcctgcctcgagtttcagcttccaagcttcaccttcagcacccaactacgaccaacggaagattgagtgcttccccctgaccggtcgccaggtgatctgcgcggaccagttggggcgcaccttccactgcgacgcggagaggggccatgtcaggagcattccctgtctccacaagcccaagtcgatgcccttgtctctcttcgtacccaatcctgatgtcgacaatgacaaggaccttaatcgctaggactggggcagcagcctcttcgtcattgagaggttcccaaagtctgaggttagctatcaagtcgaggccttcgtctaccgccatcccagtccagcacgctactccaggacctggcactgcgagctccttcctcctccgccgtatctccatgaacccaacaagtacaatcgccgcctggagatatgctcctatgcagcacttggctcctcaagcatttgcatatccgtcaatggcatcagcacctaccgcctgaacatcgcaacccagacatgggaggaagttggcaagtggacccttcccttccacggcaaggttgagtatgtgcctgagcttaatctctggtttggcctctctgccgagtcccaccacttggctgctgctgacctctcctcgttggaattggactcccagccacagctactagtaggaccttggaaggagcttcacctgccggaggaatggaaggaatgcgaggattctcagcttgtcagtctgggctttggcaagttctgcgtcgcaaggttcttacaccctaatgataggattcacaaaggcgagctgggcgatgaggaattatctagccagaattgtatcactgtcttgactggtgtggaggtggtgccacgtgtcccgaatgccaacgtcaattcaaatagcagcggcagcgttagcagcaacggcatatcggaactccggatgatccctcacaaatcgagatgtcacacttctaatggcactatcgtccatactgtgttctagtaatttcgggctttgctttcaagacttctgttttatccattatgttttgtctgaataacttttggagttgaatgcaagagataatggcatttttacctttggacttggatcgagtatctccttgtgttcattgtatgctagtggtatttgtttcctcatctcccataatggcaggttatattaccatactagaaaatagatgcgccagttaacgtgcccgtggattatataacctgctcgtactatttagtacttccaggtgaggacatgttaccttgtgcaaccgtgcacatgcaatacacgtttcctgtaaattatgccatagtaatcatataaagaccctaaaaatttattgcattttacaacaataaatatcacacaatacatacatactaaaaattaactttatatactataacgtagtttcacatactacaaaacgttaatgtaaagcagctaactttgccaaatatataatgtcatatatagcttgataaatatttgaaaagctcatagaaatgtgtctttacggcattgaaatgaagtccgttggctatagtatttaatcgaaaagttctccacatctccagctccactgtatacataatagcttctcttcacctacagccacttcaaatatacccatcttcatctataattaaaatagcatttacatgatcatcactaaatttatatcacccgcggtgcaaccactagaagttcatctctctttcacttgaaaaaaaaatatgttcatcaaaatagtatccagaaaattatcatcagaacagtattcaacacggttgccttacttgaagtaaaaaggagataagaaagtgcgaacattctggaaacacctctacatttgatgttacaactatgcataccagtaacgtagattatatgagcatgtctccttgcctatataagattaggtctatataagaaatgaggttattttttataacaagttaatgttttctcctttgcaggttattactctaattacccgatggcaaaatcggaaaaaaatacgaatagaaaaaaaagcgcgcgcggggaggagggccagctggcgcgtacgcacgcattagccacccccaataaagagagatctgcggtggggcgcggcctacgcatccggcgcacacgcgtgaactaggaggcccctaacttatgaggtggaatatcaaagttgatgtgacttatgggatgaggatttttgcaactttcccttcaaattattccctcgaaaaatttagaaaactattctatttattttgggccgaaatacctccagccggcccatcccttcttttgtttccttccctcctctggttcctggccctaagctgattcgcttcaccagcttgggcaaggtccattcaaagcggcccacggacagaagccgagccgatctcctccccgccgccattctgctgcggcgcggtggagcatcatcctggcccttcttccccttgtccggcctcgctcctcaggtccgccgcttgcatcttcatcttgtttgatcgaaaggcaattccttctcttccttctgcgtggtatttgttcgtcgtcttttctgaagccatctcgcctttgagggcacatcacatctgcagctagcataggacgcacaattaatcgaatttggagtctcatccgtttgctatcgcctgcaagaggtactcttccttccttcttatcgacatacaatatcctggttctttcccttctctatgtaattaattgtctctttttgcttcttttgacggttgattagtaagtcctgtgccgatcgactcgacgatgagcctctcgtggcgatttctgaatctgattgtgggcgacaatatgcctcaaaccagatcaatttgctgcatcgaccttacacgacaacaattctttcagccgtcaccaccagaatcagcggtagcgcaagactcgactgctcagacaccggtggcagcttcaacgatggagcggcttcagcttccgaatccgatcttgcgcctgtggaatagatacttctttccgctctcagagcacaagatactcagcgtggacaagtccgggtgctccttgctctttgatgccaacacacgccacttggtgaccatgccattccttaacaagcccaaacgggatcccatctccctcttcgtcccaaacggtgatggtgacgatggcggcagcatcttgtcatggacagggttccaaaaccagagataggcagccgcgcgcaaaccagcgatcaattcgaggccttcatctatcgcaagaattttgtcgactgccaactcctcccgccaccgccatacctccgtgattacaagcactgtgagaggcgccacaagatcaatgcttatgttgtggtcgatggcggctcacagatatgcatatctgtggaggacgttggcacctattgccttgacacggcgagccacacttggagccaagtcggcgactggacattgcccttcgacgccaagctcgagtatgtacctgagctcaagctctggtttggtttctctgctggtgcccagcactttgctgcttctgacctctcctccatggattgtcagtcccagccacagctagttggtccttggaaggagcttgaaccacccatggaatggcgggaaacgtatgattctcaacttgtcaatctgggctctggcaggttttgcatcgcaaggttcttccaaactaagcgagagggctgttatgacgaagacgatgtatatctttggcaggatgttacggccttgaccggtgtggaggtaaagccgtatgtgcacgatggcagttacagtggcagtggcagtggcagcaggaatggcgaagtaaaacttgaaatgcacactcacaagtcgctgtgtcacatgactgagagatttggtatagatgatgtattatgaatgatattgaggctttgctttcaagcagatattccttgttttatccgctatatgtatcgtctgcgtctgagtagtttaggtaatgtatgagctatctaataaagattgaaagtgattgaagaaagaattgagaaaaagcttagtagttggaaaggtaaacatttatttgtcggggaaaggttggtcttgattaattctgtactttcaagtttagctatgtttatgatatctttcttcgagatactcaaaggggttcttcaaaagattgattattatagatcacggttcttttggcaaggtgatgatcataagaaaaagtacagacttactagatgggatattatttgccaacctaaggatcagggaggccttgggattcataatttggaattacaaaataaatgtcttttgagtaagtggttgtacaagctaataaataaggaaggggtttggcagaacttattgaaaaggaaatatctttataacaagtctataacccaagtggacaagaaataaggtgattcccatttttggtcagggcttatgaaagtcaaaagtacttttttagatatgggctcttggattgtgaatgatggggaacaaataagattttgggaagataaatggctaggtaacttggctttcaaggataaatttccatctttatatgctatagtccgaaggaaatcatccactattgccactgttatgggatctgttccgcttaatatttcttttagaagagctttagttggtcagaatcttgtatattggcatgagttgtgtgcttctattgtacatattcaattaaatccttcttctgactgttttagatggaattatcatcagaatggtaggttctcagtaaggtcaatgtatctagctttaattaacaatggttatgttgagaggaacaaatatatatggaaacttaatatgccgcttaagattaaaatctttatgtggtatttgcttaagggggttgtgttgaccaaggataatttggcgagacggaattggaatggtagcttaaggtgttgcttttgtatgaaaaatgaaactattcaacatctcttcatggattgtcattatgcaaaattcatatggagagcaattcagttttcttttggttttaatcttccaactagtatatcttatatatttgatgggtggcttttggggattgacaagaaaaagattaaactgatactggttggagcttctgccatttgttgggctctatggttgagtagaaataatttggtttttaataaatcaccatctatttcatatatgcaggtaattttcagggcaacgcactggctccggttttgggcacagctacaaaggtgtgaggatggtggggagtttctaaaggttgcatgccgcaagttggagtcgatggttatgcaattatttgccaattatggatggaggttcacaaatagacttcaataaatgtgttctccttattttggcttagtttcctctgtttttgtttggtgtcctatttagctgaactacgttcttttctggattgatacaatgtaataattggttgtagctctttttgagcaaaggctgggatgttaaattccattatctaaaaaaaaatccgtaccttattgcaatttaagacatgaaagtctccgggtggtattatgttaactagctgagtagcccacgcaattgcgcggctagcatcaatttaaaattatctactttttacaaataattttatttaaaattatcattcaattgattctaataattttgtagtttttaaaagccacgtcagtcgctaccccttacttctttgtcacatttttatttgcttactcgatctaccactgctattcatcatctttaaaactttaaaaaaaattaggccttatagtttttagagttcattgtcttgttgggttttgttttcataatttttagaagtatcgtcaaacatcgccaatttactactctacggctcatccgctgccacctctctttattgtcattgggattttaaaaatcaaacataattattgtttgtgttttttttactttttataagtctcgtcaaattgttattagcttcgccactatactgctctacagcccacccgtagcctcccctccttaatgttattgagattttaaaattgaacatgattatcattggggtttattttactctccataagtcctatcaatcgacgtgaccatgtcgcataacggcatgcccattgtcactgagattttatttgaggttttgtttatagtttctagatatcccatcaaccgcgaacacactccttcacaggcctattgcttctctcctctttattgtcatttgtcatcgttgtgttctaaatggaatttttttttataatttttagaagtcttgtcaaacgttgcctccatactactctacggtccgtccactgcctcttctctttattctcattgggattttaaaaatcaaacgcaattaccgtttgggttctttttttactttctagaagttccatcaaactgtcagcggctttactactgtactcatgtacagttcgcccgctgctccctctttattgtctttgagtttttaaaatttgaacatgattatcattggggtttatattttaatttttaaagtcccgccaaccattggctttatctgagtaatatatttcctttccccgaaaaaaaagtcccgccaaccattgtgaccatgctgcttaatggcccgtccatcgtccctctttttaatcatcattggaattctatttggggttttgttaatagtttctagatattccattaactgccaccactctaatcttttacatgcatgttgcttctcctatatttattgtcatttgtcatcattttataatttgtagaagtcatgtcaaaccctatcaccatacttctcttcggcctgtccaccgcctcttctctttattatcattgggattttaaaaattgaacataattattattttagttcatattttactttctataagtcccgctaaaccgttagtggttttgccactatactgctttacagcttggccgctcccttcctctttattgtctttgagattttaaaaattgaacacaattataattgaattttatttttcacattttagaagtaccgccaaccgccaagaccgggctgcttaacggcccatacggcgtctatccttttaatcataattgggattctatttgaggttaagttaatagtgtttagatgtcctatcaaccgccaccattctacttatttataaacctgtggcttctccccctttttattgatatttgtcatcatttgtgttctagatagagttttttttagaagcccatatttttcattccgatatttttatttataaattatattactacctgaactctaataatatttttataatatntcagaattaatatttttttattcaaaatttaattattctcgtcatatgttatagaaggtctctcatttcaatagtatttattttttaaaaaaatgtattcctagttgaactattattttttatttttttctaatttcggaatttattttattttttatttagaattttagttaatatcgtatttgtgtcctatatgatttattattttaatattttttttattttcaattttatagttgtttcaaaattgtattcctactcgagctatcttttttatttatctaatttctgattttattttatttttattctgaattttaattaatctcgtattggattcttatatggactctttttttaatattctttattttatttccgaatttcagttatttatttattgtattcctacttggactcttcttttttccaatttcagattttattttatttttatttcgaattttaattaatctcgtattgggttcttatacgaactcttctttcaatattcattatttttaatttcaaatttcagctattttttaattgtatttctacttggatttttcttctagatcgattgtgggctatctccgcctaatgtctcttctatcttagcatgtgcatacggcatgacatgcatgcagtgttctccctctttactatcaatggccatgtatgtatggcatgtatattttccagccatatatcaaacgtggatcactatttcaatttgcactctaattaccatctagatatggattaatgtaatttgttttgtactctaatgactgtccataaaaccataacatcaatattcagacaacctgtccgactcctaatcaatcaacatgttcgactcctattcattcaacatgtccaactgccatatttcctattatatcaaagttgctttctatttatactcaatattgtcctagataatctataccactaaaaatctagtacaacctacgatctaatggtgtaaatatttatctttttcttcaattcatgtgggaatttctagcctccacagcgaacatggtgtcttttttcaaaactgttttaataatataatagatatttttctctgaaatatggtagatcgtaagttatggccacctttgtttatgttttatctttcagtgctgaaatttatatggacgcgtccgatctgacgcaaaacatcagttggtaactgttgttcaaaatgttctatcactcgattaaaaatgttccaaaccattgcagcatatggttattattttggattgagcaatttagtaatggctggtgaagaagcatctgggattatttcctcctaagctgatgtagcaaacatgtcatccaggaacacaagaacatggacaagcctccacatctgttgacactgtacaccttacaattggagcttattcatggcttcttccactgcacgttcatagtatctgtcacgtcccaaaacgactctaaaatacatcatctaaattatgcctagaataattaaaacccgtgtgaaagcctccaacaattaaaaggtgcaaagttaaaagccaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggcttgtcccatctccctccccctctccccgcggcccatccggcctctccccgcgcgcgcgccgctgacgggcgggcccgcccgccaccctcgctgacgggtggggcccacctgtcatccccttcctcccgccgctcccgccgcctcgtccgcgccctagcgccgcttccgccgcgaatcccgccgcctcccgccgtctccgcgtgcaataaagagagggaaatcactccccgtgatcccctctcccttttccccccattttccctctctctctcgcgttcaaacgggcggatttgcccccgcaaatctcgccggcgccattgatggcggccggacctcccgcgccggtttcctcccttccccggccaccctctctcgacccggctctatttaaaccctccctgcacctcctccgtccgtttccgcctctcgccgcctttcctcctcgccggaatcgagctcgcgccgtcgctctctctcttcgccgtcgccgtcgagctccggtccgccgccgtcgtcgccccggaccacctcccacctcggcgccgcctccttcggcttcgccgcatcctcgccgacctcgtccacccctccgtttcggtcgccgaccgccggaacgccgtcgaccccgtcgacccgagccgcgccgccgccttccttcgctccggccgcctttttcgtcgtcgccgtcgacctagggtgagccgtggaccgccgcctcttttcccccttccctttccctctctcagccaccgtgcctatggccgccgccggcgaccataggggcgcgggcgccgcctcccgccggctgcgccggcttggccgtcctcgggcgcgccgagtggctgccgcgtggggcccggccgtcagccgctcgcgcccttaggtgcggctgacgcgtgggacccacggcgccggccggtgtgagcccgggtgcacccggtccaccgtggaccgtgaggctgctgcgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaagccatttttgtgctttgttcctgcttgttatatggagtttattagagtaaaagccttttcttttctgttggtcgtgtagacgctgcagcttcggaagatccgctcttcgtggaagttgaagccgacgtttgggaaagcgagcaaggcaagtcacatcatccttgaacatattgaatcccattttataaagttattttgatttaaattattgcattatcgctttatttaaattcccgcgttatcactgttttatctagccatgcctatgtacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatagttttaggctgggctcggggtgcatggttttgatagtagcaccttggccatataaggaccggtcttcgggcctctgttgcaaagcactaccgtacttccacatgtctagtgggtaaggcttagtttgtggctcagtctggttaaaaacaaaagtacatggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccttcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttatttaataatattgtatagctttaggatcgtatttacaaaatagctttgagcaactaaatgtcttttaatgctgtttgctgcaaaccctaaccctttatattataacccccttgtactcccttgcatttatcctgcacttgtgggtgtgtcttgttgagtacggtggttgtactcagtcttgctcaatttttcccaaacccagaagaggagcccctggatgatgaaggctttggtgtctagcttgtgcctgccgtcaagcgcctgtggtcgtcgctctagtcttccgctgtttcccgtttgtctttgtgtgtgctgggccttcgccgcccatgtaataaattaactatttacgcttccgcttgttaaactctgaactgtgtcaacttttggtgtaccttgcctcctgagacaaggaataatgcacgcacgtaaagaacgcccgttgggttatttccggtcgtgacagtatctcattctctgtgtagctttcactgcacggtcaaaatccctcttgtcgaacgcttcctggaaaggaatttggaccaggactctagctttctcctaatctgagaagtggcatacaatgtgagcctataaatcattccaaagctttctcctaggactctagcatttgttgaaagttttatggacttttagtatataatagatggcaggttctacattatgtctattcatgcatatatggttatctcagttctcagccttagcactgcttgtttgtttttcagagaaattagtgacgttattttttcttgttttaaatttagtcaactttctcaattattttctagttggttactgaactttggtctttcatactgggcgttttatcgggaaggaattgtcaattggtgcttcaactaaattatataagcatgttgtttaagctgccatactgagttgttatcatctgactgcaaactatccaaacagcacgtgaaacatatgctctcaaagaagcaatttggcctttttcccgcggaaaaaacaatttgatctagtagtaaccatgcgcatgtgcagttgtacaaacaccatttccaaaattctaccgcggctacaaattaattgagtaggaaacaaatataaaaactaaaatcagattgtcatagcattcttcatttactcgccctatttgcaacttccgactctgaagaaaaacactgaaaatgcaggttgcttagcctgctacatctgcatccttctcaatcaccgtctgcttagcgacaacaaaagagcaagggcacagacgcagcagctggcatagatacacacaaaacacacacgagttttacaggacaagcctattttagaaattttacatgtactctctcttattgatccaaagggttcgttcatctatctccttcttgtacgctaccttatgctgctgtcagcttcttcttcttcttcttcttcttcagtaactggtgacgatgagcagcccgatcgccgtgacgacgatggtcgacggcaccccgaaccggaggtggctccagaaggagaggttgtagccgaagaactgagctcttctagcctgctcgcagacgatgaggttcgcagccgagcccagtagtgtgaggttcccggcaacggtgctgacccacgctaggataagccaggccttcctctctgaatcgtgagagattgcagcagctgatgcagccactcttgtgccgagcagtagtactgaaagacaaagttcagaaatgttataaaagtgccacaaaagaattgttcagaactttgggataactttgacagtcagtatccaaaagaatattgttctgaagatttacctgtgggaacatttgaggccacatttgagaggataagaattaccacagcaagaagagcaacacccttagcactgtcaattcgtgaatacggttcaacgagctcccaaagtgtgttcggtatgccagttttgttgaagccatcgaccgtaataaacatcccgcagaagaagatcagcaatgagtatgacacctatcatcagacatggcaaacacatgaaatttaattgtcccaatgaacatgattcagataaattgttgattcaggcatcagtaagtaaaatcataccttctccagacaagcctgtgcatcagtaaaatcaagcgccagaagaacaagagccgcagtgatggctgtccatgacatgttaagccccatgagaagtgcaatgagcatgccaagagtgatgagataaacagcagtcttccacacaaacaccctccatctcttctccgcaacctcatcttccttctccttgtcgccattgctggcgggagacggcggcgagtcctctatgatcacactcctctgctggctagcagttcttgtgaacttcctggaggatgcaccttcatccctcctgtcagtgacagttgagacctcgaccatctcatgcgacatgctcgatgcccggagcgacttgatcgcgagctgtatgtccgcctccgaattcacactcctgctcctcagattctcattagcactggtgctcctcacgctgttgctcctgatgattggctcacttatgcagtccatatcatccgggttcagagatgagacgtgtgacattcttgcaggtgtgaacctgtgtgaggtgacctcgtcgtcggcgaccacctccggcccagccggctgcccgccttcctgatccttctccactgaaaggtacttccagaagtaacagaggaggatggcagcatttgtcaggacgccgacgatcatcgccgggaaaactccaagcaagaactgtccaaaggagatgccgctctccacggcaatgacaaggttctgcgggttgccgatgggcgtcgccgcggagccgatgttggagctggtggcgagggcgaggaggaacggctgcggcggcaggttgttctgcctggcaaccttgaggatgaactcggtgagcacgacgcagcaggtgtcattggtgaagagcgcgctggcaatggcggacacgatgcagacgcggaagagcaggtccttgctgcccctgctcttccaggagagcaggttgccgaggtacttgaacatgtcagccctctcgaggaagatgctgacgaccatggtgccaaagaggaggccgatgattgggaggtcgatggcggcataggcgtcctccggcgagatgacacggaagaggaccatgagcatggcgccaaggagggagccggccgtacggccgacgggcatgaacgggacggtggggaagacggccagcacccagaatatcccaaacgcgacacatcccagcactactttggaggtccctgccaacgccatgttagcaaatctctcgtcctcgaacgatcgaacgaacgaacgatcgattgatcgatctatactagagctaaaatgctacgaacaatttttcactgatgatgttttggtttttgcaagaacctgtcacgaactcacagattgaagagacagtacagaacaacctttccccccaaaattacgttcacaatctcaggtcaggttcaggctacgttcacaacctccttgcccaactcaaactcaagaacctgcagaaattggagcagacaaacaaacagaggctacaggttaattctaaaatctgtaaaaataagagagagaaggtaataagatcatttaaaaaaggaaatgtaaagatccttttgttgttgtggttgttgttgtaaaataaagtttctttgatccgggggaacgaaaacgaattagcaagaaacaacggtgttagatcgactgcacgaaaacgggaggacacatatttgatatttgagatcaagcaccaccacgcctactcacggtgtatcctgcaaacaaattcaagcgagaaacagaagcccttatcaatacaaaaatccttcgcacacttcaccaaactaaatgaatagagctaccgagatttcctcagataaattactgtagttatggctaaaaatccagattttttgttccccctattctacgcttcttgcagttgatcagatcgaatggattggagcttggcttaccgactaaaaagaaacgaaagatccagcacaaacccgtgcatgcagtggtgccaaagaaccccaggaacaagatatttttttcgattgtttcgtgagctacgactatgattggtctctggacgaaaagagaagaaatgaacttcggttttgggttgctcacctcggagtaggggcgtggagagtggagagtccacagtgccacgcgcaacgatgagaactttggagtttggacttggagaagtcagaagtggaaagaagcaaaagcaggcggcagcggcggagtggtggtggtggcgagaataaagcggaggtggaggaaggaaggaatggagggggggcagctaaataaagagagcgtccactgctttcatggatgatttgaggtgactggtgggtcccaccgttgagggtcctaggaagggccgatttatcatgtgaacccaaagggtggagctcccattgtgtgagtccgttttcataattttgtgatccgcatatttgggacggtggtatagtgctacttgaatacttcatcacaaaataaactagttcttgactataatttggatattctctttgtaaaaaaataaatatttaaattcgttgtactagactacgtcacatttaatccttcttaagatctctataaaaaaacaaatttataggaagatgtgacaccacctagaaaagcatccaatccttattaggatccttccgtctaaaaaaagtttaatctatatgaagatgtgacgctttgtccagatccaaaactaatcaaagatagtattatctttgtccaaaataacattttcagttatagaggttattatggagcaaattaagacaaataaaatgacctatatgagaattattatatggcatgtgaatgtaagtgagagagtagttaggggtaaaatgaggaaaatttgaatgagataggattcatcgaagtgacaactagtactctattagtaatgtagaagtacttatttagagacaaatttaaatcctaatatttcatttattctgagacataggtactatgatatcatatgacggatatatgccgatcgcaaaattatatgttatgattgtggaataccgttttatatgggaatgtatatatgattactctgtatatatagttttttctatacatttattatctccttgctttatatatttatgaaagaaaatggagaatttataaagtaaggactatattggttggtacacatggggtgtggggctagcagttttcccatacgaactctcctcctatgattcgcgaagttgccaacgatttggatttgcatgcttggtttgctgttgatttggattgcgcgtgggacgtgtgtggcggccagcggagagatcgcgccgtttcttccgatacaagaaatctcgacgatctttgaagccaaaaacgcgtccggatgacgaagcgatcgacaagattagcatgtcattgtcgcatgattttgccgtatttctagcgaataatgggcatcctgtgggttctcctgcttccatccacgctaccaatgattgtacgtatgcaacgacgttttggtggtcaatttgcatcacaacttatcacagccgcgtgagcgcgactactctggactttgggacactggagtttggagtggagtggcaatggtacgaagtagtaccacaaacacaggtgatcgtttggcctaaaactgataagccataaaacgacgtataaaaaaaggaataatttatagataaatttgtattcgcggttcaaaattcaatgtaaaaaataaactaaggtgaaaaacctaaaaaccaactctaatttaaatttgaaaattcaaattttagtagataattatgagctgaaggctaacaaagacgaaccacctctactttgggtgtaagcgcgttagatccattattattatagatggacttcatgctagcccaaagcccagctagagagaaaattaagacgagcctggtcttatgggaaattttgtttagttaccgattgttttaattattttctgataaaatagattattttcataatttgcattaattattttctgataaaatagtttgaatatttgtattaagggaattaaatttagccatgtagtaaaactaagatcagtctcgatttaggccatgtatgattcagcttaggattattataatctgaattattaggaataagttcaaacaaacatatagcttattatgatagattattacaatctataagccagattactataatctaatc

SEQ ID NO: 21266 - DNA, 4109 bp, Oryza sativa
agaacagagaacagaatgacccgggttttttttcctgggtcggccaaagaaaggcagatcaaatttcattaagaatagtttggaatgaaacaaggtaaatccatgaaattaagtttcgatttgaaatgttcctgttaatgaattttatatcttccaaacaagctaggttttgaaaatgtctccatgtttgtataacaacacctcccctacatatctctaaacatggttttatggtggtttcaattagtagatatttctaggatccttagggcacaagaacaaccccggccaccacagaaccatctcagatgtgcctgctccagtgctcacccctctgtctcactcctaatactacataatggctacagctctgaaccacaaacccatcaacttgtggacagcaacagatcagaccaaaaccaaaaagattactcggtctccattatcacggccaattagagtaggatatcatctaccgacggatcaataattgagtagtctatgtactattatacagagcagataagagcacaagcatgcatagccagtggaatgatgaatctggtttgcaaggtgaaagtgcttcgcccagtacgtatacttaagtgctctccacgaagggaactctgctctgtaaagcaacagggcctgaccaaccagccatggatctgaggccgtcagcttgtcaattgccaggattaaattggctgcatgatgaactcccagcaagaggaagacaagtcatgtgattgatgtttcatgggcttaattacgtgagaatgtgacaattcacctactatttgacaacatccatttttccccctcctccaatctctagctaaggcccagctcaaatatgcagtttgtggctcggaggggtgaaacattagcccataattaattacgtattaactaaaaaaattatataaacacactgtttaaccgtttaataaaaatattaacagaaaatgagaaaattatcgttttgagttactcaaaagaactaagtctaattccccatgcgatagcaaacacatcgaacctttccaaccaaacctcgaatgccaaacccacaacaatccgtgcaattatagggagagatgaaaagagtgagaagcacttttgtgcccacatgaagcgaccagctttattggccagcattgacaaataatcacccgtgtgtggggggagataagatcgtctttactagtactttgattttctttcaccgtcgctgtgctaagaactaatcaggccagataaaaagttgatcgatgcagtttcagaaaaacacagcaaagaaaaaaaaagaaaaggctcgttttgtcaacttcttccagtgccaagcatctgcgtgtgacgctgtcagccaagcatgtggcaattgacaaaaatgacaaagtcgtgtactgaaaacctcgaaaaattttgggttttgtttggttggtgcctgatggaacttggaagccccatgtcaatcttggtggtgggcaacgaaatctggggtttatttggtaggtgttagttttttctttctttcttggcccgcaaattgacctgacacgtttgctaaaaccctttttgatggccaaatcactggttttaattggttttggtcccaaaagatcggcacctaactatatgtctctttctcattaaccgtgtcatatgggtttacaaaatttagtttggcctgtgttactatgtggttttttaataacttttttcgattgcacggaagatgcacgtgcacaaatatcctattacctaaattaattatgttgagttttatgacatactactactcaagtcttattgaataagccctgtaaccctacattcacatattttgtaccccatgtgttgggttgttcatgcatgaacaataagcactttccagcccctttgaaacacatgaataataaacacagaattttgatataaaagcatgaaaaagtggatacaaaacatagaaaaaacataagtatattgtttggatagaccgtagaaaaaaaatatagaattgaatgagggagagagagattcaaaggaaattttctaatagattggagctcttgttaacacctttttttcccctccaaaatctccgtgcattgaacccttcctaagaaattttacaagatttgagaagtttcgatactttgtttcaaacggctaaatagaaaaaaaaatccatataggattaaaatcctataaaacttcttcacaaatcctttgtttcaaaaaaggtccatcgaccattgatgtcagcatgcatatgcagccttgtgatggtgctatatatatatggacatgcgtgtattctttcaataatacaaagatctacttgtcaacacgtgaatacgatcggcaagtactgtacagtgaaccgcaagtactgctataccgttgtacaatagtattattactgtaattaaatttatcatacaaacggtttctatttatagtggacgctggcaaaacagttggtccaacgcagaattgtctaaaagtagcataaacgaaatcatcgtagttcaccacaacgacaaatgaagccttaattggttgaagggacagtaggtcaatttttaaaatgcaataattacggctacagaaatcatctttttttaaaaaaaaacaactacaaaaaatatctttgcacagagtcataacatattttcacataagagtgaacaaaccgcctctaacttaaaacctacaaaagtactcaaacattgacactcaatctattttgttattatgaaccacacgtgctctttcgtgacccgccattgacaaggttatataatgcttctcttttttctttccatctcttttaaagaaatgaaaagaaactcttgtgttatgttgtgaatagcaacataggcgaagttaggcgtaggatggttatggcttgaaccccataatttcacgtaaattatataaaaacactactcttctaaaaatagttattactaacattgagcttaaaagtgaagtttgatttagattttttttaaaaaaaaagcaaaacaagtcattactatataattaatagaattttaattattataaacttgaaatatggatttatttgatttagaaaactaaaaaggtatcgtttaacagtttaaaaacattcttatgataaacaaggaaatagcaacatccaaactctgtttaacagttttaaacttagctagcctaagaccctagtactagctcagtcataggcgtaagtttttcatggctttgcccctagccaccatatagagcgatatgaacatacttcctacgtctcataatactggatgaaatatttcatagtacaacaaatttagatactatgctactatattatgggacgaaaagagtatgatgcactattagcattgtggctttgtaaattattgaagtattgctatgatagccagtagccactatacgtgcacatgcatgatgcataccgtcctcccaccatattgggctcacaaagccagcttaacttagtactccgtacgtatcaccagtagtgctgacacctgcctctactccgaatttactgctactccgtactgtacttatatatgcaacgccatgccaatcaaaaaggtcgatcaacagagctaccaagacataaacacggtcgatgattacgaggatatagctcgaaacacaccgcaagatcaacgcccaattatcttagaggttgtttgggaactaggaactaaatttagttccttcagggacttatatttttgtgagagagactaaagtttagccccactttagtccctccaaccaaacaccaccttaggcacgactcgtccaccaccaccgtacttgcattgccaatactgccatgcgcgcacggggcacccgtacgtacgtgcgtgaagcccatgaacaaccaaacaaaccagcaccgaaccgcgcgataaaatccaacacaaacattcgtagtacatagtacttaccagaggaaaccttgccgctgccaacgtccacgcgacgctcgacgtactccgccgcggcgccgtttggcgcccgcgctctccgacgacgcacgcacgcaggcgcgcgcgggcttagagtcgcttgcgcta

SEQ ID NO: 21267 - DNA, 6723 bp, Oryza sativa
  unsure (1)..(6723): unsure at all n locations
cccccccccccccccccaatggcccaaggtacggacacggactcttatggccacgacagcgacgcagcagcttgaaacacacacacacacacaaattgaaaacaaaaaaaaaattcacaggcaggcaggcagacacaacctgaacttggggaggcgtcatggctctcgtatgaatccgatcccttttctccccccggaagattattgctgttgcctcgtcgcttcctcggctcctcctcctgctgctcccctccactccgatagatagtccgatcctcatccgtcactcactgcgttcctccgatctctagctggtaaaaataggcctagcttagttcccaattttttttcaaaaacatcacattgaatctttggacacatgtatgaagcattaaatataaataaaatgaaaaactaatagcacggtttgtatggaaaccgcgagacgaatcttttaagtctaattagtctatgattagccataaatgctataataacccacatatgctaatgacgaattaattaggcttaataaatccgtctcgcagtttccagtcgagttataaaattagttttttcattcgtgtccgaaaatccttccgacatccggtcaaacccacttccgatgtgacgcccaaaagatttcttttcgcgacctaaacagggccatagtcggcacagatcatttatgttttaacaaagtcagttacctaatcccctgtttctatatacaaagatgattttagtatcttcgaaaaattttcgggaggtactatattttcagtgtaaaacttgatacatctggatattgggtatctcgaggtacactaaaatttataaacatttaattatatgtttttttctgtatattagataagaggaaaattttccttccaatctttccattacgatcaacttttgaattttaaattgtctgaattctgctcctaagcacctaattagctgataatgaatcctacattagaattggtgttctaaaattatttatattattatgcataaattttaaatgctagaaatatttatatttggaaatcgagagagcacctgcttactgttcttctgcatatggagtatttcacatgtctatctgtcagtccagtcggattggatattcgatccactggatagtgagatgtctttatagatgtttggtcatatatatttcatcacacgaactgtcgaattaagtgccttccgctagtatatgctgactttgatgtactcatgtgtctatgtagattgatgatgaacaaacgacagatattgcgccggtcctatctgatcagaattaattaatcagttgaaacttggaacacaacatgaaacgcgagttgctagctgataaagttgaaagttgaggactttgcaacggagggaaaaaagaaaaaccaatcctatgaaaagcttcgattgcaaccttgccttcggtgtacacgaggattatatacataggattttctcactttgcatcggtctcgtcagaaaacggacctgatgaaaggatccttgtcgggtgacccaaatactcctctgaattgatcgatgaaactctatcatcctgattgaccattgcaccacataaaaacgatggatttcaatcgctaaatgtagggtgctgaagtgctttgctcctgaatcctgatctagtaattccaacgagaatcatctacagtcatgtccatgtattaacagtgactgacctatatacgggaccagtcttacatccgtgaactagtaactccagactaaatttgatattgtcgtcgtcagttcatatgcactttttttttttgaaaaagggagggtatctcccccgttttcattaaagaaaacgcagatgattacaagagttccagaacaagttcttacagataggacgagaaaaaaaggaaaacaaaacagttattacaggactaaaacattggcatttcaagcatcaaaacacaggtttccatcgccgtcttcaaactcctcgccatcagtttagcctgcctctgtttcccatcctattctttgtctgccgcccctccatccaaattttgagtgaaagatctcatttgctacctgccttagtagctgcgccccccactgcatttttcctctgtctccctcctttctctgcaaaatactccaagagtttaaatttgagcaaatggtgtaaattatttctataggatcaacaggcagaattccatcaaagcaggctctgtttcttgctttccaaatggtccacaagactgttgtaacccccaccatgatcaacttcccattcccttttccaaatttcaaaacccaggagctaaacatttcccccacattcctgccaggcttcacattgagagcgcattcaacaacactccaaatgaagtgagccatggggcaatctaaaaacagatgttggatggattcactcttgtcacagaattgatatttaatcgagcccttcctccaactccttttgaacaaattatcttttgtaagaatactatttcttagaaccagccaggaaaaaactttcaccctgggtggtgctttgattttccacatttttttgtagggataattgatcccctgtaatatcaaagctctgtagaaagatttaacagagaaacctttgttagacagtctccaaatcagtctgtctttttcattagttagactaacattgtccagggctctaccaatattagcctattttctctgtttaactgcatgtaggtctctcctgaatttgattgagcctaaccctctctttttgatctctgccacagtcacatttttgtcaaggttatgttataaagatctggagcagactctttaattggtttacccctcccccccaccaactatcttcccagaagagggtactctccccattttccaccttcttgtcacaaaatctcaagaacagctctttgatatccattaaaccagaccaaaagtgagaatccccattcttatgtttgatttgaatcagagttttctttttcaaatacttgtttcttaacatgtcttgccacaaatcttctgtattctccatattccatggtcatttccccaacagagctttattcattacatctaaatctaaaatccccagccctccctgatctttagggaggcagatcaccggccattgcactagatgatatttcctaatactttgatcttcttgccacagaaatctccttctacaaaaatcaattttttctctaactccacaaggaagagagtatagagacatcatataaagtgggacactgctaatgctagagttaatcaaagcaaccctccctcctattgccaggagtttcccctgccaacaccccaacttcttctcaattttttcctctacaggtttccaatctttgttatggattcttacttgatctatgggaacacccaagtatttcattggcagtcttccaatttggcaagtgaacatttggctatatgagtcctgtctctcagctgcctctcccaggcaaaacacttcacttttatgaaagttcacttttaggccagtcaattgctcaaaaatacacataatgaatttgaggttttttgcatattccagagaatcctggatcaggcatatggtatcatcggcatattgtaaaatatccaccccttctctcatgacatccattcccaaccccttgattagtccctgttgctctgctcttttgataagaagggttaaagcatcagcagcaatgttaaaaagcaagggtgagagtggatccccctgtctcagccctttgtgtgttgtaaaatagtgccctatctgataattcactcttatggccactttcccccctttaaccactttcaagatccaatcacaccatatgtcagggaatcccttggccttcatcattttatacacaaaagaccacttaatattatcatataccttttcgaaatcaattttgaaaagaattcctgcctgctttttttgatgaattgaattcagaatttcatgcatagttacaaccctttccattatatatctgttttttatgaaagctgtttgattcaaagcaatcaagacttcaatcacctcagctagcctttccatcaaaatttttgttatgattttgaaactcacatttaaaagacatattggtctgaatttctgtatcattcttacttctttgcatttagggatcaaagttataacaccataatttaatctctcaactccaatttttcttttcatgaaatctatgattagttccatcaagtcatccttaataagataccaaaaatgtttgtaaaattccacaggaaatccatcaggcccaggggccttattgttttccattccaaaaactacttttttcagttcctccatttctattggtctgattaatctctctttttcagcttcactcaacatagctatgccttccagattcaaagtaaaatcattctctggagggggaccaaaaagctgtttataaaaatttgttatatatttcattagatcactctgtcctttaatctccccatcttcctgatccagagaataaatcatgttttttcttttccttccattagctttagcatggtaatattttgtgttatcatccccttctaaaaggtttttttctttacatctctgcatccatttcaatctatcctctcttactactttcttcaactcttcctccaatcccctctctcttttctttccagaatagtcattccatatgcttcacattttttatcaatgtcttctattttccccataatttcctgttttttccttttgtacatcccttcccagttcatgttccaaccttttagtttctctctcattttttgtagcctctattgccatttatcaatactggatccatttatattacaagatttccaaacttgctcaaccacagtattaataccttctctcatgagccaactattctcaaatttaaatagaggagactgccacttttctccctcaacattgatcaaaagaggagtgtggtcagagtaaattctctctaagacccttccacatgccaaagggaacttaatctcccatttatcattaaaaagaattatgtccaatttttcaagagttacactttgtttgttattagcccaagtgaattttttcccttccaaggccatctctctcaagtttgcattctcaattatagaattgaacataagactccatttattcacccctcccttcttgtttttttcattctcttgtctcaggatgttaaaatccccaccaattaacaggggttcatcacacccataacaatcctgagctaactccctcaagaactcttccttgtgttcaggttgagctgccccatacacagttattaatctccacacaaaattgtcatttctattttttactttaacatgcaacaaaaaattcttcttggaaacttccataatttccattttgtcttcatttattccaaccaacatacccccagatctacccctaggaatggtccaattccaactaaacttaccccctcctcctattaaatccaagtctttagcagtgaaatcctgcttcacagtttcttggatgccaatgaaattaactttatgctcttttattaaatcattgagatgctttattttatcatgatcacccatacctcttatattccaaaacaaacctttcatgatttcttttttgtttttttcttctcatttttgccactacacttaggagtgaccttgaaaatctcaaggtttcctctgttatttttcctcctcttttttcctgataaattgctttgagaaagtctcaacatgttttcagcataatcaaaatcagacatacaatcatctgaatgtaagacttcatctatgtttatgtctatgttactcaagttctccccaacattttcacactcccctttctgagaagtatttagtttctcttttaaaaacagatttatcntagccaattccagatttttgattaagttcagatttgtatccacagcttctagagcacaatctaaattaacacctaacagactagccatttgagctaaagaaaaattactttcatcaactatagatgggatctgtttgttacctttgttgatgaaagcattaagagcctttttcctttcagctgcagcatcagccaccttcttgtcttccttctccataagtcttagacttttcttcttcttctcctctgtcatgtcttcatcagtctgagacaaaacaactcccacagctacagcaaagtcacttgattcttgtgattccatgttctcctcacttcccaccagttgcactcttggttcatcttcatcataaatcacctcctcactgtcattttccactctttgactagtaccacttttatctgccatcccctcttgtgtcttctttgttttctcattttccccctccccagcctgtgcttctctgattccaccctctatcatccctcctgctacatctttatcaagttgaatctgcttgactttaaactgttcttctagttgtactctcagagccagctccctatctatctccatctgtttgagcttcaccaattctgcttgagcactttcattgtctgaatcctcttccacaactatggctttcttcttgtcccctgccttttccaaaacccccatgcttgatgcagcttcttctttccttggtttcttattcctctgcatgtgatctatg

SEQ ID NO: 21268 - DNA, 3680 bp, Oryza sativa
taattgagtcaaattcagctaactcatccaatttcatcttatttgggaatctcatatggaacactcctttctcctgcattctggccttccaagtctagttccacttgaaatgttgagtgaatccttcctccagagcctgctcagtaagatcacctccccacataattgtcacaatagccaaagggttaacatgttctttttgcactatacccttagcactctgaatcagcacacagcccagacctggagcagcacatcccactactttagctacaggtttcttctgattcttcctaaagcaatcctctgtcctatgagtctcttttgcacagatcatacagaacactgacaatttgcaacctctagacaaatgactgtaactcctgcatttagaacaaaaaatcctctgctgggaatgggattcaccaacctgatgcttggactcatctcgattttgttgctgatttggctttgcttccaatcctgaactgacagaatccatcttagcacttgattcctgtagatttggacctgcttccttccttccttcagtttttagtgtgtccttcccctgcttccccttctcctcagcagcttgcagcattttctcatgcttcgccttcccatcctctactcctcaattcagatctagaggtggcggatgtggaccttgcggctcctgtctcccaacctgcaaagggcggaaacgtccccttccccctgcatctcccctccagaatcgattaggcggcctgaaaggtggacgcggcctccatcctccgccttgatttgccattggagagccgcttcttaccaccttcgcgaaacttcagccgtcccctcgaacgctcgccgtccactcccgccgccgtccaccaacgcctacccttggtcactcctccacttctctcacctccccttgcgtctccaccctctccaatctcctccacccgccctggaaccctagctcctcaagactagctccccacaggtggtgtagaaacggagtcaggagagtcgactcaaaggtgttcgaccgatccccaaaattgccattgttggatctcgacacgtgttgcccctccacctctctctcccccactattggatcgggctgaaaaccatgggcttcctcccccccccatcaaaaactctttcgcgcgctgaggagcactctcccaactcccgaaggccatcccctccgccgcgaatcaccgccggcgatcgtcggagcgccgcgggtgactccctcgtcacctctcctaaggaaatcctagccattcggtcccaaacggtttccaaactcacaaggcaaattgtccaactaagcacgtacagcaagaaatataacgtgtactatgtactgctgtttaatgtacgagtataatactattattgatgcatatatacttcggtttttagtacgatctcctcgcgaaattacactgttgactaccttaatttgtccttagcttgctctggaattttttcaggctgaactgacccatcagggtctttagtggcacgcaccgtactttgtattagcagggtcctaaatggcggccaataatattgcatactccgtacttgaaacatgaatctcccatgatggcattggttatttcagtgattagttcataattgagatcgtaatggccttcgtgaaccaatgttcaatgttcaatcctggggcacggcgagctgacgtccaccacgacgtcatcctctttttaaacgctcaacctttgatcaaagtgagtttatctcacaccacacctctcagagcttatcaacaacggaacctgaacattttttttcctctatggagtagtgtaaaataataaatgcactctcacactgtgacacgtgttctgctcccgggccttaggtttttttcttagtgatccatcattacaattttctttttcacgtacggcaaaatttggaattatgcgtaactgacgtatataagcaacaaagagaaaaaaccaaaactagaacaacaggcactaagacgtgaccgtgcttgaccaggtgggaagccatttaagcgcatccccacgagttttaatttctgaagcgattcaatttgtccacgatcgagcagtagctgtacgggtacgtggttcgctgttcagattaatgttatttgcgctttaaaaaaagattaatgttatttttaaccatatcatttttcgataaagttattaaaaatatgtctatatttaatttattattaaactttgacaatattataaacttaccaaaaatttagtaaggtttattttggctgaaattggaacagcctctccgtattgattttttttttcttcaccccgttcacgtccagaagcacaaattttgacgtacagtcggcgtctaccccgtcgtcgcgtaccgagtttttctcccctctagttgacttcagttttcccctgtcaatcgccggcctgtcgattgatctgtgatcatgactcatgtgctgcggactactggtacaaggtaacttttgatttttattctggttctaattaattggatggttagaaaaaaaagagagagatacatcggactctttagaattattcttttgaaattgaatataaaaacacacatgttagggataaatcccattattagaacttgggttaatagactggaataatgttcttcttatcctgttttccttatcctgtttggttttcttttttttaagttggtttcttcaaacttttaacttttccatcacatcgaaactttcttaaacacataaacttccaatttttccatcacatcgtttcaatttcaactaaactttcaattttggcgtcaactaaacacacccttaatttagactacactcttctaaagtgctatattataataattggttgtagctctcttgagcaaaggccggtatgtttcatttcattatcttaaaaaaaataaaacttgggttaactaatgtaatacaaactaaaacgtcctcatgataataccactctcataaaaaaaggaataatgatgtaattttcggctacacatgaatagaaagagcgtcaagagacaataacctctcctcactctcctccctctacctgacattagcaagggactcttcacaaagaggagggtcctttgtcctatttgttccaacaacacccatctttgactattagttgaatatttaatttaattaattttgaaattctaaattaatatttagcaagttgtagtaaagtgggcgtagttcaactagttagatttcttatggtgtaaacagcacactcggtttcaagtcctagacttgaaacgagttctctcatttatggccaactattattttagtgataaacgacgtacccatcgacgtatgtgtgtttataggggaaagtgcgtgcacgtaatgatatataatatgtctttatcatattattgaggagttaatattgaaaatctcaacaataacaattctgtgcaacttacggattaacaactaataaagctaaccaatatattggaaatggtaatcaactctatcatttgctcttcagcttatcaggccctgtttaaatcctccaaaatttttgccattttgtagcactttttgccattttggatctaaacactagtagcaaaaattggcaatttggcatttggcatttgctagtccatagtag

SEQ ID NO: 21269 - DNA, 889 bp, Oryza sativa
aacacgtcggttacaggcacatggatggatggatcgatcgagcagtagcctagacaattgcagccatgcttgcatgctacctggtcgatggatggatcgctttagctccctttagcctttacgatcagatggcgcccacgaattcaatgcgttcacaagccatctccttcgctcccgcgaataattgcgatcgccctcgtcgccgtgatttggacgccggcgagcgatcgatcgatcgagcgaacgacttatttccgcccattcacacctgcaaaacgcagcagcaaacgcgcgtgcgttgtactcgtttcaaaatagtttaagtactccctcccaaaaaaaagaagaagaagaagaagaagaagaagaaaacttctgactgtatattagatacgaagttggtttttttacaaagataatattaattaaggttaatttttcgtcgaacgctaaattaatattagatcaaatgatttatcttaagtcgttcttaaattttaaattacttagatttcctttcaaaatatccgattagatcgagaatgatgattggagtgatgagaatcatgggaaccaattttcttctttttgtcatgtcccccaataatggtattctagctggttgcagtgtgtatttaaactctcctttttctaacctattgacgtgtattgtttttgcgtgtttacgaaaaataatcatagggaaaaaatgtttctattacagtataaaatttaaaattttatcattttaaaatggatggggtactgtactgtgttgtggatggctgcgatcgttggatcgatgggtctcgctctcctctcccaacccaacaaatcggcctcttcaatgctcggctttcgcttcacggacaagttgccaatctacgct

SEQ ID NO: 21270 - DNA, 2741 bp, Oryza sativa
tcttgccgtgggattatcatactattcaacatttcaacaccgacagttacctgaaaacttgtcattttgagcctccacaagcggtgatccctcgagctgcaaaacgaatatttcgaattagaggcattgatcacaatctacaaaatacacctaccgccattagtgaagctgcaagtaggcaccaccacaccttgcaggagaggaggctaatacagcagccgttgggctcctcgtcgacgcgaacaagtagcacggggcagacctcgagcgcgaagaagcggaagcggtagacgtatcagcggaaggtggactcgtcgacgcgctcgatgcgctccgcgtcgagcaccgagtactgactcgccggcaagctcatgtactccgctacacgacacgagcaaagcaaaacatctcaggctcagcttcagggcggggatctctccgacaaacgaagcgcgaggcaaaggcgaatcccgagcccggggttagtactcgggaggggaggaggactaggagataccgaccgagcgggcgggcgagctgctggacgaaggtggactcggagcggcgggcgacgaagcgcgccttgggtgcggacgacacggccgaggaggaggacgacgaggaggaagaggcgcgcacgacggcgcggcggcggcggaacgccgcggcggggaaggggggcggcgaccggagcgacgcagccatgccgtgccgggtgagtggctagcggtggttgcggccctccgggaactggagcaaatgaggcggaggtggaggcgtggtgtgggggaggaattttgggttcgatttttttttaaaaaaaatggacggataagatggagtgggatggtgacgggtggtagatctggccacatctgggagcccgggttgggcgatgtgttcagcttatcaggtgggccaaggaatccttgagggaaaaaaaaattggaatcctccttagtagaaaatttccttgctcactgaaaggtgggccttaatcctgagaggctggtatatactagtactgttgcatacacatcggtggccgctgtgccggtaccgtatgtagcactactacgtgagaaagtgacttgttcatctggaagaaaatttgtgacggataatggtttctgaagtacccactgttttgttcattattcccggtgaaagtccaaactttcactatctgagtgaaaggtggaggtaccgttgaattttcgagttgggagtttgaatatttggtttttgaaatgtgaaactttgaagcaaatagggacatagtatcacctaaggagcatacgagaatcacatactccattcacaaggaaaagggggtttagttaaaaacccaccatctccggtttttagctaaatcagattatcagactacctagaaaggttaagcgcactctaacagagttttcttgtactagttcaaccaaaaattatgttgagatttacaaccaaatgtgcctcggtgcaagatagcaagatgaattgcacctactacaacaataatgtaaataagctatactcattgagaataactcatcagtcatcaatcaaaagtcattgggccatgatgagcaaaattacatttttcatttcaacttttgtacatcatctccgaagagctaatacaaattacaaacctattgcctacaatgcaacattagactatatccaccgacaatctatattccctagcttacgttgcacaaatgatcgtgtgatgtcgcttcaccagatctcagatcagatgtcatgcttgtttaatcaatctcagcatgcacgtaatctacaaatacaaaattcttctggagcgtataaaatgcgtacgctacagcggcactaaccaaagcagcagcggcaagcaataatctgaactgaacatccgcaggaatcccagcagttgcacagaacgccactgtcgctcccatgaagaccttttgcagagtctggaaggcgttgtatgcccctttgcaagatgagcatttcagtgtgtgctgctcatatctatctagcatctgcataggtaatttgcaactcggtcaacatatagtcaaatataaggatacaaggattgaagaatacatagaaacgcaagcataaatgaacatgtttttcataggaagtataagttgaaatttacaaggaactgctgtggttgaatcttcaaatatgtggaactgctgtggttaaatcctcaaatgtcaggtactatgagtacttcaaagctatcatacctccatagatattttaaagtacattactgagcttcacagctaaaggcgccagtaagtatgacaattaaaatatagcacagaaacaaaaaaaaatcgtgccaataatgagcaacataaaacctttgttttgtgtccaaaacaatatatcaaggttcatggaaggagtagtgtgcaaaaatacttcatggaaatcaattatctgtgcccataatgaacaacatcaaaccttttgttttgtgtccaaaaaaaaaaaaacaaagttcatgcaaggaggatagtgtcaaatactttatggaatcagcgcgtaaaaagttcttgcgagcaaggtagtaaacataactaaattccttaaaccatctaaagactagcttcaaaataaaactgcataaatgctctcacataactagatcccagaaatttttacctcacgctttgaaaggacagtggaaggcaacacttcttggctaggatttccaaaccagtcaggttggctgt

SEQ ID NO: 21271 - DNA, 3638 bp, Oryza sativa
atgagagcataaaattcactctaatttttaatagagcggggatctttactgctgttttcctaaaaagggcactaacaagtagattgaaaaggaggtaaatagagagagctacaaaaattgcagatacctgccaccatgcttttcctggcatgctaaactggaaaaagttccgagcactacaaactatagaacgagtcttccctggggccattggaatgttgaaagagcaaatccatatgacccatttctgatctccaaaaatgggtaactttgtgtctatctcaattctacaaaaaacgaaatactaaaagatcagaatcataagtggagttactggatgtgaaactgatatatgagctaattcacatcaaaaggcaaatgcaatgaaatgggaaaaggcatgattagagtgttttgctgaacatacttgttcagtgcatagcaaggggccacaaaagttgcactgatgcgagggtttccagaatttgaccctgaatatccccatgcaccacttgattccatcttgaatggcaaaggcctggctcgatctcttcgaccagtgacctgtgagaggagttaaattttgaggcaaggataatgctgcctagttaaccaatttctttggccatgggaatcgtacttttgctccatgaataatgaagggaagacaaatggtctaagttgtggatttactgaaagtgcatcttagataatgaatcatacctctagtccatgtaccatgaatccataacagacagttaatacagtagcctcgattaagtaagtattattcaattttagcactagccagtagcttaagtaaagagactgaacgatgctgcagctacattttcatatcaaggtgcaacaggcagttcaaaacaaaacattggcaatcatagtccaccagaagccactgttaagagattcaaccaaaaatagaactactaaaaccaaattgaggtatgatgtgcaagtacggtacacaacaaaccatcctcatatctcaaatgtgcaatatccaggactagcattgcgtgccagtacattaaagtaactgatcattctcaaataaaaaatgtagcattaccttgtggtgagcaaattctatatgcgacggatcagagacgttctccatcaatgtatcatagccatagtacagatccctctggatggtcaccgtggagaacgcaggatcctcaaactccttcggtaacctggaatcaaaaacaggatcaaacctcgtcaccgacgaccttaaccaaactcaatcaataaaccactaatccagaatatacacgcacatcggaggcttggtagccgtggccttctcccacccattctcgtcgggccacacgaagagcagcccttgcgagacgagggtggggaacttgatcgcgcacgccttcggcgacctcacagccttggcctccggcccctcgggcgccgcctgcgggatccgggtgcacgcgccggagccatcgaatgaccagccgtggtatgagcactgcaagcaccccgtctcatcgatccgcccctcctacgaacacacagacatccagatcatcgccgtgaattcaatcggatcaaaattggcgcaaaagaggaagagattggaagggcgcgtggcgatactcataccgagaggggcgcgaggcgatgggggcaacggtcgtcgagggcgacccactcgccggattttgggtccttccagatgacgaggtcgcggttgaggagctggaacggggtgggcacgctggggtcgaggtcctcgacgagggacacggggtaccagtggtccctccacacgaacttctcgtcggccgacgacgtgctcggctcggtctccccgggcgcctggtccgcctccccggggacggacggcggcgccgccacgcggagccgtgtgtcggcgcgggcgcggcggaggcgcaggcgaccggaagccgagagcgccgggagcgaggggacccggcggctcgccggcagcggcctcggggagaggagaagagatgcggtcggagccatcacgggcattttcgtcgactcgcttgggaagcctcggagatctgaggtttctgtgtggttttgaagatttttggcgtgccggtttttatagctcgcacctggtgtggtgagtggtgactgaggtaggcgaggagaccagtgttcttccagaagaacagagtagtagcacgatggaggaggaggaaggcgagagctaactggcactggtaaaatcgcctgtttctggcacgaaaaccagcagccggaagggggattcgaattttctcgtgcggagaggtgagaaactgaagaagagagtaggaaacggaggtggaggaggagtccgtggttgcgtgacggcacggcggaggaggcgggggacaagtgtgcagcaggagcacgcatggcgttttgcggggtgtcgtgtggtggagcttcggctacgcagcggcggccaacttccctgggtatactcactcgtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccatgcctaacgggccgtgccgaaacgggccgtgccggacccgtgcccgtgccgtgccgggccgggccgcccgtttggccacctctactcactcgtgagaatgacacgaacccaaccggcttgtgggagccggtccgcccattggattctgggttcacttcggcagttcggcgccgtggacatgaacaggcagtgtacggaactttgaccgcccgcgccccatcagtgcactttgtgatccagaaccgtttgatactactatggcatttatttatgagtaaattgcatgttgggcctcatatttttaccatggttgcaagttgcaccggaggtatgcaccttgcttaacctcgtcctctgcccatcgtcgtgctcaacctttggcctcccactgcgatgcgctacttaagctcgaggttaacagatgccatgaagcctcaccttgcaatcttgcagtccattgttgtcatatgctagccacaagatggtagaagcacaaaacaataatcatcataaggctgcaatccacctgcccaatgtaaatgtcctcgaacatgtagagcttggagtgtgaccaactgaccatgggcttgctgacttggtgaaggaatactactagaccccctccccc

SEQ ID NO: 21272 - DNA, 3388 bp, Oryza sativa
ctccccccccccccccccccccccagcaatctccacaaaatcctcctcgccgccggcgccgatcggtaaatcttcaccaaaccaaagccaagctattccctgcagatagctcgacagcaatgggggcaatttttctttctttttttcgttccctcctgagctttagtgcaaacctagatggggagattgagatccatcacaagtgtgtggctttgatgctaactctgagagagctttggcattagtacagcgctgactttagatagctagctacctgacctgttactggtcagagaagagaggaaatagagagataaaagagggagccagaggtagaagaactaggaccaagatgaatcatttggtaaatataactggtccaatatgaaaatgttgctttaccctggtgcaggctgcaacaatggtaataaaaggaggtctcatatgcaatttatttttattttttttttgcaatgaagcataattgaatttttacatcctttttatcagcttcagaggcaatgatgtcaagtctatacccttaaatttaaagatgtattttttttattaaagtatcttatatctagaataaatttcataaaactacatttacttttatcaatctatcataaaactgtatatttaaaaaacatgtatcataaaactaccgatttaacaccatatcttccataaaactaaagatttgaggtatcatatcagaaacatctgttttatcacaaaactacgacttttataaccccaatatgctatagataagaacttaaaaatctagttctttgataacttcactgctaaatctgtagtttcatgatataatattttaaatatatagttctataataaatttgatgctaaatttgtagttttgtaatacgcatctttaaatgtgtagttttgcgatagtttggtaaaagtatttgtagtttttgtgaaatttactcttatatatattagtagtttagggttgatcttccatgttattagagttatgtttggttagggtttgcttattgcatgtctttgttggtgatcatttcgtttgtgggatccttgattttcggttagcagtaccgtctttagagtcagctggtcaggttcgttgatttgttgggtgatatcggtttattgatttgtaagaggaacaaagatggtggctggtacttattcattaccttttgtgcattttttttaataatgaaaataattatatctccggcttctgtccatgggcacacaaccaaccttttgtgcataatagagttgatcataattatggatgtgcttgtttgctcatgtcttgcagcattttaagatgtagagaattttttttctttgtcgatagatcttttgttgtaatggttatcatatggttgtaaattattgtcttgtttaataacgttatcagtcttgtcttgcaaagaaaatcatggctagtgaattaaataaaaatacaatgcatttcttattacacgcgtgtgagaggttaagcaagttcctcttatttcttgatcaaggactcaagttgtatttgatttgtcacgtctctaatatgatatcctgcgcatagagttctcttccagatatgtatgaatttatttgattttttagttcaaatggattccgtagtgaaaaccggataaatcatagcattcctagttgaactgaaagtgatccatttctcataccacacattgttgtagtagccttttgctgttgctactgcttttgttgattacacgatgtcgaaatcaaggcatgcaacacgtggtgtccccttgaactaaaatcaggagagggcagctcgatgagaaaatttcaggtcccatcaccagcaactgtaccacaattgacactgccactcacaccccccaatttccttggccacatcccaaagagatatttttggcaaagctaatcttcaattctggcagcaaagcgctccaatgctaacacgcaaatatccagctcaaaaatccttttgccccaccagtccattagtgcagctcaagaatcctcttgcactatcacatatgcttgcactggatgaattccaaagaaatttcatcaaaagttttaggctccacttgcatcaaagaaaattctgcttctgatgtttcctatttcactctgcattttcgccattcagagtttcagacgtttccaaacacaccaggctgcaccaacttctatttttcagcctgccatgccatgttggatcagtagtagtagacgacatggatgggctggaagtctggaatgacaccgaacactgataatcagtgttgcttcaaaatgttgatatcttgatcacaccttaattagtgagacaatgcagaacacgcaccaatcaccatcaaggtttgttgtaaaccacacaaagtttaaaaatgcaataagtccattcaccagtcgttatgcctctactgatcattgcactttatacccagaatgctggacaaaagaaagaaatgctaagcatgaccacaatcagaatgtcacatatagtagtagtaagttgtaacagtttaacaacagtaccagcatcacatataatagcttagcaatgaaaagtatccaagataacacagacgtttacatgccagttcctactcgggcattctcacgaacacaaggtggacaccaccaacatcactaagatttccaactaacaaacgaaagtaaattagcagtatcgcgaaccccctttaagagatgtaaaggggctagggtttcgcacatttcaaccccgggtcgccgccatcgccgcgtggagggggcagtcacttgggcagcatctgcgccgctgcagccgcggctgcctcctgctgctgctggaagttgagcgggcggcggaacagcatgatgtgcggctccggccggtggatcgcgtagtgcacccacccgcggctctgctgcactccgatcgcgcgccactcgttctgcaaataaaccccatcggaaaaacccccattccccaatcagacaatcaacgaatcgatccaaccaggaacgcgattctacacgaatgtatttggagatcttgaaggttacctcggagagaaggcgattcttggggaggagcttggcgacctccggcggaaggacgacgtgcctgcgccgcgccggccaaaaggatcagaaactagggttttgcaacggagataacgagaagattcaagaagaggggattctcatctacctgtactcgtaggtgtcgtcgaagtacttctcggagtactggatctggcccatctcaaccccaactcctcgatcaacttctctacaggaaaaatccccagaatcactcaaaaaagccccaaccaaacaaccaaaatcccaaatcacgcagcaatccggaagaaacggg

SEQ ID NO: 21273 - DNA, 40277 bp, Oryza sativa
ttgaattcaaactagatactagtactccagttttcctttacaacggaccaatacattttgctttttaaacgggcaatttctgggattctattgtggcagggaggagggaaagagcgagcctacacaggcttacggcgagggtgatgggctgacggtctgaaatttattgggcttgtccgaccggtgcagacgaggtcagaggacgaagcattatggcccaacccacttcgaaagccttaacaaatgtggcaaaccaccgaggccgatgcgtaagcgaaactgctaatgcgcgactagccgcacgcacgtcctcccgcgcggcgaggaacgtggcgcgcgcggagagggccgcggcggcagcgcgtgcacagggtggggcccgcgcggttttttttccttttcttttttttttgagtaaattacattggtggtacacaaacttgttaggtgggtgcaatttagtatataaacttgtaaaatgctcatttcagtacacgaacttgtctagttcgtacgaacgatgaccaaaataacttggtaatgtcaattttatgaagttaatgttggttaggatgcgacgtgtatacctgtagcgagtatgtataagacatgcaatatttataaatttagtctctactttatccttcatcattgaaatgatgaattttatatgtttctaacccttatatcagtgctcgatatttttaatctttttctactatcactaaatcctattctatattttattgaataggtgtaagtctagtgtcaaccttctcatatatatacatatatacatacatatatatatatgtatgtatgtgtgtgtgtatatatatatgtatgtatgtatgtatgtatgtatgtatgtatgtatgtatgtatgtttacatagcatcctaatcaccccctaaatcaataggattagtcatatagtgtcctttttgacttccccgcacgcaccacacaagttcatgcaccaaaacaagcattttacaagtttgtgcactagattgcatccacctgacaagttcgtgtactgacgattcaatttactctttttttttcctgtttcattttttctttccgtttttgcggttttcattttaggtttctttttttggttttttcttttcatttttttatttttttaaacatatacgtatacatattttttatacgttatacaaagtttatatacgtgtatacaaagtttgtatatgtatatataaaaactttgtatacgctgtatataaagtttgcatacatatatacaaactttgtatgcgtatgtatatgaagtttgtatacttgtatacgtatacacgtgatgtgttttttggttttttcgattttttaacatttacgtatataaagtttgcacaaatagtacacaaagtttgtatacatcatagtttgtacacatcgtatacaaagtttatacacatcatatacaaagtttgtatatgtgtatattttttatacaacaaaaatatatatttgtttatagtagtagtatagtagtattagtagtaatagtgtagtagtactactagtagtaatactggtagtaaatactccatccatttactttttatagtcatattttatcttggcacacagaccaaggataagtaattctatttatcatccatttaaacatgctaatagttatatctcgtaaacaagcgattcattaaaatttacatttttcgatgcccatgtagccaatcttgtgtggaagaatagagagtcatgtattaaatccgaaaaagtcattaagagtataggttgttagattgaaatatgactatctaaattaaattttttaaatttagaaatataactattaaaattagatggagggaataactggttcctagtgtactactagtagcagtagtactgggggcgtcgcgcgcctgccgtcagtcacgcattaagcgtccccgtaagtgcgtggatggacacggagatagcaagcccaggaagtgtcatatgtgggccgtgctggagtactcatcttcgatctgaatgggccgtatcaaagagaggagacgtcaaagtctaaacggcaaaatcatcagtgctcaatgttttctctaaaaatgggaaaaagaatcaaagcttggtatttgtagcccggaattttttttttaaaaaaaaatgaaaacggccacccttccagaaaaaaaatgtattagatggaaaaggtagtcaagtactacttgtcatcagaaaaatggcgaagaagatcggcaagaaacccggtctgaagaagcaggtggcaaagagatggcattttgtggtttatgccttatggatacttttgttttcatttaagaacaggtacaaaaatatgcattgcttatttataaattcttatagggaaaagggcaatgcctactccattttctttaattgatggcgacatatttatggaaacaatgcttaatttagtctggcttaagtataggatagtgccacctaaccaaattgccttgaattgttatgtcttaactaaacaagctaagttctccagctcagaagcacatccaaatatttgaccaagagcactagccagctcataattcgcggaaattgtcgcacattcaagtttctccaaggtattttaaatacacttaatgatatacaaaaatatctttccctatcagatcaaagctcgcgcgaacaaattgatccacgcaattaatgaaatcctcatccagcaaggcaacgacttagattagatccatccacttcattttatcaccaatttgtgattggatcaggtgataactaagaagtacttttctcgcatacacatgtgcattgcaatgcaaacagttcgatcgtattgcagagatcatacagttctctccaggggcaagtcaagctaggccccatcacatgcaaggcgaagccagagtttaccggtaatgacaacatgatcttatcttaatatgtactgagtaggagtaaactctactaccttcgtcctatattaccgatcgttttgactttttttaatatttgattattcgttttatttaaaatattttagaattattatttagtttaactatgacttgttttattatcaaaagtagtatgatttatcttttttaatatttgtactaattttttaaataaaacgaatggtcaacggaggtagtaattaggaagaattggatcagatctcgagcacgtattagttccaaaattccaaactacatgtgctaaaattacatcaagtcatccgtgcatccctctcctattgtggataaatatctcgtgatcaatcgatcgatctcttctcgtagtaacatgttgatgcatgcatgtgactgggttgcaaacggcaagaacacggaggcagatagtaagaaattaaagaacaaaaggttttgcaaatggtggagccagctgctgtatgaaaaacaaatcatgtggatagggtgagccctcctcttaatataatcacgcggataatagttgtgtaattagtggttctcctaatcctggaggttagtgtggactaattggttctccggcgcatgtatcacgtcgtagtgagtgtgagtggattcttcgagaacccgaggggcaggacggtaatttcagccgtagctgtcacccaattattggctggggggggtgctctcgtgcagcacagcatctgacgtggcgcgccgagaaacgagcagctctgagtggctgacgtgtcaccatcgtacgaaccgacgtatggagagaaaaaatatacggatttgctaaaatgatgtcgccatattttatggctgattactcaaatttctgacccgtcagatgttgttcagtccactcaggtccttagtatttctctgctgtcattacacgattaattaaaacttaacatgcttcattagtttaagcttttgatggttctactcatatgtatatgtatatagtatataaatatatgtaatctacaatgcaaaatatagacgttgtcttgcacttacattgtaattacattcaacttacatatataatttagagacttacatatgtaattttgaaacttacattgtaaatacactaaaattacatatgtaatttagggacttacaatgtaaatatatggtgactattttttgtgaaaattatggcgctataaatatagctactcctaaaaatatatgggccggatgattgtttttgtcgagggtgatgacactgttcgaattaaaatttgcgtagccgctccttcaggaattgttaactccggagtggaatccaaatggtcatggatggatgaatgttgctactactgccaagggtttgcatttcaagaagaacaaaaggagaaatgggttaaccgtgtcctctttcgaccgtccaagaatgacgttaataccatctcgatgttgccacttcaggtaaaataacaagactatgagagcgtgtgacatatagaaattttacggtacgatatactaccaatatatactggcagtatttagaaggacttattagaaatttgatagaaaatttaaaatacactttagtaattttgggttcaaattgactgtaattgagagtacttagtcctagatcttatcgtgcattatggtaggagtatcctgagcgcatttgatgacgaaacacgtgatgatagcacaatttattaccctttcaaattttatattgcaatctaattaactaaaaaattcaaatcagtatacaccgttaaattatgtatacttacagtagtatattataccttaaaagttctcacgacatatactaccccttggatttctagatgaatgtgttacccctgattttttcttgaggataaccatcaaacttttgtggttaaatattgagaaaataattctgacgaagtcgctagaagcatcaccctgcacttatcaatcacggcagagacaaaaaaagaatagtggagaacacgttaatccctaaacgctagccgtagaagcgacggccgtaatcagcaatcagtctacctcgccgccccggagcaacgcagccaatcccagatcacttcccgctgccgggacaaaagaacccatcagccaatcccgagggatttgtggtgagacgtcacgtcgcccagcctccgaatccacacgggccacgaggcctgcctcccccgcacacgtggctcgctgacagctcctcggccggcgtggctgagctggcaagccgcccgccccccggttgctgtcgcctcccccctcacaatccgagcttgattaccaagtgacgctcgtgtgatcgtgttgtttaacggcttactccctccagttttattttaattgacgttttagataataacacggtctataaaatatgtctttgatcttatttttctattataatatatataactagcatggtggcccacgcagattgtgcggctagcatcattatattttctctcatataatagcatatatgttttctcattatattattaaaatatattacaatgacaacataattttaaattttgcaataacttttcaaaactactaatgtgtaataactactctagtctactcttctaatatttcttattttttaattctgaatttcagctatttctaaattgtatttttatatagactctgctttttctttttctccgattaatgtgagaatttctaggccatgagagcgaacatagagtctcttttttctattcctttaattacataatagataaataaaagcatgtttacttttattacattgcattgaaagacaaatctatatatgatgttctaattcctttaaactaaatatttttaaagttattgatggtcaaaattataaaagtttgatctcaattaatatggaaccggagggagagtaataccaagcgatgatcgtgttatcgtgttgtttaacggagctctgcgtgagactgacgacaaaatttgttacagatatccatatcttgattgtaaaaattcagtagtgtttgcttcaacaacactttcttttttcagttttctatttttgttttttctctctcccctagcataagccggtctagctgattgcgtcgtgtaaattaaattcttttcttctaatatattgacgtgtaatctttttgcgcgttcgtgaaaaaaaaagcttcaacaacactgcaacagaccatacacgtccttagcatgttgcaaggaaaacaagcacagatgatgccgaggactggacaacaaatcgtcgactttgatcactggtgctagcttaatttcgagcttagcagcctgcctgaataaacattcggtagtgctactcacggttcatccccagtgttttattacgtagctccattagctgtgacacagaacaggtcaagttttaattttttttttccatattttcatctgagagcttgtattcaattctatcatatccttatccatcatgtcgttcattaatccccaaaaccagcacctaccagcttgctatacgcacaagtacccggctaattttccaaaatcacaaaccacaccctactgatctctagaaacttcaccgataaccgtaatatggcaaatccggaggggtgagcacagcctcacacgatcacattcgtgactcactcgaaagagaaagcgagagaaacaagaaaagaaaaaaaaaatatccccatgtgttgccaactcgccaccggccacacccggtgtctctcgtgcatgcgctgcgctgggtgtatatataccggcctctctcccgtcccgtctccgcaccacacaggcagccacacacacaccactccatttctgagctcttctagtttgagtgagagagcagcagaagggagtagtgcaagatgccgatccgcaacatcgccgtggggagccaccaggaggtgtaccacccgggtgcactcaaggcggcgttggccgagttcatctccaccctcatcttcgtcttcgccggccagggctccggcatggccttcagtaagtcgccgaccttaattttaaccaccttgtgtgttgtcactgccactgcaaatccactccatatactatgatgatactacaaagtccaggacttaattgtggactagtttagcaacgcatgaattaatccctcaaaataacacaagacatgtgggggagaaaaaagtttgggaagatatacaaaacttttttctctccgtccttgcaggagtgagagaaactagacgccgtgctatgataattaagttgaaagaaaattttcttttgagaaaaagtcaaaagttcgtgaaataaaaagtggtatggcttttaggttgcatgattgggcccaaatgaccggtttgcccttactgattacgtggacgaagggatctcagtagttctgtttcagtcaatgatgtggcagtcacagaccatgtgcttgtgccaagaactagaagcaaaaaaaaaacttttcagacaaaataatatggttaattagaattaggagcataaattgtttccaaactccatagcttagcaattgctcaaacatattattttacaacgaaatactgaaggttaaaataatatatatttttttcagagtagcaaaatccactagcttagttaagcaaaagagtaatacaatcagtaacatgaccaaaagaagaacacaaacgagaaatcataagcaaatccacaaaattaaattaccatttcgatctctgaattcttcttacgtgtacctaactgtcatgcgcgtacgcaggcaagctgaccggcggcggagcgacgacccccgccgggctgatcgcggcggcggtggcccacgccttcgccctgttcgtggcggtgtccgtcggcgccaacatctccggcggccacgtgaacccggccgtgaccttcggcgccttcgtcggcggcaacatcaccctgttccgcggcctcctctactggatcgcccagctcctgggctccaccgtggcgtgcttcctcctccgcttctccaccggcgggctcgccaccggcaccttcggcctgaccggcgtctccgtgtgggaggccctggtgctggagatcgtcatgaccttcggcctcgtctacaccgtgtacgccaccgccgttgaccccaagaagggcagcctcggcaccatcgcccccatcgccatcggcttcatcgtcggcgcgaacatcctcgtcggcggcgcgttcgacggcgcctccatgaacccggccgtctccttcggcccggccctcgtcagctggtcctgggagtcccagtgggtgtactgggttggcccactcatcggcggtggcctcgccggcgtcatctacgaggtcctcttcatctcccacacccacgagcagctccccaccaccgactactaagctcatcgccgccgccgccgcttgtccatgatcgcctcgtctccgactccgatccaaccgtttagtttctcgcatcagtgcatcatcaaacctgtttcatttgcttggatcagttgtacgttgaacgtactgtaagtgtggacctttgggaacccgttgctttgcttctgtaaaactgtgcatgcatttgcctgagttccttcgttttttcctagtcaaattcgatcgctattcgcaaccagtaccgcactacgtacgactcgtttgcttgtttgaaaagttttaaaatcttctcgaatccaatccgtgcggttaatttcaagacccgagggcccgtagcttgcagagttgcatcatcccaataatgcggccgcgcgtaacgacgaatggtatggtacgcgcgccacgtcggagtgggggagcagtggagataaggccgcgctgtggctgtcggggcctggacggcggctcgcgcgatcgatcgatcgattgggacggagtcgagacgcgcgcgcgcgcaccatgtgcatgcgcggcgcgcggctccgttccaaggcgtctctctctctcgcgcgcgcgatccaacggtgagatgagatgagatgcggtcgacggcgcgtgtaaatggggtcgtggtccacggttctcgcgtgggttgggtggggttggtttggcatactgtttctgatccgatctcatcgatgcaaagttggcacagatacttgccatgtcgatgcgtaatttcgcagctactcgtacggtgtcattctacttgtggtcagtcctagttattacagttggtaattggtgaaccaacaactctctactgttgagagcaaatcactccaagtccaagaccatgagaaactattcaatagtgtacgtagctatcactcccatcccatcatgttgagtttttagtttttgtccaccgtggaatgtactgtacctactactaccaacaaaggcgcaggggctgatgaaagtccgggcgactatgggtttgtttggtttaataccctaccaaaatattggtagtgccaaaatctaggtaagttttggcactactaatttttttttttatagggtagagttatatttggttggagaccaatttagaataagctttgagtagagtatagaaaatatcaaactagaataagctttggcttcaaaccaaaaccaccatatacactatttaaactaccaaaatattggtagggcaccgttttgacactgatccaaaacggccctatgcgtgtcgctggcaatgcgtccagaggccccgtgcctctccctgccagcctgacgccctgacgtccggcccaccactaactcttgagacagacgacgcctacacatcaccgtctccttctcttgtcttcctctatcttctcctctccttttttttctttcttttttataagtagcatcttcgtttctgttgatgatgcaatcaagctagtatggtgatgttgactgtccagttattaacgtgattgccgcatgaatccgttttactgcaagtgttatttttcacattcacttggctctgttctgctgtaattcagtcaatgctctgaactaacagtgcaaagttgcaaactgctactacttcgttcgaatcttcagaagaacgatgctctgataccattcatctctggatatttttaagccattaaagtgtacatggaccacatcaatcatatggtctgtagcttagcattatcttgttttcaagccgtcgtcctcgcctagcttgtctcttgagtcttgattaggaccccagtaatgtgtttggtgtgagctaatatagctaagaatcaacaacataaattatccttaccccgagacaaaggaatgattagtctacacaaagttggcgcaacgaaaccaagagcatgtgtttatggcaagaacaagaattgcttggacgatccgccgctttggcctccggaacctactggatcgcctctttttcagcttttcgttgacgatacgtgcaaccagcagtgccaagccccgttgtctccacgttaattcgtggttgatgcttcgcgatagataggtgacacggacctcacatgttgtctgcattagctcgtacttccctctctccaaaaaaaaaaaaaaaactcaaccacttctcttaagacaacaatctggtcatcatatcttcttctagattaattttttttattttggacggatgaagtaagcatatgtgctagaaccgtagaattcagacatgtttaatcgcagcggtaattccaaataggaattttattggcatgccttgtctcttctcagtggagagaaggatgtcgctagctaatgaacttattgccagataactacacgcaactagtgaaggtactcgcagccattaattccctcatgaaagactgaaagttactatcgataatacaattaatgggttttttgtcatgtttctgaaatatctagaaatggagccgtacgccccatccctctcgacctgattgcacgatgatcttgtcggctcgcctgatgctcactcgcatcaaatgcctgtgaaatactccatagattagtagagtagtagcaagccagacaaactttctactgcttgttatggcacactgttcatcggataccgtcttcgtcacatgacatgtacccccaaactcggctatgcaccgctggatggatggatgggtggaggtggagcccgtgcgagcggccgtgccatgcacctgacgaaattatgagaaaaaccagcgtggtcgtggcccatggcgctcgtgtttggctcaatccattcgcggagaaggggagaggtgatcagtgtgcgaggctgcgcgccgagaaagcaagaatgtcgccataatgtttgctgcctactccggacacccgggggttggtgtcctgcactggctttggttctcccggtgaaatctgaacctgacgtaggagtagaacgtaacggaggatgtggtgccgtggtggtggtttatactgtcatccaccatgtcactgttcgttttgccggtacatacacgtgatggcctttctcctgcgcttgaccgcttgtggcttgccatgagggtagcacctagattggatctttcttgtcccttcggtttggttgctctgcctagctagctgcgtcgtcatcttgcggtcttgcgtgaatggctagcccaaaaatagcagaattgtggcgccactacaaggccaccgtgttagcgactgaggacaacgttttgcttgtcatttgccaacactgaactctctcctgaatgtttttgcctatgcaagtatgcatggttgcctatgtttggactaaactgtaatgacacatgcctccttgtgacgctggtaaatactaagagtacagttttgttccccttcctgtgaaatgattgtactgtctttttcttccgctgaaagctgcttagttgcacaaatgaaaggtacgtacaaccgtgcccttttttatggtatccctatgagaagatctgatccgctcacggatatatgcgggatcatcttttccatggctgcatgcatcacacattcacatgcattcatctgggagcccatgctcatcatgactgtctcctcagtgttcgcaggaagcagtcaccgcgcgcacaatagagtgagagcaaaagagtttaagcaaattatcaggcgcatgcacatgcaaaccccttgtgagcatctggttcagctttcttgctacagaaacataatctggcaaaatattagtatgtgtcaatgacacaggcattgtaggtccaagctgaaaactactgtgagatctggaataattcaactgattcagtttaacagagtgtcacagagcttcgttgataataattgttacctgcatgataagttaatgacacttccaccatatgctcctgatatacgccttttcttttgtacacagatcattcagaattatgcaccagatatatacttccaccatatgcaagacaaattgtcaggatcccattacatgtacatttccagaaaacaagactagtcgacatgatcctggcacattcagcacaccaaactgctacctgaaggaagttagaagggagaactttttcttttgtacaaatcaattcccagtgttcgcaccaaaaacttcgtgtggttatttccttcttaactcgcatcagctacaccaacaagcatttaggtacaaatcatttacatcagtacacaagaacatgctaggtctaagcatcatgagctcgcatacagcaaccggaactactgacagcatcctccattttttgctttgttctcgtgcttctgtttcagagagttcctcttgacaactgaagaaccttcctccaagagacttggtacctcaagaatctgaaataggacacaccacaagatatttacaacattgtcgtaataaggacaatacaatattgtattacaattaagtaaacaatacacaattttatcaagataacattgtcacatcaaaaggtactaagatgacctttaatcttgtttaaaactacttagaatatataaataactttttagtgaaaagcagaatcttcagcaggagctgaaaatagttgtacatcaacactcttcctcctacgcttggtgaaagatgcaaaaatattcatgaataattcaaactttggcttattttaaacaaatctgtttttagaaaaggaatgctagttgtacgcttcaaggatatatatagttcatgcactcatgtgccagagctacattaaaaatgtggcacattaaacattgcacatgcaccaccatgtgcaaacatcacattaaaaagaaataaattacagaacacaagagtcactaaactggcgcaagcatgctctttgttggtaccacaggtaacatgcttccaataagacaggaacatattccatatgctcaggtgatgagtatgattcaataagcagaagaaatcatactccatgattaattctttcataaatgaaccttccgagaaatgaaggaaaaaaatgaatatgtccatacaacctaataatggaacatttaaacacacaagactcctaggcataagccatcaaaagagtgacaacaggataagaaagagaacaataggttctcaaggagaaataaaagcaaagaaaactgcaggagaccaggaactaaggcaagaagcattgccacaaaaaatggcataacaagatactgacacacttgctgcacaacactcaatggtgtggagatggacatatggtactgtgatgaaaacaaaaaaaaaaaagacttcctaagacatgaataagtgcagcactaatctaaagctcaaagaaaaggcaacctaacagcacagccctctaaaaatatgtgccaaatgatctgatgatttcaggtgggttgttgacagcccccgcttgaaggcttgttgaacttgttctatgccaggatgagaaagaaaatataatcacttaaaaaaacattaatcctccagaaactgcttcccactgctaggctgcacaaaagacaccgcacaaatggatagctaatgacttcaatacgcagtgattgctgcactaaccaacagaacaaatggcacaagacatcatatgcaggactcacagcatttagaaaaatatgatcatgtgaccaaagaaacctatgaagctatatcaccacagcaagagtcttatattaagaagaaaaaaatgcatgacaggttgcacagagaaaaataatgttatgtgccagaagactgcaaggcctgaactctgaagcgcactgtcataacaaaaatacgctacaaactaaagatatgttcagctttaacttcaataatgctactgcatggagttggtttcataagttcacaggtcaacctgtatgtatccattagttcaaataatcaaagcagaggttaagactacagtgcttagagcaggtacaatagcaggctattagccagctacaaacatattttaatgagataaacgatgagagagaagagcagcgggctacagatctgtagactgtagccagctacagcatggactccaagacgcaatgtgcgtatgacgggtgggaccatatattaatagtatagtaagcaactattgtatgaattggctattagattgactatagatgaattggagctaatagtgggctatactattaaacttgctcttagtatattatttctgcaagtatacctttaacgcaagctcttcaaagcatttctccacattttctcttgttttggcactgctctcaagaaaaagacatccagattcctgggcaaaggcaagaccttcttcccttgtcaccatcctttcctcattctacaatgtagaattatcaaatatcagaaccatgcactgccatttcatcttaggtgctaactcctataagaaaaatggcctcgatcattaacctcttcctttgtttggtaacaatctaatgccatgtgtattgaaaatttattttcttcccgcatgccaactataatagctgtactctgaaattgtcaacctcacttatgtaattacaccaaatgctatctatgataaggtgctgaagtgatactataaactgtacagtgttacagaaagtgctataacatgttatcgatgaaccaataaatacttatattttagaaatgggaagcatcaacagcagctgaaatggaacaaggttccaccaaataataatttgatttaaataggcaaacaatgattactttgtccactttgttcccgacaagcattttgatgcactctttatttgtcgaatgcaattctatttccttggcccatacatcagccaaatttgtgaaactttctctctttgtgacatcatacactaacagaagaagacagcagaaagttaaacttccatgaattaaccaggaacacttttttccagaataaaagagcaagtaaacatattattcttcctacaaattaggttgcaacagaagtttttcaatttcccagatgcaacataaaaaaaagagggttgtttgagacttgttcatacatggtcatagtaaattttcacctcagtggaaaagaaaacccatgatatcagcacacaaatactgagtaaaacaatgaagcgccatggtgatggaaaggaagcaactgtctaatagcaaatacaactaatttgtggcaggatattctagtcactagatcgttcaggaatcacactattaaactatattaaaaagatcctgtatcagaaaaataatgatggcaaactgacaatgcaacaccacgttggagcatgcacacaatatcagagataaaagtgacctaaaatgtgatacatggatgcaatacgagcaactttcagagttgatatgccctaagtgacagtgagattggtataaaaatgtactgtaggcatgataaatgcttagaaatattgatggtcctgaacataagttgggaatagaattacctagaatgatgccatgggcacctctgtagtaagaacttgtgattcccctaaacctttcctggccagctgcaagcaataaaaagaagtccatgaacaattgaaatcttttgaaatcattaaataacataagctacagaagaacaggattgagccaacaaatatcatgcagcaagaacagttgaactttacaggagaaaaaccaaagccttttctttgtactaggagtattacttatttctacgtatgcaatggaaagtggaaacagcttttttcataggcccctttctgggtacaatgaagctgcctttggggtaaaaggcaaaggcagctgctttccaacattaaaaaatattgacaaatcaacaggagaacaccattttcacaaataaacatgtacggagtaaaaaacaacttaccagtgtcccatattgttagcttcagtttcttcccattgacagtgagaaatttgattttaaagtcaacccctgataaatcaatgtggaaacaaggtaaattcgtagaagtaaatagaatgaagttataggtagttcaacaaagagggcacacttatacagtacatgaacatgagctggattcctgccactgaagtgataaacctttaccttattattccagaatgagcacatatagaaggttttgccccattaacaatttagatctgaataattttcaagcatgactcttgaacaaattcactactgacaattcatgcatagtagttagtacgattacaattcataaaaatcttgaggagagttcaggatcaagctttccgcacagttagttttgtagtagtgttaaaattaagaggtagtgctatccattcagttgccgtaaaccgctgatcacttcttttttactgattctctaattccgctgataacttcttttttactgattctctaacttcacacaaaggagcagacatgcatgatatgtgctactgcttagttgacggtttcacacctagacgacgtaacaaatccaaacgtgtcccttggaattaggcttgtcgcaagcaaggtcactctcaattagatcatcaatacatagacagatcgcaaaacaatcagtaagcagtagtagtagtgtactacgggctacaaggtgcgtgaaacaacagtaccacagagatgtccacagcttggttactccagtgtttggtgatccctctacaccgaaccgagaattgtaccatcgtcatcgcatctttcaacaaaggtaggagtacgcacatattttacgtctctattaacaggaaactaatacagtatataatagagacaaaaattaattgccggcgtcggcttgttccctgatcgggacaaggcaaggaagcggacatattgagcacaggaggaggaggcaggaatcaacgagatccagagaggacggggggaaggcatccgtacgcacctatggtgggagcgatttcgtcgtcgatgtgggaggcggagacgaagctgacgagcagactgctcttgccgacggccgagtccccgatgagcaggatcttgaaggagcagtcgtagctgctcgccggtgaagaggccatggcaagggaaggaagggcgcgttgctcgccccgctcgctcgctcaggcgtggatcgaatcgcggcgggcaaagcaaagcatccggacgcgaatgccggcgggttggtgcgcgtctgcgtggtgtggaggagagagagagaggtgggaggagtgggaataaagcaggcagcgaggctcttcgatgcgaggaggaaaggcggaagtcagaaagcgaaacggaacgacgatagatgatgcgtcgggtggtctactttcatcagttacggtttgacgactcgactcgacgcgacgcgacgcgacggccacgggggctgcgtgtgggtccgaggcccggatgcgcccgcgcggacgccgctttggccaggtgtctccgcgccgcaccgcgctgtctcgcttcccgcgcggcacgcgtcgtcgtggcgttggggcgcacgccaccgcgcgcgaggggagtagtggtgtggattgtggaatcggcgcgaggccacggcccacgggtgcgtgcgtgcgcggtgcagccgcggccgtcagcgagcagcgagagtgcgagacgccgagacggaagcgcagcatacgcggctgcgtggtgggggcactgggatgttcggagaaatcgagcgttgcgagccgcgcacgtgtaacgtttttccaggcgcggtgcgggggatcggcgcgcgtgggaggggggagacgtcagacatgtgccgtgcggcgcgctcccgctcgctcagccacttctcgcgggggccgcgtcgtgttgtgttggacgtggtggcgaccgggggcggtgtcgcgttcgcgcaggcgagcgaggacggaggcgtgtgctcgagaactggagcgcttggatgtaacgcttttttagccgtttgctatcacgtcgcgatgctcgcctcaggaactgatttgggcacgatcgattggtcctagtctggctccaagagtgtggctagaattatatctttcagttgcatgtcaacctcattggcaaaacaagatcgagccactcccttctgccttcgtgctgtatgttttcctaaaattcaagggtataattaggatgcatcctaagtgatgaccgatgatgaatatagtcaagtttatgatgacttgtaaaaaaaaattaaaatgttcataaaaaaacttaacaaacatgccacgattgccttcgattggttatttgcaacaaacaacgtcgacgtcttctttagggtcacagggtggtgaactggtgatgatggtgatcagtgtcacaggaaggatgctttgtaaagtggacaacgcacacgaggcttgatgatcataccgctacttctttatttcaatctcgtaagcaccggcatgccaatgaacgacgagcacatttcgttagttcctttttctttgcgagaaatacctcaccggcgaaagcacaacgcgataaaaatcacggtaatgataaaaatcatctcgatgcagagtcctgactggcgcttgcggccaaggcccagcaggcaagcaaagtcgaaatccgcctaaagcacaacgctgggccagattagcaccagaccggcctactagggggaacaaaccatggacgagcccaaatttcagaacaaacggttgtttgcgttttgatgggctttgagactaatcacaggctgcaaatctttttattgggcatttcagactgcagagagcagtgcaaatctctcgctgttcttcggagttcagactagctctcatctcactgttcttcagaattcagactctggagcacgcggcagcaggggcggctcttgtctgccgggtgttgtaagagctgcatccggggcacttgtgtcccaatatgtggaattgcacgttcgatgtcgtcccacagtcgttgcataggatccatatctgacagagccaaaaaaaccacaaaaacttttgttcagcgtatagttacctggttggactgaagaacacaagtaactgaatttacataccattttcttctgatagatcactggcatcggcgatgctgcaacctgagtgaagagttatttggatggtgttctatgcatgtatgtatgtatgtatatgtacatggtcagtgtcaatggataagctgtgcaatgggagaaggaaaatgcacctcttgatcaagcttttgccatgcatgggacatgtcacaagcagacctcaggcagaccgggcaagagaatctggcgaaatgtcacagattgacaccatagtcagcaatcagttgggagaggccatggtgtaagtcttatctgtgattacttactgttgatgggatctcatctcgtataggcattccagatggatcgtgtgtccgcagtgcagtgcactgatgtcttttgttgagtcaaatagatactagcacagaaacaaataagggaatttattttagtagaatacagaaaatttcagagtccatggtttctctgacaacaaatatttacctcgaagcatacagggcagttatggtgcattgctctttccacacaatgatgggaatccttcagcacatagctgtagcagcatcctgataaccacaatatttgtcaatgcaaatatttactaataccaaaatctgaaattgatgaaatcactcgaccctaaacataccgcatttgtcacagtgaaagaagttctctgcaccaccagttctgtaaaatgtgatggtgagatttatcaaaaagggctcatatttcattactccgtcacaggaatgcatatttagcacaacttgcctgcatatgccacatccatcgcagtgaaattggttctttgatacctggaacaagagcgagagccacgcaagtcagagaaaagaacagaaataccacccaaaaaatataatcaaaatgctatttagtttcattaacagcacaaggttcaaatgttctttatgtgcttacatcgtcatcataaaagttgcattttgcgcagaaatatttacccaagcatgccccacaattggagcaatcctgttgtacctacaaatcaaaaggcggacgaattttatgtgatgggaacagccaaatctgatgacacctgataaacactattcttactagttttttttttagataatgactattcttactagttattggcaacttacatcctgttctttgttgcagagagagcagataacctgtgatgaggaaggtagaacagtctcaataagatcactatatggtttggtggtatctcaaaaaaaaggtcattatattggtggaggaggctcattatgattaaacaaccaaaagtggcgaaaggggagatagtgacttgtatccatatccacaaaagaacagactttgcccgtttcaaccatacaagcagtcgcagattctgaaatttgataacggctattggttttactccagctgtcttctctacttaatctgtgcagttatttgtgacctggtgactttttttacgctgagtttaaaactagattctatgggcacgtagtgaaatattttttttttttagataatgatctagtatgaacattttcagataatgatctagatcggacatgcaaccaattcaatctttaggatatgaacttgcactgttagttatagttcattcagtctttgagtaacttctgaaacaccagttatagtcagccatcaataataggagtgtgtagttgatggtacaatctattcttttgcaactatgctgtgcttcaaatcatcctgagttcttgactaacggtgaaccatgcctacaatagtttctcccacttgactattctcttacatggtcttaggataggtctcatcccatgctaggttgctatattctgggacggagagagtacttaatatggaggacgcacctatactgctgcacggacacattaagtagccaaaaaaatcaacagaatctggctaagtatctactctctccttgtcctaaaatataaacaattttagaaaattgcaaagtcaaacatttctaattttgactattaatgacaaaaaaaatcaatcatgtaaaattgatgctaatagtttatcattaatcaaactatcataatatacaactatttttatttaaaatattttatctttatacatattgttgatcataataatatctcgaaaaatgtgtcgaaatctaaaaaaatgcttatattttgagacggagggagtatacagtagtagtggataagcgtacagtagaaaaggaaaagaaattcaggatggaactgaagcagcagtaatcaatcatttccaagaatattgggcagcgcaaattactaatatcatgtccgacacgacagttagcatcaaatgcagcaaaatatccgataaagtaacagcgatagtgatacgctggaaagggcagccaaaataactggacagggacaccgaccagcttgatttcatggcgagggatctcgtgccggtcgctgatgctgacctccaacgagtcctgtaacaaagtaagcagaacaataaggtttttttctcctagccagagacaattcaaagcatgtaatactgagacaaggaaaaaacggtgataccttcgcttcgttgtggcagtgcctgcaatcgaagatctcgccgcagcagggcgcccttatcttgcatttcctcctgtaatgcacgcatcttgcatatggaagaggaaaaaaaggaggagaaacaaacgagtgatcagtaacgacttgctagtaaaaaagatccactgcatccacaggaacggagacatgatgaatggtgcttacccgtactgctcgactgccaagtccatctccatttctcgcagctttcctcgaactgatgatccactaactgaattctcaggtattgtagctcttagcacctgaagagagaccaaaaatgaagaagcaaatcaactcaaaacttcttgctctgctctgcatctcttctcaggtttttcacctcctctgaatcagctcggccatctcgccgccggccaccacagaccagaccgacgacgagacaccaaacaaaacgcaaggtagaacaagaaaccaagacgcgaagcagctgcctctcaccgtacttaacgccaaacccgagagagagaaaaaaaaacagagccgcacggacgagccacacggcaccgtcccacgtagtacctgcgtgcgccgaccaccggccaacccgatgatttcgcggccacggcaggagacagccgcagcagcagcagccgcactcggccggcaccgagtcgtcctccacgcttgccaagggtctcctctctcctcgcggagggagaccgactgcccgagcgagcgagcacgagcacggcctgcgcctgctgcacgcacggctcggcgcacggctgcacccacggttatatatttgggtaggcgcggcgcggcgcggtttaaagaagaggagaaaaacgagggggagagggggtcgcgtagcattcggtggcgcttggtctttatgtgacgcagtaaataaagtagtcgggcgggccgcgcgtcacccacccgcgtgcggctgcccatcccatcctcccccaaacctttgacatgttcgggccgtcatctcgtctgccgactttggccgtcctgtggtcgatgatgcttgatgttgcgctcgcctcctccttgcagcgcgaaaactgaatgaagtgagtgtcgtgctgtaattttatcagtgtaatcatggttgaaagtattgttgtccgaagttgttggcagatacggagtacccctacttggggttggtcataaatctgctcgtcgatgcctttcaaaatgcggaaaagtaaagctggtcattaatcgctggatcgttactgtatgtcaagttcctgtgcctgcttgaatgcattgtttgctgacgaccggattatccttatgcaacgcgttgttccgacctgaatgatctcgtacaccttggtacatgatgtcggccatgaggccatcctctgttcccgtcgagctctctggcattacaccgtacacgagataccttctcgggttttcttggccaaaacagaacctggtatttctactgcatggtttcctgtcgagagaagcaactgttgcttctctgaaccggaagtgcgcgtctttcgtaaaagcagctccaaccttgctccccaaaaaaaaaaacactagtgaaagcagcttcaacttaacatgtcccaaagccatttgacctgcaaactaaactaatcaagaatcagcagaatgtaccgtctggcagaatcttcagcctgagaattgaggcatgctatccgagtatctgagcaactagaatgatcgtaccatttgttaatgcagttctatacagattgggcagcctgaaagcaatcctctgcctgcctcgaatttcaccttctcatcgcgtttgatcgtctacctgacgcatctcagtatgaccgaccggatcaaataaaatgagaagaagagatgaagaggcgtgtattcaggttcgagttggtgccgatgcttggtaaacaagtgctgcgagttgcagggtagggtgtcttgcagttgcaggtaaccatcagctagctagctcgatggtgcagttcatgggatgtggagcaattttcttgtgttctttgcgatgtattggaagtgcgtcatgtgccatggttttctttaatcttgtaaggccgacctgcaatttgcaactaaaaagaccatggaatggatgtgtcgttttccattgaactgtatatagtaatgttgttactctcaccaccacacggtctgcactggtttttttttaatccttgttgtgttgtctcactgtttctgtatcatgatattatcaaacgaagcagtggctcatttttaatctttgctttaatcttgacgaagcaagatatagtgacacgatcgtaaaattgttattttttagcatttatatttttatattttctataccaagttcctcctttggttttgaggcactcccttcgtaccataaaaaaacaacctagtataagatgtgacatattctagtcctacaaatctgtacgtagattcgttttttacggcacagagggagtactttttttaatatgtcatatgattttatgtaaaatttatatggctattatatttacgagggaggggaggccgggagggtttggagattgggggtaggggatggatgttttgcagaaaaaccctatacttttcatgtttagagcgctacccctagaatcggaattttctcttcttcacattgtatttcattagaagacaagggggtttccggataaaatatgatgggctgtcagtcgattcaaggatctgtgtaatattttgtacaaaaacgatgagctttttgcaaaaatagtcaaccacgcttatccttccccgaggagctgaaaaaaaattccaaaaaaggagaaaatttgtacggttaggggagttattgactttagatgttgcattcaaacatatcttataaaaatttctccatatttttctacagttttgataaccgttttctttatttttaaggtttgtgtttattgtgttcaaataaaaagcaactaaaaaagttgtgtttaaatgattactattgtgaaaaatgttgctaataattgagcctagctgtcaccgagaaaaaccatacgatctgaacgtccattttccatccaacgtttcgagatactacaagtagttcagccgccagctaggttttcccccacttgctcaaccccgccgtcactatcttcatccgccgtcccgacgccgcgagcccaaacccctaaccccggagagcctcctcgccgcagatggcagtccccggccgccgcgacgacctcgtcggcgacgacctcgtcgacgacgacgggatcggcgaggagtacatggccccctccgacgacgaggaggcgcaactgcctgacgaactcttccgcctcgccgacgccgcccagtccggcaacgtcgctgccctccgcgccgcgctcggtaccgaggcttaaatcctgtgcactctctcccaatcctcgagtttttctagggttattatgtaggatcgttcgattggattgggggtacgcatgttgggtaggttggtgttggtccttacctatgcagcgcaattctagatttgcccttccgtgtttgtggatcagctcctgtagtagttcaacctgaactgtggtagtctgaagtttgtactggatgtttctggcctatgggtttgagtcgtttctgcagaggccctatgtgatgcaaaaacagtatcggcttgaaaaattgattgccactattacatagaagcagcttgaattttagtacaactctgtgtgcaggcacttggtattttaatacgagtctgcatatggactagactagatggagacatgcttttgaaatataaaaaacaaggctaattatatctttttttagttgaaatctatagtacccctttgttggaaaacgtggtaaactggtgattgaatctaaaagtagcacctgaccatgcactttttgtgatatttgtaactgttgtgtgtctagttatctgcatttgatgtaaagttagcttggcgtgttgtgccgaggaagtgatgggataacgttagtcacataaatcttttcttattatagtaaaaaaacaggtttgaaaatagcagaacataatcccttttgaaaatccacaacaatgccaatttcttctttgcccaacccatgaaattttgtcctgggcaattcatgtaatttgaagggacaacactagtttgtgaatctgttatcttgttccttttttacctgcatgctatgttcctattaaccttcattggatggttttaaatctttgtttcactttcaacaccaatttgtggttaccttgattttttctgatgatgtattctctattcttcagttgtatattcggaacagtgaacttccgtgcatacataggctgtcctggttgattcatctgtttgtgtttgaaacttatcaagttgaagagtagtagttttcccccattaattttcacagaagctgcactgaaacgaagcactttgctattgattgggtagaattgagttcaaaaactgttgccaatgctttgtattttccattcttttctagtgagggctttaataagtcatgtccttatggcattcttaacacattgctgcaatcctgtaatgattacatatgtgtgatgctttcaccatgctaaccatctcagtgtgttgtggcaaatctatttcgtttttctaaatttcatagcaaaaatgattccattcttaaggtacctcacttttttttttctgttggctcattggacaattacttgcaagtggaagctgctatcagcaaaagcatttgtacacagatgattgttgtagatgcagatctttcgttaaaatcctattgatatgtgtatgcagataattattctggcaacattgatgatccaatagaagatggtgatactctgcttcacatagcatgcttatatggccatctaccttgtgttcaggttaatgttgttatcttgaattatttttgctctgctattagttgtatcctaactgtggttatcttatcagctactgttggaacgtcaagctagcttggaatgcaaagatgaagaaggagcaattcctcttcatgatgcttgtgctggaggtatggatgtttattatgcattgcgctctggctatttttatcccttttgttggcagtttgtatgtgtaatctaataaacacttttcatgtaggctttagtgatatagtccagtacattttgaattttgctgcgaacattgatggctgcgtaacaagaatgctcaacactgttgattctgaaggcgacactgtaaagtttcttgagctttaagtattacatgaaccattttttcagctaaatgctatcagcatgatgtataatttctgcaattactccgtgcagccactccatcatgctgccagaggggaacatctgggtattgtggatctcttgcttaaagctggggcatgtgccaagaaggagaatacttatggccaggtccctgctgagatggctgatgaaggcactgaagtccggaaactgttaattcaagagcaagttgaggccagcacacatactagcaattaattgacgtatggcaatccttagttgaaattggtaaaatgagttactgtcaggctgaatatctgtagtcattggaactgtgtagtggtatgcgggaaacatcggcaaaccatccatcaccacccttttgttttgtattggcttgttgccatctgcctctatctttctatttcgtatgtttgggcttgcttgatgtctagcaagatttgtgaagaatcatttcatcaatagttgatagatccatgacgacctgggagcattgattggtatgtgtatcctgccatgtcaggaaggtagtcactgtaccatcctcaaatcctcatccatgccgtatctgtcgatattttcttctttttttttcctgcgatagaacttgtacattggaaaaatgtcatagttcgttaattatcagggttgatgatacacgatgctacagtatctgtgctgtatgaagcatgccatgaaccttatccatctgggtatttagatgtgcaatgtgtcatattatggatattttgaaattcaatcccgatcaattcagtcagaaaatcgtatttgagtggcttgggtagtctatggcggtgcagcccgctaaacgagtccgagtcggactggcccgttcgaccgatataagcggacggcccatctggccatctcttgtgagatcaattgccgatccgccactctcccaaccacgacgatggcggcggtgcagcgccttccccttcctcccgccgcccctcctcagccgtgccgcggacgatggaagacgaacgagacgaacgggtcgtttccatggacggaacgtacgacgccgacgagaagcccgtgcttcttttctctcgcggcgacggcgttgtccgtgtccacgatctcccgtcgctgaagaagagaggggatattctctgctacgacgaggtcaagacgatatccatcaggtcgcgcggcgtcgtcttcaccggagatgcgtccggcgaggtcagagtggcgaagtggacatgaccgggtgatcagctgaggcacaagcttgaattagtttagctctgacctgcaagttttgctttgtggtctcgtgatccaatattcggatgtgtcatgtgctgtaacgtggtaaacagaggaaccgatacgcggcttgtgaattgtgatactactacctccgttttgtaacggtgtgaggctccaatcttctcaaaatttcagtttgaacaaacaaaggtatccccaacgaagtatttggttcaacagaaagtcgttgaaaaaaaatcgaagtaaaccggatgaattttttggtttccattccttcaacaaaatttcgtttaaagatcggtgtaaaccggtggaattttttgttttccatatcgtggggaaaggtgcaggcctaaatgggccgttttattgggtcggaatgaacaccatcccgtcccgtcccacgtatagcccgcaagcgcaccggcgcgagaagggcggggtgcgagatagcggtgtcgggactcgggaggaagaagaaggcggggaggggggcagagcggaggagcaggcggcgacgcagcatcgccgtttctctctcctcgcctctccaaatcgctcgaatcccctccccccaacttctccatggatgccgtcagcatcgcgatggcggcggcgccggccgtgatgagccggcggccagcggccgcccaactgggacggctccgctactattttttccatggtttctcggctcacatctcgtcttacttgctcttatctcgttactgctttgttgttttttgctctcatctcgttactgcttgtgtgcacttgtgtggttttggtagggttttctccacccccaactccgatcgcggtagttccccaagactgctactacgacccaatactcttcccgcaacaacccgatggtatgattccatatcgattttgaacatctggcgacacatttttgacccgaaatcactcggatttgcttcccttggattagtctttgtatgatttaattagcggttgtgatgcgtttccttctctcttttttttcgaacgctggaaaaggattgcacgtttccttcccacgcacgcatgaggccagcaacatctagcttggcatagaattgatgagtacacgcattacgcgtcgatgcggctaggttaagagattgaagaaactacaaacattaattgtgtcgctgcggggatcctacgaccatcacgatcgcgcacacatacctttctcactcagtggtaggtgtttattatatgggatgtgacttacatgctagttacattgtaattacagtacattagtattgtagttacatccgtgtgattttaatgaaaaaaaattgtcgggtgatatattggtaatcctctcagcccgtgaatgtaattgttagtcctcttaattgtaattgcaatcaaagatatatcctgtgaatatagttgtgatgatgatctttccttataaaaatatggttcatactgcaaggtacctagtactggagttatgtttgcaaagctcaatgctgatacttctgagattaagcttactgagaaacaggatgatgatactgaagacgacaagaagaaagtcaatgggtcgatgaaaatcccgcgagtatggctgtctttgtctgattgctgggagaaaatgaaggtctctatctttgagtttatgattgatacaagtggaaagaaagaggcaatctatactgtgtacagctatatcgctattgggattatcctgagccttaactgtttctggaaagtatggcgtgaagctagtaattcggatgaaaaaccatctgggtttaaagctttctttattaccatcgtttgcatggttggcaaaaaactctatgactctctgaagaccaccaagtaggtcggagaattgctgagtttcttctatcaagtggtaaaaacagctgctgtggaaattgacaaggaaaataaattgaagaatgaaagtaaccagaggtatggatatggattgatagttgcagaacttattttggttttaggaaacgggataagacagtcatacaatgatacccgtgcattgtctattttacagtgctaaaaatgatgaagctcaagacaagatacctgagagtgaaactgagaagtctgatgtcacccaggactgaatacaacacaacatgttatcaagtggtaagtatgattggccataccatatttggttgctttgatgacacttttgaacgaaaacgaaatattgagggacttggatgggcacattggaacctcaaggactaaactcataattttcagggaccaaacaggctattttgccctttatttgtctaatacagttttatattttacaggcttgcattgaggattcgattagtagactgatatatggctcaaatttcgatgacctaacgtagcatcttgtcaagaggtaagtatgattggccataccgtgtatttggttgctcttatgacacttttgaacgaaaacgaaacattgagggacttggatgggtatattggaacctcaaggactaaactcataatttttagggaccaaacatgctattttgccctttgtttgtctaatactgtttttcgtatttgtctaatacagttttatgttttacaggtttgtattgagcactcgattagtagatcgacaaatggctcaagactcgatagacctaacgtccctgatatcagacactgaccatgatactgacaactctaaccatcccacgaatccacattcattgttcgcctattgttgacacttgtcacttgagaagtgaatttggtttaatacgacaaattttttttgaactgaatcaacagggggggggagtccccacctgaattaaatttaaaaagataactgtacaacaaacgacaacagaagaaagtaggagagaagcaacagactaggaaggtaacagattaagaacacaattacaacagtgtaagaggggatgagagaatggaggtccaaagcggcaggacggacttctgcgaaggattgaaccggtgagcccatagttttgcatcttgtaggcatgaatttatcagccgactgatggaaggtggaaggttctgaaagacgacttcattgcgatggttccaaagccgccagcaacataggagaaaaaaggtagaactcagaaatgtcggtaggggccctgagagttccaggttgtggagatctgatagcgagcttatctcagggatgatttgaatcatattccagaaggctgctgccatggggcatcttaagaaaatatgatatgtgtcttctaggttggcattgcatagttcacatgtaggagtagggaggattgtcttcttatgtaggttaactctggttggcaatctattcttggacatcagccaagcaaaaaattttactcttgggggggctgcacttctccaaattgcagaccaaggcggccaggtttcaaatgttgccatttcagaccggtagagctccgaggaggagatgagaccattctttgtcttgagattgcacactatttcatcaggctcagtggagagggtgacattttgcagcaagtactgaagttgcatcatttgctgttgggcagtaggagtgattctggggacaaagaagcatctgaaatcttcatgaaggactgagctgagcaaacagtttagtttgacagtgtgggtataaagagcttggaatttagcggataactgtccatccagccaaacatcatgccagaagtttatatgccggccatcacctggtaacatctttgtatgtttgcgtagaagaggcagtaaggcgatcagggatcgccagtgcgggccgaggtcaattgatccaagtgggtagttttgatgttctttcgagatccaggatgcccagggggagggctgggtgaaaagcctgtgtagcatttttacgaggagggcggtgttttgtgtctgcaagtgctttatgcctaggcctccttgcttcttagatcgacagacttgatcccaggctatgaggcatttagaaccatggtaggactcttctccagtccacaggaaacttcttcgacgcctgtcaatcgcttcgattgtgccttttggaagggggaaagcagccatggcgtaagtcgggagcgagtcaaggactgagttcaccaggactgatcttcctgcatagtttagaagagatgcttgccaccatgcaagatatatatcggtatcatacatataagtgttctaactagttttgacgacattgaagcatgtatcctgcttcggttttgtgacggttcatatacaatttttttagtactttatttgtgttctgcctttgcttattaaaatctttccatttcctcacatctttgtggaaacgtatatagtgctgatgtttaaagtataaagcatggcatttgaaagagtgacaaagaatgaacgacattgataaagggtaaagacaaactgaaccttaattgagtcgacaaaacctgatttaataacttttctacctaaaaacagctccgggagaaataccgtcttaaatccatcattctctatcgctgccttctttttttaagagaatattttattgcttgccttatacctttttttctgcttattgcaagtttaactaacattagtaacatccagtttgtacatgcttaccgaaaatggaatttcattgtatctaacttacagtacaaaaggcaaggcgaggacagtagattgtttactagtactaggtactatcagatagatcataaacatcctactatcaaataccgcagtcataggatggatcagctgcttgagttttcacgagcccgtttcaaacaagtacatgttcctatgcaaacagctaccggtccttagcgaataaaagttcgtacctaaactattaatcaagaaaatagtactgcaatagtctattacctgatagcaatcgcaattttcaaatattttatatgtacttatacagtttcaaatttgaaatttaaattattctggccagtatcagaatgccagccagcggctccagggcggcctggtatttttatccctggtcacgaactcacgaaatcacgatcatataatcaaattggtcatgctaaaatgaattattgaaggaacatgtaacgttataaaatcccattttcattaagtagatcacatctggcaatccccatggtgaatttgatttatacatcgaacttataatatccccctaattctatatcaccagacaaggaaaatgtttctcattcttgtcccaaaaacatgaacttaagtactttcatcaggccaccgttggttgttagtattgtataaaacattgcttccaggtagcgtgcgggatgctttacaccaatgtattcgtagaacacagcgcaggaatacacatggagtgcaaagtacctgtatcaacagataattgttttaaacgtataaacaaatcatggtaccaaatgttccaaagcaaaaattagtatacaacagaaagcaaaaatcaaatttattcaattaagcacgtgcactactgatccttttattggaaccctaaaaatgttcatctttgtgccattgctagtaacaaacggcgtgttgaaattattttgcgcaagatttgccaccatattcagctcttacccatttccttgtgctatagctgatccattggaacacagatgccacagtaattttggagagcatcgaaaactttggagacatatgtggtaaccctgtttcactattgtcatatactccctccgtcccataatataagggattttgagtttttgcttgtaacgtttaatcactcgtcttattcaaaaaaatttgaaattattatttattttatttgtgacttactttattatctacagtactttaagcacaactttttattttttatatttgcaaaaaaaaaattgaataagacgagcggccaaacggtgcaaacaaaaactcaaaatcccttatattgtgggacggagggagtactttgggtttgaagtgtttgttaacaactatgttaatatctggtaaaggttccttcttgtattcaagttttgccttctagctggatactgtaagttgtagccagcttggtccacacaaatggctacttttgatacagagttctgtgattttatgttggttatgtatttccaagagttcctgtacagcaaaccttgaaaactgtacaaattttaaagaaaatgacttcccatctatttaattagaccatcaattttaacaacgcctttacatgttggtgacctggtggtaatctcacatgacaagagttagttttaggctcaaaagttaaagcaacaaatcaacaatctaatagtatagggatttgattcacaaaatgggacagtttgagcctataggctatagcacggtattgccaaaataagatgagaagacgtgtgcacaccacacgagctatacacaaatatattagcaaaggctatcgaagagaagaataaaagtgtaaaagaatgtgtgcaagggtcttttcagcataaaaaaataataagaacattatattagactgaattaatcatgttctggcttccaaagctacacaagtgaaattcatacatatcatttcagattttgaagcttaacgaagaggtcttcatgcaattctgtgaaaactagccactgaacacttacataagaggcagtgggcaggcagactgccttcaattgttttatgcaatctacttgccacataatgtttttactcatgttccaatttctaaagcaatgtgagtcaatagagagctatttttctctcggacgcgtcattagagaactatggacttcctaattcctatgttatttttctaagtagaagggtaaacagtactcccctaaactatttcacttattttccttttgtttcctatacaaatgacgtttccagtcaagattttgtaagataatagatgtcaacataatctatgctacaaatattttaatgacaatttacgcccatttttatatccaaaggtttaatgaatcttaggttcttccaacctacacaattaggccttgtttgttttggaggggattgagggggaataatttcataccacaataggtgtggaatatatctcctctaatccctccctggggattaaccgaacatgccctagtgattttcagtgcatactaccatcctttgatgattttttttcttttcttagattaagggacgaatcaacatgagagtgctataaattgatgcataacctaagggctccgttggaacacaggattttgaccagaattagttcatttactgtaaaatccctcccaaaatcctcagatccatatgaggaatatatataaaatgacattaacattgttgttggaactttcaactactaaagcaacttgacaaatgtgtcaggtatctgagagcttcaatcctaaataagaaatatcgtataaaactagatatttttaacatatcaaactagataatgaagttccttccacaatgcgcaaaaactatgtaatggtttccacttacagaatgcagataaatcatgcgtaaaaggatttctgtcgcaaataatgataaggaaaagttaaccatgcatgaaacattggaagaacttaccagatcaactgtgtgaagtagaagcaagagtcctattagaaggggggaaggatcatttagtaaaattattgaaagaatccatcaaaagagctcatgcgaaagaatggagcctaggcgtacttctttttcagcaaaaaaaaaagtaccttaataggattgttagcccagaacaacaaaagcataataactgcatttcaaagaaaactatgtaagatgagtgtgttcgaatagctgtttgcgatactaaaacatgtagccagcaaaaaataaactcagtatatggaaaactcaaaacaaagtaggacagcactgaaaggtttgcctttgcctcatcagttaaagctaaactagtaaattcgctttgactaatacaaacgtgcattgccatgtacccataacccaataaacagatggatgctagttcataatttatggtcacagttagtatcgcgtttcagattgtttggtgctatgaacactaatgtgtagaaacaatttcggactcaccaaactgtatcctagcacaaatgttgtttgctttcccatttcttttcagctccgctgctaaaacactcatcctgtagcatacatatccgagaacaaaatccacgcaaaggccaggcgccagtttgtggaactgacaaatacgaatcacgagaactaataaacctgcacagatacatgacatgttcagtaactgctatatacatgcacagtagttttttttttcttttctgagggacgcaagatgcatacctgacgttatgcccgcgtggaagcagcgacagcggaagacgttgccattagtggccttaatttcctgaaaggcagtcaggatgggccggagaggttcttcgaccagggcgttccatatagcctccagttcctcctggccatgtcccgtcggctcgattagatcgtcaggagtcagtggcgtcgtccaccacttggactcgggaggagcacaacacaagcgcaagcgcaagcttcttccttggctgccattgggtaaactgagggcgcgccgctttccttccctgctcccggagaagcagaggggggcgccattggcccctctccgcatagtagttgtgaagctgcgagtggcgccactcttgaaggactgtgttgaggacatggttagattcctacggctttccttggaccggcgtgccggcgaacacccggccttggggcggctaagaggttatgcggcggcggtggttccgggattcttatggcgagagtgactgagccggcggcggagggaggagaggtggcgcgccgaattgggctcgacgcgacggacaagaggaagggattcgcgcggcggagagggggatccaggcgcgcggccgcctgccgcggcgcggagtggggagggcagaggggacgaggggaacgagtttaataccagactagccgtgccccccccccccacgcgttgcgcgggcattagatataacctttaatcagaagaattaaatagaacatgaacaggtggacatgttttacaacagcggagcacgtaactcatattgcatatgttttacagtatgtactaaattatccattaacaaaataaaatagaaatcaaggttgatggctatgatcctaaaatacacaagcagttcatttagttgattggtttaactcctttagcttgggctactatccaaatgaaagaggtgaatgtggacataaggcttgctgatgaaaatatccatttgctcaaaatctttgggtgtctaaggagggtttccttttggaaattgtagaggtgatacaacataagcacatgatagactcattgttggctagagtatctgccaatcacaactatatatcaacatcagtaaaaggtgcacagttaatttgaagccatcattgtgggggataataatataaatctgagagaataaaagatgcacaatgtatttgaagtcatcatatttgaaggacatctcagcaaatttacatattaagattaataagaaaacaactatgaacacatcacttcatagtagtctagaagaaaattaaggtgcatacactgagtaaaaatgcttcctaaattgtgagaacaatttcaggaccaaatcaagctaaaggtaacatacaactcaagttggttgcgatgtgatctctgcaaacaataaggagataacaacttcagactttctgttggcctaggctacctgcaatagctaactttaagttcttctcaattgaaccatttgggcaaaacgattgaatatttaacaactcctatgagaccttatattactggccgtatgggaaaactaaaatcaagtaaaatcagtgtgcatttttttagtacctaaccaataatgcatataatacctgtagactatgtccgtcaagcatttcttcaagtaatgagtatatctacatatgacatacgcaagcatatatagtaggtcaatgtttggttaatttaccttgtatttcgaagaggcggccaatttctaaaccatgatcaagatcaaacattttgcttgtaaggttgtaaagaaaatgaaagctactaaaatatttaaataaaaaggagaagaacactgggtatcttttttctagtagtaaattgagttgctcgtagagtcactggactatatatgtaccaaaatatatctgcaaacatgattacatgaggcaagggtgtacaatatgcatctaagcgtatgggatgatggtataagaaaaatagcttgtaagcaatacaatacagcagcagacaagtgaatttgacaaactttgatggagataggaaaccactcttcatcaagtttactttacaagctgtccgtgcatttcctgcgtatggaacaatagccatgtaaattatcaattgtagagtaaaagggaggcaaaacaaatccatcggataaaaaaatttaaaatgtaaatagaaggaatcatacctgtataatgaaagaggatcacaattaatatcacagagcatctgtaatatagaattagtaagaatagctaatcaggttgtactggtcgaaaaagaattaaaacaataacatgagcatttgtaatatagaaacctataaagggtgaaggagatgtaacaatgtaaaatacctttgatagctttgataataataactgcatgcaacacccactaaaagtacggtctaacattgttaatgttttgataggatactctgcatagagatcaattatagaacacatctcaacaaatatggatttagaatataacatgtgaatataaataactctgatggggtgacatacatatagttcttatgtagctaaaaatagggaagcaacctaggtaagttgaaaatgtgaggcgactgatagagaggattttgacattgaactcgtaaatcccttccctaagaaatgtgccatcacttaccatataccttttgcttgtctgatgcaccctgcagccatttttatgatcatatatagacataaaaggctaatgaattatcttcagtcacttattgattgtactctgagataccggccgatcaatgtagtaaacatttacccaatcaagttaattaacatgaaaagcaatgcagaatgggtatctacatccaagtggtgtatgcgtatttgcaggaaaaggtagtaattagcaaatagacatactcacatacatatgtgatcctttcgtttgtgcttccaagcaggcctgcacatcaaaaaaaaagttctgaatcaacggaatatggccttctaacagggaaatttcagaagcataatgcaggtaaggcatttgtaacctcatatgttcagacttgattgaccatgccccccagaaaaatcaagtagaggtttcccccagttatgtaaggttgataagaagagagcatgagatgtaggcctgtaaagagaactgagaaatcaatttgaggagtcatatcagcaggaggagatttggctgtggccacccatgtgaagtttcccctgttggttaccgcgtgcttgtaggcgctcgatgcggcacagatcttgcagaaccaagctcgcgtgggatggagaaggagacgaaatgacggcgacagtggacatcgaactcgcaagaaggtggcggcagctgcctctggctcgctgggaagacagcgacggtaaccactggctccacaagacgtcagcgacggctg

SEQ ID NO: 21274 - DNA, 1936 bp, Oryza sativa
atctgataccggcccatttaaaacaagcaagggtgcatgggccctcatgaatacggtccaaaatttgtgtccaactaaccatatctccagtgtaacctattcactgccgagttagatagacgcgtttatttagtttaattaaggcaaattatggatattttgaaattcaatcccgatcaattcagtcagaaaatcgtactatttgagtggcttgggtagtctatggcggtgcagcccactaaacgagtccgagtcggactggcccgttcaaccgatataagcggacggcccatctggccatctcttgtgagatcaatcgccgatccgccactctcccaagtcccaaccacgacgatggcggcggtgcagctccttccccttcctcccgccgcccctcctcagccgcgccgcggcaaacctggttgctggaacacgccgccagcgccgccgaaggtttgccactactggaagtccggcaggtgcagccggaacccctgccgattcctccacaccgacgcgcctgatccggcgccgccgatcgccgccgtcaacacgcgcagcaacacgtgggtcaacccgtcctgcgtcgccgcgaattcggatggcaagggtagggctcctccggttcagccggcgaagcggcaggttgaggcgccgccggaaacgcctgccaagcgccgatgcggcggcggcgcgtggtgcgtcggcgacggcttctgcggcgtcgcgcggctcaagggtcacgccaaggcggtcaccggcttcgcgctgccggaagggtcggacaagctgttctccggcagcctggacagcacggtgcgcgcctgggactgcagcaccgggcagtgcgtccgcgtcgaggagatgcaagaaggggaggtgcacaagctgatcgccatgggcccgtggtcctcgccggcgtgcgcggcgccgtcaaggcgatccacacggggccggcaaagagcttcgggttgggagggcccgcgtctcagatctcccccatgctagccgaggacgaggaccccctcttcgccggcgcggaggacggtgccgtgttcattgtggaggatgaaccaagaacagcaatcgttcgacgaggtctccgcgctctccggccactacaaggccgtcgtgtcgctcgcgcagagcaagggcgcgctctactccggctcaacagacggcagcatcagggtctgggacctcgacacccaccgctgcatctacagcttcgccggccactcgtcgacggtcaccgcattgctctgctgggagcggttcttgctctcctcgtccgacgatggcaccgtgaaggtctggcagtggaagcctgatcacgacgacctcgacctcgaggtgcactacacccacaaggaagacgaacgggtcgtttccatggacggaacgtacgacgccgacgagaagcccgtgctgcttgtctcccgcggcgatggcgttgtccgtgtctacgatctcccgtcgctgaagaagagaggggatattatctgcgacgacgaggtcaggacgatatccgtcaggtcgcgcggcgtcgtcttcaccggagatgcgtccggcgaggtcagagtggtgaagtggacatcactgagtgatgcagcagagtcttatttagctatggcctgaattagttttgatttaagagaaccatcagccaatttttgctttgtggtcttgtgattcagtactccgatgtatgtagtgtacacaacgttgtaaacagtggaaccgctacgcggcttgtgaatactactccctccgttttgtaacggtgtgaggctcaaggttaaatctgaatgaatttttagttcagatctgcctgtttgtaattattaatgttttgatttaagagaaccatcagggagttttgctccttgtttctaatccaatgcatggataataatataacagtgcaagacaggaa

SEQ ID NO: 21275 - DNA, 770 bp, Oryza sativa
tcatcacgatactcatagtggcctgagtgagtctggaaggctgtcttgggcttcttttcaaggtgcaaccctaatttgggaataccctgccttaaaatcaagttaaaaaaaatacttagctccaaaaagctcatccagaagctcatcaatgacaggcaaagggtattttcccttaattgtaattgcattcaggtgcttatagtctatgcaaagtctccaggtgccatctttctttttgactagcagtgctggtgatgaaaaagcactattgctgttttgtatgactccagactgaagcatttcagttacttgacgctcaatttcatccttgagtgctggggtatgcctatagggtctgaggttgactggacttgctccttccatcaccctaggtcgacggcgacgacgaaaaaggcggccggagcgaaggaaggcggcggcgcggctcgggtcgacggggtcgacggcgttccggcggtcggcgaccgaaacggaggggtggacgaggtcggcgaggatgcggcgaagccgaaggaggcggcgccgaggtgggaggtggtccggggcgacgacggcggcggaccggagctcgacggcgacggcgaagagagagagcgacggcgcgagctcgattccggcgaggaggaaaggcggcgagaggcggaaacggacggaggaggtgcagggagggtttaaatagagcccggtcgagagagggtggccggggaagggaggaaaccggcgcgggaggtcccgccgccatcaatggc

SEQ ID NO: 21276 - DNA, 996 bp, Oryza sativa
atcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 21277 - DNA, 5909 bp, Oryza sativa
  unsure (1)..(5909): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctattagctatataagtgtaagctagcacgggtgcttgaccaactttgttccccagtctaatgcttaatctttctagcatgtcaacgtcagctaaatttatggttaattaatgttgtcagattcattttatgacatctttcccctctctgtttacctaggagtatatcattggtgtcaagagatagaaatttaaatcaggaagctaaaaatattaatgtttatgctgcttattttgccatccaattaaaaattaaaaattcaaattattggtttgcaaatgaaataacgatattgatttgggattgtattgtggatcagtttggaagctttgagtctggtttcttaatgttgcaatggcccaaattaaaatagagtaggtccggtacaaccagtgatggccctgaaatctacatgacaggacaaggaattttctggtcagatttcatatattgcagtgcaatcatgcacaaggaagaattctttgaagctaaggttgggtgcacaagatgattaatagccgttgatcatgtaatttggtgactcggttgaagagagccacattccatggccactaaattttgcttgacttacggtctaaagataaaatattcttcagacaaagaactcaaaatcccgcgttgatcataagtagtcaccgtctcaaaaaagaaaaaaaaaagttgaggcacactgattaggctcaactccatattataattccacttcttgttggaagatgatgaaaggtgacagcactagctatagtagtagatgataagaaagttacacaacacgaaggtcaagggaggatataagagtattatgtcttgacaagtatctttcataaagttttagattatattatttattttactcaccttgtttcttgatacgattcgccgctagctactcattgctactgtagaatttaagctttgttagttagctttagggaacgtttggtgtgtgacatatgtgagtgtaggttctcatagctgctaaggaaatctgacgtaacacgtaacgcattgatgtgcttaagctcactaattaagttgtagcacccgaatccataattattgcaacattcgtcaaaagttgcggagattaattagttgcaacttcttttactaactacagtgatcatttcaacaaatattaaacagctaaaagaaagccttgatgatgcttcatctatttcttcttatttgctggccgcttgcctcaagcacacaaattctgaactttcttgttccaactacacattaataaaaaaattactaaaagtacaacgatttcagcaaaaaaaaaaaacaagaaatctatttctcgtgtcttaattcttgacttggtctagttttcatcgcaatagatagtgtgctccttatcctaaaaattagtgtgttatttgtcctaatcctaaaaatgatggtgtgagaggagcttgtttaaagtggaggctccacagaagactgaagcaaacacgaccaaagctaccacacattcacactaaacaagtgcgcacgtactccacttgttaatttcagtggtgccggccgcgatgatcgcaacccaaccgataatgcgatgctttacacaagcagattagcgcaaattacgtacaaaagtgtgagttttttaaattccggggaaaagtgtaattttgtttaagcaaactttgtgccccgtctactcgatacatcatcttgtatgtatcatgagcagggtgaacgaattataatagttctcgcctcagtgcaggtgattaacaaaactgtggattaggaggcagattgcatatttgttggagctgtttggtgttagtgcagataagcatttggtggtggcgaagcagcaaaaggaagggaaggagcacaggaaaagagggacatgttcaattcaagaaggttcagagcactgaagaacaaaactcttgaactgagaccctgctgctgcctaacttgttaagagtaatattcagactcttgaactgaaactctgctgcagcctaacttgttaagagtaatattcagaaccttattctgtatgttgtatgtattcgtatcattatattgcaaatggaacaaagggaacatacctcttcagaagccaccgttacaatcatcagaaggtgaacaggccctttcattgcgtacttcgctgaacaggagcagcagcagctactgcgttgggcatataagtacaagaaaatagaccagccataaagtaatgtactgtccccagttagatggggaaactaggagaggattgctcaacatctcgtacaaaaggcctaagagacactccagttgcaactcacaggaacagtgtgtatcatagtcagtgagtgcattgcaaatgatcacatttggtttcatcagagcaagctcatcaaagcggcacagtatgcctagatgctgcataaactggggagtacagctacctacacggggcttgatggacgcaagaagcatggcgggtggtcctgaatcctgatgaatttggggggcaccacgagctacagggagcttgatggatgcaggaagcacggcggttgggttcatggcgccccgagaagccatcgctcagtcaggtatcttgctgcgtgcgctccaaagcagactccgaagcaatgggcctttgaaaactccgtcacaactgcaaaagaaacaggaacattgtgatcatcaatagtatgagctatgtattaggttcctattcatcaaagaacatccctgtcagtacttttttctagaaagagaagggtgcatcgatatattaatgcttcagaacgatgaacctgtttgtatttaggttatctatccagaattcaaatatgaagtatcggagtgataaacgcactatactattgattctgtattggacttgcagcttatttcaaagaaaaatctagaagatggaaacaataaagctgaggcatctatcaatcaattatgtgtgatacggtgggatgtgcaaaacctcaattatttgatgcagatgtttggtaatcaatatgatccaatcactggagattgtgacaacagaggtgcccttttcaccctagtattgtatagtagtgcttgtggaaggactgcagagttactaggattctgtaattcagtgccagttcaccgtacatacataaagtaatgacactaaaatctacgatttccagcttttctacatgcttttcaacacagctacattcaatgaccagggatgctgcataagttctatatacccaatggagggaacatgaatgttactggagtgggagcacaagaaaaaggaacagctaaacaacattgatacaacagtttaaattgtcataaacaaagacgagaattatccgaggaaagaaaatgtgcacttacctctcagtgctacagtatttgaagagagaacagaaatttcaacaaagaatataacagatgacggaaactcccaaacctgcaaaatttgatgatgaacgtgaaaggaaataaaaaagtcaaataaaacttagaaataaatcatcacaaaaatcttctataccatcattgccatgagaaataacttgaagtagcttgaaatgatgacggctaacagaacctccctatacctgagaaatgacaaagtaagcgcaactgttaacccatgacacatttaatgtgaaattctgatatggtttcatcttctacaacagaagtgtactattacagaatccctactggttgcataattccaattgagaatacaccaattcatttgcgcgtaatgaactaccaacaaatgtaattgaaatttccacatcacaggtattcaatgtaccttctaatatcaaaagatagttttaggataaattgcacttccaggaataacatggtcataaatacgatgttccctaacaatgcatcgcccagaacctgaagaataatagacaccggatacattactaaggtaatgagcagcagaaacatagaacttctcaatgcagtcaactttaattaccttgctgcaattgagaatcgctgagaatatgtttatggaagaatccccatcagctatgttgcctcttgaaaaagatattctgacttacatagttaaggggtgcttaagttgaatatatacataaaaaaaaccaaaattgaagatgaacatttataaatagaatggatacatgcatcaagaacaagatgcgtcagaatggacaacaccagtactccctgaaaagaacaaaaatcaggaacataggaaaatgtaactcttgagtcttgacataccccattaaacaaattcaaaatatcagggaataacggctaatggaactaccataaggtgacagaaagttattacaaaaacgttaccaaactatgcagttataacttgaatgaatagaaaactgtgtattccatgggattggctattttaaactattgtcagatggactgacaaggcataaatggctaaagatatcatgtaatacagaacatagacaccaagaatatactaactaacaagcagatctaagacagatgaagctaataattcttgagcagcatgacagacagacaggacagagtacaggtaaaactaggaagaagcattgttgaagaaaacggaagtaaacatcaaaagagctgagcccacctcctttttcattttaactaaaagtagcatgtgaacgagtttgaataccatatgattcccaccttgtcaagtgatgaataaatcctcaacttattaaatagaagatgacgatatgctcttgtcttgtgtagaatcagatcaatcaagattatctacgaaaaaaaagaaagaatagttaaatgctcaactcaatgcatcagttcagcagtaaataaactgcatatgtgatgcaaacaatcggatcacacaagtatggcgagaaattcgatatcatcactgctagattaacgcaccatgaactcgcactcgatgtagggatcagcaacagccttgcaggtatcctgcacaagaacagggcatccaaacttaaacagattacacgcacatgacaaaaaggatttacacatgcccaatcaacaacactagtccctctcttacgcatttcatcaaacggatgttgcccggggagtactgcatgtagagcgtcttcacacgccggccacagccgacgcagcgcggccgctcctcttctccttccttggcgtctcccatcaaagccgaaatgcccaaccccaacaaggaatcgatccctgctgttcaatcgggggacaggcagatgaccacccaaaatagcttaatcaagatagcaaaaagttaaaccgcgcaacgccaggtcaaagcacgggagcggaggcggatctggaacggcgaaaagatcgccggagcacggggggaaacgaacaagaagaggcaacgtcgcgtacctgcggcgagagccccgacaggggaaccgccttacccccgtgcggccgcggcgggtcagggagccgggggcggcgccgccggtcgccgggctgcggctgcggcggcggctggggtggcgtcgcgtcgtcggtgagcttcgccggcgacgagacgagacgaggacacagctctcttctggtggg

SEQ ID NO: 21278 - DNA, 8862 bp, Oryza sativa
cgatctggtcctccgggttcgaattctgggggatcggtgctggtgttggtgttgccgttgcggttgagggatatcgagtagctcgttgtccggtttttgtttttgcgagagcggaggctgtcttatccgtgtgggctctgggaaaattctggggatttggatggatctggtaatccgatggatgatatactgttacaatcattcggagacgttaagggatttatgtgaaaaatgtagcattatgttcatggagagataattgaagatcgttactgttatatcttatgaagggtttgttatcgaagaattcgagtgaaatgttagagagtttctacttggtttcgtgcaacgttaggacagtgcgttattcctgtatgacaatgctgatatggtttgtgcagctgaaaaatggggaggataccgtctctgaaaaatttcaatgccttcccccatgcggaagaccacttactaaagaagacttactctggtgctatcggtatgggagatcctatttcttcatgattttgtcctgtgggtactgatgtttcatttggagatgtttggttgatttgtgcaactatggatatgtttgcagtcacgattttcggactaattataatggttacgttatttgccacgagctcaaattttatcttaccacctatactgttcatcaggtatggttggttgtttccttttcttctatgtctagcatgtgcaactttactgtaattttgcatataagttggttattttgccactcaataacagcttttaatgatatttcattagtaatgggaatatgtatgtaggtgatagctatcctgttttggtctatttaacaaaattgaccagagaatctgtatgatgacagaagggtatcttggagaacttaaccatgattttcattgaattacattattctaattgttttaaatatctactgattgctatttggatatgatgatttttcattccttgcttcggtccttaccaatgccaatttcatgggcctctcatatactccctccatccacaaaagttagacatatttcacatttgagtttttccaagtaagttgttcctatttgtagtctttatatgcattcaagacttgaatcaagagataaattaaatgtttgattagaacccaaagagtcatttaaatactcattggttgcatgcttgcatttactccttgattttgtaacatctaagatgatttaatttctccttggtcttagtgacaaaagtaataggtataacttttgtggatggagggagtatcttactaagaaatcatgacatgagccatcactatctaattgatgctgtctgcagatgtctgtagatctgaaacgaggagaaactctgccaattcatataaatatgtcatttccctctctaccatgtgaaggtcagttattgattaaatgcatccttatcagttcgatatgaggtttcttttcaacgttggtttgcaaggagattatggtttgacctttttcccctggctcttttgtttagtcttgagtgtggatgcaattgacatgtctggcaagcatgaagtggacttgcatacaaatatttggaaggtaccacctgacatgaacactttgttactctgtgacttagtgtatgttctataatagacaaattcagtagttgcactaattatcctcattgcttatgacgcggtaataataaatcccttaattatggataataacacatactcgctatccatggtgcagtcatagtattcatgcacctagaagggaacattttcttttagccgttgactggcagtgcatgccttgctctagtgcaagcagtattcttcatttttacaaaacaaatatattttttcccaacaaaagttgtaccatagtatttttctcaattcagtatctggcactcatataatgtttctaaccttacctcttctgctgaatgcagcttcgcttggataagtatggccatatcattggtacggagtatttaaatgatctagttgagaaggagcatgggactcacaatcatggtatactctgctgcttccataaagataaaactaatgtacactgaactgccatatgaattattgttgtttcagtccctagtgtgtacattgtttccttcttttgctcactgtaaattgcagctcgctagtaatagttgtttgcagttataattgtggtccaattatccaaacaatactttaagtaatatattaaggacacagatctagggaaacccttgagacaacaaattaactaaatctattgacaatatgttatagtcagaatgtcccatttgatgcgccaacatgctttatactgatttagttaaaatgtctgatgtgatggagaaatatgctttatttagaatgttccattaagtacgtagcctggaatgggttcaagcatggaaacagtgtttcttagtaatataatgtttgcctttcttagtatataagttcaagcaaaaaagaaaattgattgcaacaatgtgctatcgagcttgctttggtactttctggaaagatgtaccagccacccaaaaaaaatggttccaataattagctatttagcttgctgtcatggtcaaacattgtctttgctgaaaaattatcattggaaagaattaattctcgtttcgagtaacatatggattgtcatttgggaaggtgggaggagggatggtgatgtagaacttaccatcactgtcattaactcgaatacttttagtagagataaaaaacaatcaaatctagttattttattgggattatctacttaagtaaaaaaaaaccctaccttatcgcttcttaatgtgaaactttccccttgaaaacacagtttagttgacaatctcttggcgcttatttttctatacataataagctagtggtttaacagatcatgaccatgagcatgaagatgaacaaaagaagcaagagcacacctttaatgaagatgcagaaaaaatggttaagagtgtgaaacaagcaatggaaaatggtgaagggtgccgagtaagatatttctctaccagtatcctttaatttatggaatggtattattaaggctattatcatcaggcataccatgtacttgttaaaacattttgctttcaattttcacaggtttatggtgttctagatgtgcagagggttgctggtaacttccatatctcggttcatggtttgaacatttttgttgctgagaaggttattcatctaaaactgcatattttttttacttctgtgcttccatctgtatgctttttgctgtgaaatatgttaatttctttttgtatgaagttgccaggattattgtataagcttctaggttttcagtttatgacagatcatgttcacaagggtttaaaattattcaactaaaaatcccttcagaaactattgaaaccagccagctcctacttcctggtaatgccatattggacaagtgctttgtgcatcttgtacaagacttcctaaaactgtccacaattaggataatgttttaatggtaaacagatgctagtgattacgagagaaggaaaataacacaacctaatgataataataataataagttagccagtaaacaactcaatactcaccagtttggtgcacaccagatcaagctgggattggaacaaaaaaaaggacgtgggaagtatcttcttttggccatcacattatataattgtcagcttatatgaaccacaatattttctttacattggatgtgcttatgtctcttcgatttttatgaaaaatatgcattaaaaagcaaccacctaggtagctaggcggtgcactactgcctaaggcgcctaattgatttattatgccgcataggtggcttgctagccccgtcttatggtgtactacactctggtatgccgcctaactagcacataaaggcctcagtgatttcaacctctttttgtgctacctataaataagtgttttatgcttttatttgtattgttattactctctatgtaaattttcattttcatctgttgtatgtagatttttgatgggtcaagccatgtgaacgtcagtcatatcatccatgatctatcctttggtccaaaatatcctggaattcataatccactggatgagactacaaggatactccatgatacaagtgggaccttcaaatactatatcaaggtgagtttgagtagtcattcatttagtagttcatgtccagacagcaatttgcaagttccaacatggacaaggcttgcgaaagaggatgcaatcatgaaaatagaagttcacatatatgcataattcaaaatcatctatggatccttgtggaaaagaactccatccctcctccaacttttttgtccttttgctacaaacctatgtaaatcgttctttggagctgtttcaccatcagatcagatggaaatccatcacattatttgtttgagaagaagtgtcctcatctgttgtaattgatatgcagattgttccaaccgagtacagatacctctcaaagcaggtgttgccaacaaatcagttttctgtcaccgagtattttgttcctaaacgcgctactgataggtccgcgtggccaggtaactctcccttcactacaagcgtggtatattcatctgtttccaggactaatatgttttccttctgcagctgtgtacttcttgtatgatctctcaccaattacagtcacaatcaaagaagaaagaaggaacttcctgcatttcctcacccgactatgtgcagttcttggcggtacctttgcaatgacaggtatgcctccacagcctacaagaatgtgtgttttaaaagcatgctggtgttagggattggcgtcagtagcaatagttcattggtaatctcatatgcatgattttagagtgttattttttttaaaaaaaaagggagtaataataacaatttcactctaaaactgataccaattctgtcatcctacgatacaggaatgcttgaccgatggatgtaccggcttattgagtctgtcacaaaatcaaagaccagaagcgtactacggtaattgcgcatcacatgataagtggaggcaaactgtgacaaccctgtgtgttgtcactggtcatacaaatcagtcagagcatatcgtctcagatacggtcaaccccagtgggttttcatgttttgatatgctctatggctcgattgcttaaaatacttatgttgttagctttgtcattaatcactcatgttagactggcacggactcataacagttttgtaatcaatgattcccacaaatcggaggtgccaacgtcgtgtgatcatggagaaacaaatcccagtatagcctgataattccaaaaaagcagaaaaaaaatcaacatataaaactttgatactcttgcatcacggaccaactgaacgtttgtttcgtagacaaattgttagtcaagtatatttttaattccggtttatagaattaggttaatgatatttcagaatgttacgttacaaccttgaactcctgagtttataaaccttgttgggcaaacaaaaatacacaagcacgacatgcaactaaaacttgcaacatccaacatggaccaaagtttctcgttatacaggtaatctagctatacagttagttggcaatatgagttttgaaagatgaaaacagttacatagtggatgattacaaaacgtgtatctggctaaacaaagatgcgcctatcccgtctacccaaagacctgaacagtgtaatctgtacattaccaggccactggctgataattattctctacagaatgtcgttctgagtttctggcttgtacgtataactgcatgacctacaaacactacatggagctattttctgaacgtgtatatatatagctgcatatcagaaggtgagtgctacttcagctggttcgaaatacgcatcaacaatcaacatcctatgatatcgataattcagtctgagaatcctccacttgatctacaactggagcttcacatggctaattggttatgcacatgagcggatgagccaggatatcagtgtgtcagttgtaccctcctggcagtaggtcctcatgagtctactcttgagcatgcctgcactatttgtattcatcattcaatacccaacactggaaaattcaccacaattcatacataactataatatgaatataaacctatacggaaaatcatattgaaaatttgaagtcgatgatgattgcaaggatgacaggtgctgcaaagatttcttttaaagaaatgctattaatcaaaggctgcagttcacagttgagaaactcaaactactaattaaaaacatatttcttgttgtctcacctagttgccctttttatgctgtcgtatcatctttgttctgattacttctcaaacctgcaacaagcttgcatgtcttcaagaaagcatctagcaactgcatacagagcactcatattattactcagttgttgccactattaaactggtcattgcaggatacatcaatccaagcatgcaaactctttgcaaactaggagtactggagatcgaatgctctaagcagcatttatatcaggatataaaacacttaccccaggatattgctgtaatgtaggggagtagcgatcaagagttacatatatcttctgaagaaggtttaaatgtgaattaaccttgtcgcccaaaatgacaacctgaatcacatcggaaatatttcaacgttgtctctttgaatttatagcgatatatcacagttgtagtcaaacaaagcttaattaatcaatgaagtattccgtgtgaagaacagtctgaggtttacgcccaaaaaaggaaaaactgaggtgcgacttaagttgagattaggagttgttggatcatgataggatatgaggtgtttgtcgttagtccttaccagtactaaataagcctatgggctgtatttatgtatcagtttgtcaagaagaaactcactagaggaagcccctttaatggtatttccacaaatcttcaagttctcaaaggggagttagaatatacccttgatttgtgctttaaatttggtgtaatttccaaagggaaattggacaggcaaaaacaaagaattaccttggcttcagccttctggagctcagaacgccttgtttctagcatttgtttgtaccaaaggcctatttttgttagtacaacggcttgtctgaccatgtggttgcaatgatcactcaaatcctctgacctgaaagcaacaataatcgcatcgagttataatggagcatattcttaaaaaaaaaaggacagcagaagttgcaggtcaggttttggtaagagccaggctgcagttttcacaagcaacaagcgacaacatatacacttctaaatcaatcctatatgatgtattaaagatactaacaaaaccttgtgttgatatgctgtagatgatatttgatatgccaaattggatttatatttttcaagtagtaagtcgatgcaattacagaaaaaacaagtggaaaggaagatagacaaacctgcttgcacttctttctactgataatttttgctcgatctccacaaattcctttgacaacttcataatagatattaaaatgcactccagttgcttttcttgctcatttttggtgaaaataccattataatcgatatttttattttcaacttccttcaatgcagctgaagcaatttctaaacttgagttaagtttgacaagttcatcatattgcatatcttgcttgggagtctcatgtgatcttcttggtgatatgtgaggcgccacctctatatcacgcaaaatgatctctgtactctcttgcttgatgacttctggatcttcctgtttatcttggatcaaacattgctctaactctgctattttttcttttaacattcggttttcttcatttgacaaacacaaagccttctccttttcagatatcatagcttcaagagaagacagttctgtactaaaattcgttgcagcatcatgcatgctgttcatagaatcatcaagcaactttcttgtaatagtttgatacactccatccctaacaccggcttcgatttggagatcctcatattcttctttaattttggcaatttgtctcaggagatcgtcttctgatgacaactgaatagacatttctttactggcttcagatagctgagatgataattccttgacatccttcatattatctgcaagcaaacctctaagatgctgattttcgtaatataaagaatcgattctttttgctgatatgcatctttcatccagtccatcattagtcatgcaaagtgaaggcatctttatgttcttcgaaatgatttggtccattctagaaataatctgtggaattttctttcttaacggctcaaattccacatcattcttgagagtaagcaatcccttctcccgtttgaatttgaagagctcctcggtcttctcctgcaaatccaattcatgcatcctcttcaatttgctcatttcggacttaaaataagttatgatctcctctttactcataccattcaggtgacggaagtcagatttttccaagacaaccatggacttctgtttcctgaaactcttattttcctccgcgcgagatgaatgatcctccttgtttttctttccaaagatgttgtacttccacctattgctcctgttgcttgaagtttcatgcttgctgtgagaaatatgtgattcttgtagtgagggcaacaatagcttagaaagagcacccagatcatcgcgcatgctggcaaattgagctatggcatcctgccaatttttactcatggagtttgtcatagaaatttgctcatacag

SEQ ID NO: 21279 - DNA, 2217 bp, Oryza sativa
tttgctgggaggaaatatgcgcaagatcacctccggttttcgtcagtaacagctcatacaccgtgaccagctttaccctggtgcgatccataacccgcaccctgcattctgaacattctatcttcacctatttctccaactgatcattcgaccaactgaattctgtttcttaggtgtttgagttcaacaaaggcacacttcagaacctgtactggaaagccaacggctgctctgcttgctccgggcaaccctccttcacctgcgtcgatcagaactgcgcgatcagcacggcgaactgcacgggcaagggcggcagcgtggattgcagccccgggattcagctcgccttctccggcactgacaagcacgaagccgtcctcaactcgtggtatgaggtgtccaagctccggcagtactccctggttgggctcttctccaacctcaaggactcactcaccagccagttcagcatcttcttctagctccagcatgttcttctagctttttcgagctcgcatttctcttcggccatcttggtgtatatgtcagtttcgtgttaaggtaataatgttatctatttatatatagtccagtggttgctgtttgtaaagaaaaaaaagacgacaaattttgtaaatcagctctctgtgtatgtacctggttttatatgagacgatatatcagttagggcgtgttctaacggaatgattggacttcttagctacaattacttgtaaggatgaactaaatattttatagtactcccttcgttttttaatagatgacaccgttaacttttggcatgttatttaaccgtttgttttattaaaaagaattatataaatgtcatttattttgttgtgatttgttttattatgaaagaactttaagtatgttttatactttaacatgtttatactatttattttgaataagacgaattgttaaacgttattctaaaaggcatcaacattatctcttataaatttgtgcgttcgcgaaaaaattatctcttatataaaacggagttagtataatgctaaaaaaatagctagaacaagttgtataagcaatgctgatgcagaattttctctgagaaaatcgtttgagcataacacaaataatccatatctttcataagttcttttagaacacgccttaaattttcgcctatgactttactgcttttctggagaatgaattgcatcgcacatagtcgaatgctcgaataaaaggataaaatgcagtttcaaatgcaatgatatttagaagaatcagatatgtataataatcaagacgatcaactaatcatacagaagtaattacaatcacgaaagaaaaaacccgacaaaaaaatagaaatctctcactatgaagtatgaactcaacatggactatcatacgaccatcatgccgttggcggcggcggcgacggcgtcgccggcgccggcgagctgctgctgctcttgttgttgttgacgaacttgagcacgatggggaggacgacgacgaggatgaggacgagcaggatgatgatggcgatgcaggtccacttgcgggtgctcttctgatgcttccgcgccaccaccagctgctcgcggccgcggtcgacgaaggagcgcgcgcggccgacatgggtctcgatgtcgtcgagctgctccccctgcgccgccaccagcacggccatgtcgttgaacacctggtggagctcgagcagcgagcgttccagctccgccacggcgccgtgccgctcctggatctcggcgaccacgccgagcacctcgccgcggccctgctcggcgatcgcgcgctgcaggaaccgctccccttccccggtctcggcgaggttgtcgagcgtcgcctcgtcgggctgctcgccggtgacggtgtagtaccgccgcgccacggtctcccggtactcggaggagatgcgggcgcggagggaggagaaggattccatggagtcgcggagcttcttgcggaggccggcgacgacggaggtgcgggtgcggtcggtggaggagcccgggccgcacccggggacggagcggttggcggcgttggcgcggtcgagcgactcgaggcggagcttcaccaccttggccttcttgatggcggcggcgacgtcggcgtccatgcgcgcccgcagcgcgcgcaccgccgccgcgtcgtgcagcgacttgcccccctcgttggcgtcgtggagcgaccgctgga

SEQ ID NO: 21280 - DNA, 20292 bp, Oryza sativa
gtctcgtctcgttcacgcgaggatggagttgaaatggcgacgtgaggtggcgcgggggggagggattgggaaggtgggaggaaggagggagatgagatggccgcggcgcgggcgggtggcgtcgcgactcgcgagcgccgcccagtccaggcctccctcgtgtgcactgcccgcgcggcgcttgatcacgcggtggcgtgtggtggcgcgccgggggcgtccagattgtgctttgtttcaaacctaaccacgcaacctcagaggggccggtgcatttaacttttttttaccactttaaagatgcgataattaagaatttacgtctcacgattttttatatggatccggtgacaaacccttaattaaccatttataagactgacaaatagttaaatatctttctatgaaacggagcacggatttcattttattttgtgaaaaaaaataggtcatgttttgcacaactccagatccacgacatatttgaactttgtacgttacattaaatcataatggtttaaattttaaaattaatttaaaatagaaataaaatgatatatctaaatattagcaatgtaatggttgatttattagatcataaatttgtaaaactagaaattaccggttccgaaaaatcttggaacccgaaccgtataaaaagggccttatgaaagcttatcaggtaactgtaaacttcaaatcatgccaataaatttgtcaagagtaaaaaaaaaaaagctactggtagtattataaaactgctactggagtttgtaagactggagaatggagatgcatggcatcaggatcagccataagccgtaggcgatcattcagctggtcgtttttgaccggatcaaccagagcgagcaagggcacctgtgcatgcaagtgtgcagcttgacttgaccacgacaatataaaaaggacagagaacaaaagaccgaaaataaaaccaagtatgggtgtgtttagttcacgctaaaattagaagtttggttgaaattgaaacgatgtgatggaaaagttgaaagtttatgtgtgcagaaaagttttgatgtgatgaaaaagttaaaagtttgaagaaaaagtttggaagtaaactcggcctatatacataataattccatcagttgcagagttcggtccctttgattcaaaggaaattcataggaattttcttttagaggatttcattcctataggaatttttcctacaaagccctttgaatcaaaggaatgaaccctatgaaatcctataaaattcctatggaatgcctcttcccatataagttttggaggaattttaacaagaggtagaaccttatggaaaaaatccttcgagtctttatctctcctcaaattcctgtgtttttcctgtggtccaattaaacggtcatttctatgtttttcttgtgttttgcaatcctctgttttacacttacattacatttctgttagaatcctatattttttttatttacacttacattacatttctattagaatcctatatttttttattccttcatttttttattcccgtgatttaaaggggcccttcgtttatacaacttgctgggttggtagttggtactggtcgtcatccaccgttggatgtctcagttatcacatgccaaactgccaatcatggatgaaccctcgcaattctgcttgctatgctatgttaccacgctacaaaccaaaccgggtcaggccaacccaaggcggcaacgctgaccgtctcaatcgatcacaaggacgtgaacgtgacgccttttgattgattgccccacctcacatgtactataatactccttttatttttccatttcaatataagaattatgaatataaacgacatgttcagatttataatactaagatataataaatttaaaagctgttacatattataacagagaaagtaacacatttggatgtcgacggcgttgacgtcttatttgtttcgtactactaacttcttttaattttttataaggcgttgctttcttcagcagagggagtactaatgacactattattattgctagtactactcactctgggattaccatagtgatgcgttgatgtgctctctccgttgacctctccttgttttgctttacgagctttgcatgctgttgaggattctagcaactgacgcacatgtgcatgcgcaaatttcacttaaagcacccgcaatggttatctatagactctctataagagatccacgtcagtatatttttctatttgcaagatattaaatgaagagatagagcaaaactatctactaaactagagatagtctatagagaaaaacgagacaatacatgagagagctatagatacccatgtagacatactattgaggtggtttactattaatctagtctattgctgagatgtacatgttttatagagagcaccttactttaccattgcgggtgctcttatccaaccctcatagattgtacagagttgcaaggaacacttcagggggcagcactgaattgcacagacacaacaatatatagaaaattgacggataatatgatttttgcgatataaacgaatgaaaattaactactactacagagttgaaattttgttttagaaaagtatttcaagaaaattttatatagaatttcttttggcatcaaatactccgtttagtagggaaacatgcaaacaaaaatctaaaatctaaataatactccctccgtttcaaaatgtttaacaccgttgactttttaacacatgtttgaccattcgtcttattcaaaaaaaatttctgaaatatgtaaaactatatgtgtacatgaaagtatatttaacaatgaatcaaatgatatgaaaaaaaataaataattacttaaattttttgaataagacgaacggtcaaatatgtgttaaaaaatcaacggtgttaaatattttgaaacggagggagtaataataaaaacaacatggccgatgtaaatgcacggagtcttacctgttcaagcagaggtgaagcataatggaggtacgggtggattttgcattcatggctatgtttagatttaaacttttttcttcaaactttcaacttttccgtcacatcaaatgtttagatacatgcatgaaatattaaatatggacgaaaaaaaatcaattgcacagtttgcatgtaaatcacgagacgaattttttgagcctaattatgccatgatttaacaatgtggtgctacagtaaacatttgctaatgacagattaattaggcttaacagattcatctcacagttaacatacggaatctataatttattttattattagtatacagtttaatactttaaatatgtgtctatatacttacaaaaaattttggcacacgaaaacacagcacaagacaaaaaatctctgcatttggtaggacttccactgcatcagctgaacacgaggatacattttgttggtacaagtacttggctgcaaaaaagctggacttctagaggcaaggctacaagaggctgtcgattcataaatacacaaataaaacaagatgctattttgtcaaaggtacagtcacgattagctgaactacttctggaacgtgcaagagtcacgaacttgcattttccggtttcagcttggagactgttagtagatgaaagtatcaaacaagacaaccgcaaatcattttctattatatagaatcttataaaaacatcacaagataatccggcaaacaaactaagccaatggaaataaaataacttcgtatgatctgggattcaaagcaacactatatgatgaacatcacaattagccaggcaaaactgccgcccttggagcgtctcaagtatctaatttcctcaaaagtacaatatgactgaaaactatggacagatactgcatctgcgagttgtctcaaagttgacaaggatttacaagaacaatgtaagaacctataggctacagcaacaatcggcaaaccaaagcttttgttgtctgcatccttcctagcaccaaaatttcaccgacaatggtatacatctaatcgccagaattacccttgaaaagaacttgtataactgtgctagtattgaaactggaatccatgtatattcattctatactcaaccgtgaacttacaggtacacatcttcaccagtcaccactccactggtttgggttggtcagattgtatatctttacccagcatccaaggaacgagtttcttcatgagaaggttgtctcactgtctcacaccatccttccttgcagttcatcaagcatcctgaagaacagtgacataaaaaggatgcccttggccaccaccggatctttgattttcatccacctgtcctacctcggatgaatgcactttccattgtagctgataattcgaaagattgtatgttccaggcataaatatgcacacttttagaggaactttagtggaagtgtcaggtttcaggtcaacttgagcagaactcaatgaacaccaaacaaaaggtgaaatgctctctgatggctgtttctgataatgtgtccccttggcagtagagatagctttaatgtcattttccagcgatacatcataccatccaccctgattactattagaatcttgcaaattgacagtttggcttttatctggcacgctgtcataggtaactactctcgctgaaatattatgttgcacagtattatgaattaccaactggatgtttgcttcacagtaagactttgagaaatcatgagtaactgttctaggcccttccataaaccaccatataggactctggtcgatagcactgagaaacagcagatggtatcagcacattaaagtccagagcccaacagaatttgtcgtaacaaaggttctacaatctagcacttacctgcaatggcacacatgatgagagagtagttgaacgtctggatctgacttggaatagttaccacctactgctttcgagatcagaataaaatcaagaaggtcccgtggtccctggacagtgatggcaccaatatatatgtcatcatttgactaagtgatggtaaactgtatgaaaacaaaaacatatgcatccaatttctcatcatttttcgagccaaattttgttgattccaacttgaagattagggtaacaaatccttgacagctggaaaaagtaccaccaagtgggtgcaaatgcctttatagtctttaacagaactcaccttagccaaccttccctgttggtatctctcttgatagtggaaattggtaataggagattgggaaacatcaaactcctcagtattgctgttgccctcacgagataaaaaaagcatatcacttctacaagaactgttttcagcttctttacaagaatttgtacctaaatcctgaaaaaaagagatgcattttaaaaaatataatacagttttaaactctacaatgtaatgggcaaaaaaagaatatatagatttggaagacatggtatgctacaagtattacctttatcttgaagaagcacgacacagactgatttgctgatactgtttcaatagagcggatagaatcgcacaaaggcaacgatgaaattgcccatttactgtcattgcatgacaactgatgaagaataaatgactctgagggagtcctgttcaggatgtccatgcgcacaatatactctttcaatcttgatgagcacattcttatagcaaaggacacattaagtgatggaaaaacctgcagagaattgtttagagataaaaactcacaccagagtaggaaatgctgactataaaaacacagatgctgattaaacaaaaaaagacactcaaaagctaaaaaggaataaacccatcacctcctttcgagtattttaattggtccactccgttgtggagcatgacaaccctgttttacagttagtttcatgcaattaaaaatatttccagttttaaggaatatgttcatttaccaccccctctaccaccttgaactttgctaagaacccacttacaacccttaacaacaaatttaggtgtttaatccaccaaatttgcaacaaatcatgtattatttaaatacaagcacaagtcattacctcaatattgtagtgcatgcgcaatgttctataagttatctcacttgggctctccatttcataatacagagatatataaagagaaaagttcccaggagttgcagcatggaaccaaataggccaggagaacgtggctccttcttgaattttaatatcctggcaagagagtacggtgaatatttgcaaagaaacagagaccatgcatgatttttgcagcatacaagggggcatgcttgaaccaactcacttgagaaaatgtaaagagcaaacccttggcatctccctgagtacgttttgtcgatacagtactaatttctgattgtacatgctttcttaagcattggggaaactcgaaatcaacttctgataaatcaccaggaattacaaatcttggatggctaagcttcatcttaatattctgcacaacaagattgggaattattactacaaaacaagctgctgaaaaattacataaaggacaaaattagtgtaaatgtcatagaacttcaactaaacttagaccatcataaaatccacactttcaataaaaagttctcacaaaaacttgacgtcctttaagaccatcatagaactctcaacaaattatgaccaactaggcccatatgaaagtaacatatggtaacatctgatattattccaactatacggtgactaagacagtttctatgcaggccaagtactgccttgtgaattgtcatcctgatggcatagcaccaaggggactataggctttgggctactccactcatccactgtacctttgccacattaaccagaaggtcatccatggaccatgaacgtgtgtgtggtccatatggcacacagattaccacgtataccttactaatggtctcagtcagaagtctgactagtgtaaattcataaaaaaagtagttttgtggttctgaagaacgtgtagttttctgaaagccttctttgaaagtgtggtttgtggtagttggttcaaattgtgtagtaccattaaatttgctccaaaagttatgctcatttgagcaaacctcgttaaatcatttcaaattactgaaaaagaagggaagagagttgcaaaaatatatagtttggaccttcacagcatattctgactggttcctcagattcagcttgagtagccgtaaatctccagcaaacgcatttgttggcaagtgatcaatacaccccgtaagtttaggtaaaccctggaaataaattaaagttactcacttatctcagaacaaattatgtgaaagagagcactggacaagtccgaaccttgattacaatcagggtgttgctcaaagtacgacgaggtccctttttccctttcttagttttcctttttgtgtcaaattcaaagtattgatagccaactaataaatctgagagcgtccaccttatcccatgtaacttcagaataccttcaacttttggagtaacttcaagttgtacctaatagaattggaaaggaaactggttattataatgcctaccaaaacattatcagctaaattatgtataactacacattagtcaattaagtatcgcctcttgtcattacaggtattattataatttataacatcagacttaataattgaagcaaatgaaaattaaattgaggaaagccacaagtatgaatagtttgaagcaatatcaggccaaaagataaaatgcagatcgtcctgaatggaaatactattggctttacaagagaacttctattatatcttttttggatacaataaccactcggtaaggagtaattgaaacagcaaagaagacaaatgacaaagtgacacataaagctttcctcctttttgtttgatcgcctaatataccattgatcaatatggttacaaatagaaatagttgaaacagtatttgctagcgccaaatcattttaccaagggtagaaattagatttactaggaaaatgggaagcaacctaacagaacttttgtaaggcgataatactgagtaaagtggaatgacaaagaaggcatacacttttagtttcacttcctcctaacacaatgtccagctttgaaactgtgaaattatttccatcatcctcaaatctgtagtgttaaaccagaaacatcatcggtacccatgagaattaaggttgggatccaaagacatacataaataaagcctcaataattagcaaaaaagaaatattacgttgatatcgcaggctttgtgttagctatatcttccccagcacctgtggtcagcacactattgactgcacagtaatgtgatccattaaagaaatcaatgatcaacataattttctggatatggggttcttaagataaaattttagatcagagaaaaaagaagtaccagcacttgaagcatccaaactggtggaaagctgacatattagagagatgcaagaaacaacaacaggaatttgtagaggattcctaagctcaatcctcacttttactgcttctgcaattgacaaaaaagcaataattgaaacactatataagagatgcatccatatttccctctattgtccgttgacgtttctattttgataaataaattattttccttaatcctttaaagtgacttggggcagatcgagtttgaactcatatttggctgcaatcacacaaacctccatttggactgttggatgtgatatggatggatcagattcttctgggtcatgagaaggtaggcctaatctttatactcttttaaaaggagaagctggatgatggcactctctacacctaccactcaactcaagatcatttggggctgcataaatgtagacataagtgttctttgcaatatccatttcttaggaaacattacattctttgcacatgtgcatatgtaattgattgtgccttatgaaatagtgtatctaatttttagttttaatcaatattattgcttgttttaactctacatcatatagcatatatatttgtatctctcgaaagtcgaaatgcatgggcatggatgcttggaattaatatttccaaccgacaaaggggatacgagtcacccaaactagtctgttcatctcatcgagtggtccacgtggaaagcttccacaattacactcaagctgcgctagatatgccccatgagtccattgctaataatgttggatttactttgccattttgctggtttccagctgaaagcagcttaactccaggaaaattcagatgaagttaagttgatccacttaggagcagatttatggatattgaagatgtattacctcccacaacacaaacacaggaatccttgtattttctcaagtcaggagatttttcaagccagttagttctaacaatagatgatgatgggatcatttcttcctccagctcctgccaaatgctttcactaacattaacctgttattgaaggcaacttatacaagttagaattagactgctttaatttctagatcacaaagacagatacatttattgttagagaaacaaaaggagtggttgaatctcatagttattatttaattgtctatcatcagaaatgctcaatacatcgattcattttggtgttcttttatttcagtttcagtagccccacaagaaataagatatattctacaccctccgtcccaaaatataacaaccgagtccaaattttgtcccaaatatagcaacagtacttgtaaaatgtaaattttaccgctaaactacccacagtaccccttggctttattatagtccaacttgtccggacctatacctcaccaatcccaaggagacaaccaagtcttattccccctcgctttaatacccgtgccaaagactaaaaacttgatatattttgggacgaagggagtattagaggaaatatcataaattcaatgtctgattactccggaaaactcaatggtaaataaaatgtctgattactctggaaaactgaatggtaaataaactagatatagtcctacagcagtggaaagtacttacatctgcatctgatgcataagtacgatgatcttcatatataactctgagtgatggcatgttgataacaggaagttgaagcttgtagacatcaaatttcttccccatactctgttggtacaaaacacaagatgaacattgcaatagaagtttggttcaccaaaatgagagcacaaatggagctggtcaagaacctgaacaaaatggaaaaaatcattgaggaacatgctttgcgttgtcagggactgatggctgcaagcaatgacctccagcaagtgctttatggctacatcaaatatcccaaggactccataccacctagtttacagtcaccagagttaataatagtttatagacaagaaaaatatatggataggagctaaaacacacaactaccttccaacattaaaatgtacatgatcattgatataactccaaggatgttgtttgtaaacaaacagagcatttctgtatgcccgaacagcatgttgcttctgcactcaaagattgaattttcagactcaacaaagatataatatacttctaaagcattaattaaatatcacagcagtaaatataattatagtacacctgatcggatatgtaataactatttccagctaacactaggtgaaatccatacttccgaagcataggtggtttagataacacatagcaacaagcggcttgctcaagcagtacagcagaatgcaatgaaggttcctgaacattagaaaattccatcaatgttgtgtaataaactaaaaattcttcctgcaaaaaatatgagtaaaattttatcaatgtatgcttgatgctagatctacctcattagaaacgcggtagtatacacttgatgcctccctatactgtcctcttgttttaagcatttctgcccaccaaatgccacatctagtagcatttctcttcccagaagatccaattctctacaaatatgaatagaataaacgagagcaatatcaagaaagaacagagaagcacgaaggatatcaatcattccaaatttaattaacttcaaaagttgaaattacacataagagtagcattaattatttggaatcatcctgcccctttatagcccttaatcgcaaattatgaattcttcaattcttgatatctagtttcacgcattctttattatatgccacaaagcacacccaactatcagctcccaaaaataatgggaataaaggaagtcatctatcctagagatgccaccaatgacaacttggattagaacagtgctaggtgaagcatggcactaattcgggtaagaacagagcacacaggaatttaatgactggggaactccataaaattaactgagtctactgttgatatcatatgaatgactataaaacaatgcaacagactagcatttgcgcagtaagatcaatgacatatgatcactccttgctaagtcaatgttaatatcaatagtcctgaaaatcagatgcaactgtatttaatagacatggaaaactgcttcatacaaaactaaataggaactccttttctctttgtgtatgacatattggacagtacacagaacacaaatttatatcgatggagctagcatgttaggttacaatttagaaagagaaccatttaatttagtctgagaaactagaagtggacatagagatgaataccagatatgtactaaaggcactgtccaggcaatattcagcatccttccttgactggtccaacatgaaatagcacagtccactcatttcctgcaaaagacacagacattatcatgaagtgactacctacttgaatatttggccactgcactcaagcttgattcagtactcaatcaatcatcaaaacaaattcaggaaccatgtgctttaaatttggaagcatacagtatgattctgatatggtgtacaagtaagaaggtctaaactcgtgtttgaggtgaaaagtatgttaggctgttaacgtagctggtcccaggatattccttaagaatcgccaccttgattgctactttatttcaaactcaacaacactacataagtaatgtcatatgtaaatcaaggcaagaagttaaaacaagtataaagcacctgcacaccagcaaagcgcttccaagctttgtcaagcttataatctgttgagagtaatctataattggacaaagcaagctcatagtcccgtaacatgaaagcatagtcacctagaactctaatctgtgactctatggaggtgaacgtatacctgttgaagaaaaaaaaaagtgttacagcaaactacagaatttttatatagggaaaagggcaagatgtaagtaaccacttgcattgggccatttgcagcttctggaacatcatctctttttctccaccacaagttctttatttgattcctaaagcccttccttgttgtggctacctagaaaaatgcttaatattattattattattattattattttcaaaaacagaatggttaatcttgttgagagaggtaaaaaaaaagtaatggaataaagaaaatacctgctgattgaggacacggatcttttgctccatgtagggaattatatgattagaagccaaatcttgcatgaagtcctttatctgaaaaaaaacggcttatctagtaagtatcttgtatgggttggctctcagaaatcaataattgcatgtgacactggatactacagaggaataactaaagttcattgatctaataccatacatctgcgagaaatattcattttgtattcttagcatcgatacccatgaaaaccttgcatacactgagtaaaaactaccaagtaggctactaatcttcccaacaatacctaccagggaacagatgaatcattaggtgctacaaaatgttggacaatggtttcatgacattcaatatgcccaagaagacggataagcagatgacatgatattcatcaaatggggcaatacctcattcaaatcatccgtgttaagccaacaagctccgtcttggttgtgcaaaccatgagatttctgtagtttagtcaagaaaatactgtaactagattgcatatcggctgcactacgtaaacactaatgcaatttaatctgaagtagttctctgtacttacataaggtaaccatgaattctcagcatctgcaccatctgcttctgtagaagaattaatacacaacaatttacaatcattcaaaccaagagtgctcttcatttccgctaaaatgttcatagctcttcaccaaaagaaaaaagaaggtcagcaaaaaagaaggggaaaattgcatacatgacactgtaaaatgttggcatttggcatatgacattatatcattgtttggctagagaacactataaaactgagagaacatgttcattagtaacaggttgctaggctatgcaagaactaatgtaaacataataactgagtgaagaatatacatctcttgtggtccatcttgttgatcatgaagtataagatagtgcttaagaatctggggatccattatgccttcatttaaaagagaaggtaactgatttgtgttgaagagatcaacaaacttgctgattggttcattgtcctttgatgatacaactaacagacctgttaacaatagtcaaagcatgagcaagaacatatccttaaaaaaaacaccaaataagacgaaagttccaaatctcacatgccacagggtggtcgaatgtttcatgctctgaaaatgagagtgtacgcatcagagctctgttgaatttcttaatccacaaagggcacagttcagcttcaggctctggaatcaagagcaaagaaagaaccatatgtaagatgcaccgaacaaacagcaaacaataatactattatttcagtttcatatcaactctaagacatgacgaaggcaaagaaacactatgtttgtaaccacccaaatatcccttgttatttacactcacagccactgagaaacacatcgcatattcacaccatttacaggaactttgagctatccaaaatataatgcacacgctcgtttggtatgatcactttgtaaagatacttccactaccagcgcaaaattataacctaaaattattctgcaaattaaacaatctgaatagaagattattgctgctcatagtaagtcacagtttgcttctaatgtcaaggtgatcggattacgctactttaagtgatccatagaattccaactacggctccataattttgctcaaagtaaatatgcccacaggtgagaacataacaaaatgaagcagtaagggatctcactgctaagtacatcttctagctgtggtgggtctgaaagcagatctggaagagcactctcattggcctcagaaactactggcttgatcctctgatccgccacctgctccaaaacagccaatgtccatcaagagattcataaaccataggcatccatactgaacaagcccacagcacaacccagaagcttccagaaagttcgagaatcacctcgtagtcctgcttccggacgtcggaagcgtagaccatccgaatcttaaacatctgcagcctgtaaggctggtcactcgccgtccgcacgggcactgcatacaggggattccccatgaggtcacagaacccaatcgaatgaaatgcgacaagcgtcatacacacaattatcggaagcggagagcatcggggaggtgaatcaccgtcgatttttttgaagagggagaacggcgagagcatgtcgacgacgctgaggccgctcttgcggcaggcggcctcggcgagcggggtggtgagcaccatcaccaccggggtgatctcctcgaggaggagcctcccgaggtagctcctgagcggatccatcgcgccaaaaacccaagccggtgtggcaggcgcgcgcgcaggcgaagcgtaatcgcaggagcgcgatctagggcgggtatagaggtattcccccaccttcgccggtgcctgcggcgaagggggtcgccggagaggggtcccccggcgacggggcgaggcggcggtggaagcgggcgccggtggtgatctgatctgggaggaggagggcgcccagagacaggggaggagacggcgactagaggcgtaccgtgtagctggctcgactgcgtctgctcgactgtgtggagggggaggggagactgggcttgggtgggcccgtttaatgggctgcaaacttgaagcccaaagtatgaagcccaattaagcctagtttgggtaggcttaaacatggggatgggctgggctatatctgggcatgtatattgggtggaaaattcgtaaggccgaccatatagctttaaattgttggaattttaaggcatgttcactttgttaccaaattttggcaagatttcttatatagctatcaaaatttgataacaaactaaatgtagccacttttttagcaacattaccaaaatttggtaagattgaaaataacatcaaagtgaacaggtccttacataaactttatcagattttcccgaaattcgattcaactttcacagggttcaagaaaaattcctcgtttcaacgatgtttttttttctggcagggccccaaaacagaccctggcataaaatattggctgttcatcactcatcaggaacacatgtatgcatgatgcatggctgatattatcgaaaattcatttttcttgtatacagaaatgttgcgattgctacagcttccaaggagaaaaaggtcggaaaaacaagaggtagacatattcaattactactttacaatgtctctgacaatgaaatgaagacgacgagctttcatgttatgatggcaagcgctgtcaagccaggtaattgtagatctgggggttactcctgtctctctccaggtactccctgtcgattaggctctctattcttttcttgatatccgatggcttgattgggaacttgagctgaaagaaaagaaaacgatatattttaagatatcaaaattgtggagtgcgcaaaatggaatgcatgcgttgaaaacatgtctaacctgctgaaaaagctcagttattagaagcgtgtggctgagggttttacgtgtcttcattattcgaactatggcagcatccacctgcacggaacaagaaaaggaacttgtggcattactctcccgtgattgaattcatcattagatttgcaccaaaaacattccagaataaatttgtttggaatggtgacgttaaacctaaaagatgcagacattaattaagcaagaaaaatagcatgtaagataacaatatgaactaacaataatgtgttgcttcaatgaataaaaagcatgtgagattagaaactagctaccatgtgctgagtgcaaatagagggtaaaacttctacggcgtcacataagaaccagaggaagcataagcacagcatactagtttagctaacatcttataccaaaaatcgaggataactaaacggggacaagtgtaactagaagtcctcaaaggatgttcttgtttgcaagtttagatggttaatgcacctgatactgtctgtcctggaatactctctcagttgtgcttgtgttttcttcaaccgtctccttcatctgaatagcattcacctggaaacacacagcattaccttagttaagcctgatgacacacccaaactcgacgtacccaccccaccccacacaaattagatgacgaatattacctttatgcgatagagaggggcactaaattcttcattaaatacaaattcgtccttatcttctacgtctcgcccttttggcatctgaaaataaaagtgacaactgaacaagctgctactgaaaattagttagacatttggataaaataaagagccacaccttttggagaacccgaactttaccgcatgcaagtgattgcagcgttcttcgcaattctttatcctcaataccagtcgattccttgatatcgaggaagcttagtttttgtgcatcattgaacaacatcaaaaccacactctgaaaaacagaataaatcagtgattttctaattattgatcagacagttacagctacaataaaccaccaaagaaattgggaaaaataaccctacctgaaatagtgacaccgcaagttcctttttaccttttgggaactctgcttttaatacacagtgacccaatgagttttgccacatcaaacgccttccactatacttgctcaaatagaattctttaaatatatcctatcagaaaaatagaaaactaaattaatttccaggcagttaatataaatatttactgccaacaaacatagttttgagaacatggcctgacctgatagacattaagttcatgggggagtttcacatccattggtggatatgttggccaatagctgcaatgcaacatatttaatcagaaatgcacatttatgatagaaaatatcaagttgcatgttaacatgctcagcaaacgcctattataaagttatataatccattgcccatattccagctacatgtcatggactaagaagcctatctatcagtattaggtttagacaagtgttgtgtaaacagaacatgctactcagtaaaccagcacacatgtaaaaatggcaaggcacatgttacctaccctgttgtaagcacgtgaacactcatttcaatgccagatggaagctttgtccttgcttgagatgattgcttgaaagactcatttatttctttggataattcaatgtcctgagaacagcaccaaagtcattttattttacaagagtattaaatccaaataaaagaaattgatgatatcgtgtacgccaccaatggatagaggcatagagcatatataagttagcaacatttgagctaaatatacatagggcaagagttcgcaaaaaggctagtatactagcaaaagtcatttcttctatagcaaattgctaccttgaacattccctccagcttgttggtaaattgacttccacactcagttttgagctgcaaacagaaaaaaaaaaactcaagtatgtcagcaagttggatggcatgtaaaatattattttaaaccatcagcaaataaataattacctttgttatcattgatttttcagcatctatcgatgcactcttccccagcagcaacctcttagccagatccttcttgtagaatgcctcaaatacatcttttccctgaacataattaagaatattaaccttcttcaatcttttatttgttactacgtatagtaaattttatgtgcattagcttctcccagaagcttcatacagaggactataggtctataggactctataagaatgacatattataaccatgtttgtgaaggaccagacctatagcatcatcttcaatgcaatgcttaaaccatccgcccacatgctcatggaaattgtttttctttaatatgatcaccatatagggagttttactattttatacagttgactagttgaaaaaggaggtgtcccacatgtataactgaaattgaaagaacaagatgctgacaaagaagaaacttagtgatataaaataacctagtgacttacttgtataaatcggaacagaaccaaaactttatccaatattccctccagctcttcttcggaggtacctttatttccagctcgaagtttctcatcaagaaacttcgcaatcaattcagcaggtcgattctgttggaaaaaagggcttgagctgatctttcataaaataaaacatagtacaaagaaagaaaatgcaggataaattacacatctacttaagtacaaaaaagcaactagataacaatgaacatcagaaacaaaatgtattggtaccagcatatctcaaatctaagaattgagctttctgtttatcaagtatcacagccaaactggactgcgataggaaaccaacataaagcaatatgtacaaggacagcacagttcttaaacaaatggccaatatcaacatgtcccagcaagtcaaaaatcaaagaatcaaacagtttagcaggctataaaagggaagactgactgtagtaggaaagcaaattacaaaatattgtgatataagatatgaactcagtacacaagaaaggaaaaaaaatattgtcaagcagaatcataaatatggcctacctggcgtaaattgataagatgttcgaatgactcttttattgtattggagaaagcctcatttttggcaaaactttcctccaatattctatcaagcgatgccttaaattccagaagaaagggcaccagttctttgtccttttcttcatccatgataatgccctggcctgtgccccgaatatatgaactaagtgcttgctttagcaactcaatggcatcaaccctctggaagagtgtgtacatcctcgagaggtcttttacacgatttgcttccataagcattgtgaatccctgaacagtaaaacatcatatgccaggtcatgaatgagacagtggctaaactaaattagtggccaacaaatataatatattgataaagtaaacacctcttttctatatattgatctaatgggtcaactagaaaatgcaccatcacattcttattctggccagataacaaatcctacagttgtaagagcagataatcaccttctcaagaattgcagatgtgtgccgctgcaataattgcttttctgtagctgttataagcggcttcctagtgttagcttccaaatatagaatacacctttcatgttcttcttgcaaccttgtctgaataattcatgtgaaataccaccaattgcataagtatacctgaattttgtgtgaacaaaatgcaaggggaaatacaagaggtttatcaatacctccacatgcttgagatagtctggaatatcagactgctgcaaatatttaacaccttcagtagcataaaattcagatgtacactccagaaagggcttttcaaaactctcagaatacattccaagagcagtaaacatcttcagaagatgactaagtaatgtcctgtctattgcttcaccaagcctgataaggaagagatggttaatgaataatcagttacatagaagaatataaaataaattgacccttcaagtccacaattttaataatttaaaatggacccaatacatacactatgatcgccagctacatcacacaaggtaaatgcaatgacaaaacttttctcaagtaaactgattactctctgatatgtaatggagtataca

SEQ ID NO: 21281 - DNA, 12825 bp, Oryza sativa
cagcctatagtgaagaaaacaagttctaaataactaaagtgggatcatcaaatagaatagaagcaatataaaaattacctggtaaagtttttcaacatcgcacgaaagtttctgttttagaaatatagctgtaatagcatctttcaaaatagcccatgtatcctcctcaaagtttgttggcaattttggctgacctgatacatgaaaaacagatgggatataatgaacaaaacagaaaagggatgcaacaagagacgaattccggggtgggagtaaatctttagttcttgttcggcaaatgggttatgagaggtgggatcgggaaagggaaatgagtgaagggctacaatgaaatggagtggttagaatggatggctaggatgcagtgttgcattttttatgggtggatattatttcccaatctcatttgccaatcacgccaaagggttgcaaaaaatacatccagaagatcccaggggtctattatctaagaaagaacatatggccttctgaattttcttatacaggttactagttagttatggtgggtactgattagtgaatagtgactggtgcagggattattattatatatgactcagaaatgaatagatattaaaggttagagccactgcaacatccattgcacagaaacggattttcagctttctcctgaagactagagaaggtcacatactggagatgcgaagcaaagcttccaataaataccgacagttacacccaataaagagacaaaagagtgtcaacttttaagcaatctagctagaagccagctcatatggtgcaatacgaccaaatggggagcaggaagtcagaagaaccatacaactatgcccaagctcacttgtcaactgcattaaaaaaggcagaaatccttgatgcatattcacgcccaacaaagcaagccaagataaacaagcaattacaaggaattgaacatacatatatatctcaagagaaactagacggattgttgctgacgaaatcattagttaccctagcaattatcaatttcccccaaaatagtccaagtgtctagccaaattcctctttacaaatagacacgccaattagtaaatagaaaacagaagtgtgtgacgaagcgatccatttgacgaaagggctaacgaacaccacctcaatccctccctattattggaatttaagttaacgacgcaagcgggcaagtgaacacactgagaggaacaatagaattcccctcaatttacccccgaaacccctcgatgatgtattctcacatggaaaacgtgcaattacagtgaaagagagggacctattttgattcggaggggcttgcgggcggcggatggctgggggagtgtggccttcttccggaagaggttggcggcgacccccgccggggccgatgcgctcggagcggcgagctcctcctggtcggcgagcaccatctccgcatcctcctcgccgttggtgcgcccaccggtccgggcggcggcggccgtgggatcgacgtggagcccgttcttctcggtgaccccgggggcggcggcggaggaggaggaggaggaggagccggggaacttggccttcttcatgtgcggctgcgcgggggaggtcggggaggaggcggcggcggaggaggaggagaagtggccggggcgcttgggggcggtggcgtgggggtgagacatgaatcagatgccgaagcgcatggcgcggccgcaccggcggcggcggcgaggcccggggtaggatgggtggtaggtggcggcgcgccggggttttgggggtgaggccgccgcacgccggcgaggaggaggtgggggagtggagactagagagagagagatcgggttgggggaggaagggtttccccttttcttttcttttttttcttttttttcctttttctttttcttttttttattttttattaggtgggatttgcgaggccgtagcggcccaaattaagagtgagaatgtgggcctggagttccacgcggcccagtttccttttgttctcattagcccaattctgttgccgccgccttgccctcgccgcctctgccttctgtcgagaactcgagatcgagaattcgagatatccacgcgcagtcagatatggagaactataatcttcatccctttgacgggatcttctttcgtttgttcaaaaaattcatccaaacggttataaaaaaattagcaacacttgtactacatgcctactgtacaacctcacaaaatctcacgtacagactcaactcacgcatcgaaatgttaaaaaaaaaactcaactcacgcatcaaaatgttaaaaaaaaaagacaaattcaggtatgactaatagctattgtttacatctgatcgaatttaaacttaatttttatacccatagacaccgttatgtatgttgttaattccttttagaattttttgtaactatctacattaaatttggaagagagaagagaaagatataaattaagttgtgttcagggattagaatccattcacacgcaaataccctacctgtcttcgtcgtctttctgtctgattcgccggattcgcgatcattgcctcagcctttggtacagggaaggaatgcacccacagaagttacaaaaaggttcaggcagaagaataatacaaaatgaaacccgtccaatttaagcgcacaaaaaaaaaacaattgcattgcatcccatagtcttcacccgtttcctcaccatttctcgctcagcaggcacactgaataagcttggccagaagcgcaaaatatgacaacagatttttcgcgatcaaaattcattgctaaaaaccgtttagcaacacagctgatagatatacccatcagtcacaccctcaagaaaagtgaagcattacaaacatggaagaattgagtggtgaaagcgaaacgtgctcaggttcagtgacaattaaggttcggttgccaatccaacatcgccgtttttttggcgctttgttgaaggttcatcctcttcattcgttgcatctcctccggtttctgtcgttggattatttggctcggccaccttttcatcttcggtgctggcagcaccgttgataacacggttgacaacgtctggacctaacagagaagcatgtttacttgtaatcttccgaccagctctgattttgggaccccaatgacgttctgggttcggaaggaaccgcttgaccttctttgcttgagccctgctgagggcagcagccgctctagagaaatttgcctatgaaaacacaaaggaagttagaatgccatctaactgaaaggcataaaaggactgctgcacgttcaagaaatgcatacttcaagcttgggtgattttgaaaggatcgctgtccctacagagtcatgtggttgttcctttacaggatgattcttcacctgtatgcgaatgtcacaatattagtcagaatactaaaaaaaaacagcatttctagtaaactacccacaatttatactagcaaacacaatatgttaggaaagttatggcaaaaggaataaatgaatgtacccagcagcgcatgatgtcccaaataacatcccaaggggcatcagtttttagtccaagtggattcacatgtgtgctagaaatccgataacccgcatttaggactgcagatcggaacaatactgcagatggagatgtgcatttaacattagcacatatgttgtggagactgaagaacaatgggatgtcatgtaactcctgcatcacaataataacaaaatgaagtttaaagaaaattttaaagagttcgtaaactataaataatttctcaagagtaaatgagtgagccatgacaaacaaatgcagaactagatggccaactaatttattacttgtacatggtttaactaaattactgcacatttgggcaataattttcctgttgaagtgctttacatatctatgttctagtgagaaatggattaccaaaaagtcgtattcctttctgccattatttatttccatcagttgcatgccatgattaacaggtccacatatcgaggttgtattgataaaatggattagcaaaagtcgtattcctagccaccattatttattctcttcagttgcatgcaaatcgtgctttaggtcaatattctaaaaagaaaattatttaatgtgatgttaagaataggcaacagtttcacttcatagcaaatgcaccaaaacaggccattttaacttcatcacaaatgcaccaacaatgacaacttgataaaacacagataacagtcatagcaatacctctgatatggtagtcagaactgaagttatcttatcatatgcaggatatctatccttcattgacttaacttctgtcaaagtagacactacccactcttggtcatgtataggagcagaccatattggccctcctatagtaaatttcttcccacaggcactgcactcttgaggaacaacaggcccaatggcaggcgcattcttcacactgttgttcttcagttcggagaggacgcacaaggaaaagggaaagcttcagactcagcacagatagaattgaggttgtgtgtgtttgggggcttgggggggggggggcaagcataccttagttatggtcctaccaagacactgaagatgaaatgaatcgcaaccaacacattgatatacataagaaagcttttgaggagtcttctttacttcgtttgcagaactgcataagatttcattgtgtcaaatttagaaagaatatttcaaccaagtactgcacaaaagaacatagtcctgttgcataaaggaaaagatgaggggaaaaaggaactcacgtaaatactcggacaaaaacacggatgtagaaatccatagacacagagagaacaggcacaatatatcgtttgtatcgatttgcatgactctggtattgagaaatggaaaagataacaagaatcaagatacatgaaggatgaagcaatggaacttcagagtttatgggtcatttagcaaagcaaataattcaaacttaacacagttctcctgcgttttcgagaaaacttctaaaaacagattcttaaataggtattgaaatttgcacatcctttaataggaatatacttcatcttatgcagttttttaaaccaattatccagttatatattgatccaaactaataagttaactgagtgatataggtacctcaatactggcaaggaggattcgcaaagccatttcatggttatacttccctttggttggataggaaccatacctacaagaccgacttgatggttagaacaaaaaactagatttagatttttgcttcaaaccagtagtaatgtccatacttggagtggcaaacttcaccatttggcccacatagaaccgccatatcagtggcagtgcacattaatagcccaccatcagcaacagcctgtacagccgaatcaaggaaaatagaaggtgctccataggggtcaatatcaacctgaaaatgaggcaggtgtaagttgacatagaaagatacaaatggagtaactgtagtattcatcactttctaatgattaaaattcatttctttcaacttaataacatacaattgactgtttggcacaatcaacagtttgtcaataggggaaacaaatcgattaaaagggtaaagcatgaaaatctaccatttttatatagtaaaatgttgctaccaaaaacaatgctataaagatatcctcgtaactaccagaagagaaaggcttaccacatcaaactcttttggatgtgtgagcatataaactcgagcatcagtcaaatgaggctcgatcttactcatagcagaagcaccattaaactttatattccgcttgcaagcttcaatacaagctgaaaaggaagaacccacacagtataatgaatacaagcagagaagcatcattatttagaaaggaaaccagttcagaaaattgggccattacctttatcaatgtccagagcgaccaccttttctaacacgtctatttcacgagcataacggatagatctcaacccagaagcagccaaagcctgcatttagttttgttagccggtaaaaactgaaaaactattacatatcaggtcaggcaacattagtatggaaccgtaaaactgatgtaaacataacacagtaatgatttttttattgtcaaaactgcataacgtattatgacttgcagcacatagaaccaaatattatggtcctcaggttgcaaaatatcccagccctatttaaaattcgaacaatataacattcagagtacatatttaactaaaagtccaaactttcatgtcagagtgttttatgtatttttttaaatattgaattcttgattaagatgattaatttaactcttaattaatttgctaaaattaactgagatttgaacgaagggtggggctctatgaaacccgtagaccataaacctgggattatgtgccacaactcataatatccttgtttttctggaatgtcaaccattaaacctgcatttttttagatttactctatactattcatactatatgtctcacctcaagaacaactggtgccttaagctctctggctactttccgcgaaggtgtctttgttgcttctgttgacagatcttctgtttcatccgcaactttatttgtttccttttcagcatcaacatccatttcatcatgctgtcctgttgacccattctctccatttggaccagatgatttactctggctcactttgttatgcgccttgtccctcttatccatcattgccttatgttcttcctcacgcttggcaatgaaagtccttaaaagagcaactgacatatctctattgtggacctaatcaagcaataaaattgaattacagaaaagcacagtagctgataggagattagacataattttaggccaaatataattactctgcaacttttaaaagcgatagatacaggaaatattaactatgaataaactcatagtaatttgccgatgatatcacattcccataaccaccctttactcaattcctccatagcaaaagttcaggctgttagtgacttgaaaaagttatggctagagatactaattgttgagaatgcagcataaacaagcccgagtggctgttttgaagcttcacatatattctcctagcaactgcaagtctacaaccttaaactgattataacgtgtcgtgatgcgctaacacaaatgaccaacacaatgcaaacaagtcgtaaagaaaagcaaagcaactagtactctagtggctacaccagagaccactcacttgaaacgacccaatcacatacaaatcaaatagccaaaacccaaacttatagtcctacctatgcacgattggtgaagctcgcagctcacaccattcgatcaattcgaaacaaaccaaccactaatgatgcacgtattctaagaagatagaggagccgacaaatccatcatacagcatcaaataacccccaaaaaaatcgcatacagaacatatacacaacaatacctgcacgggattgtagaacacttcatttgctgctattttcttgttgatgatgatctccgcctcgccttccctcacaatctcatagtcctttagcttgttctccacatcctccatctctccgaatccaatccaatccaacaaaaacctcccgattcaagcgacctaacgagagacgcagaccgtaaagcataaggcgtgggcagagatagatgaggaaggaggagcgtgagaacggatgctcaccaccagatagacctctgatgcagcgggaggacgccggcgaagataggcggtgctcggcgcagaaggcggggcgagctcgcgaagaagagacggggaggggagtctatgccgaggcgacggcggcgtcgaactagggtatagggtagagaggaaggaaggagacaggatgggcccaattatgatgtgccgtgatcactatgggctttttgtatgaattaagttcactttaggtcccttcgtttatcgcctagtctaaaattcatcccacatgtcaatggtcagcactttcttcctcctctcttgccacctatcttcctctctctttccatcttcaggacgccgcctagcaagtggcgtggagagcgcgtggtggacgacgtggagaggggctgcgagagcgccacccctgctccaccttcctttctggcttgcacacgactggtgttcgactggtttgctatgataggctctcctagcttgcacttcgccccaatagcacggacatgttgccaaatgctataatcagcataaccagcaccccacacatacatcacacaatcaaagacgcgtactttttgggaataaatcagaaggatcactcggatcacaacgtttcaactagtagtaaacaagaggaggaggagagatataaaaggcacacctttaggacggaggttggccttattccctcgggacttgaacacggggcgatgattttgggaagcaagtctccgtgagcctgctaaagatggctagtccccagggccgctgctcgcgaggtggcggcggtggcggtggagaatgggcgaagcccgatcaaatctattacttgataaatagctatgcaaggacaaagagagagaggagaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcgaacgagctcgagccgagcttgtctaaaagctcaaaggtagaataggctcagctcgagctcggctcgagctcggctcgagctcgtgtacctgctggaactggtcgccgtggacctggagctgtgccttcagtgagtctatctcactgcataaaccctaaaccctacaacttttagacctattctacctttgagctcgttctacctattctaccataacctagagctcggctcgagccgagcctattctacctttgagcttttagacaagctcggctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagttgatacggatttgcgagttcgggacggtctatacatgctactgtggtttaagacgaattttagtctgggcgacaaattaggggaccaaaagtgaacttatttctctttagccgtcagaattgactacggcccaatagacccaatagcccaacaggaaacacattctgaacagcccgttaacccctaacccttccacgctgtcttctccactcccaccgccggcctcccaacccgccgccggcgacgattccggcgagatacctggtcggcggacaccggctcccgcgggtacgagccttctctagacgggctgcgtctctgtccatctcttcttcttctccaacatgaggcccctcgcgatacggcggcgggaggcgcggctcctcccacccctcgccgtcctcgtccggtccatggcgtacgtggacgtgaagatgcgatggaagaaggacgcctccttcgacgccgtccccgtgctgtcccaggcgcgggacctccgcccgctcgtgtccctcgccggcctcctctcgccgtcgccgacccccgtctccgcggtctccaagcttcgcatcccgctcgaggtccccgaccgccgcgtcatctccttcctgcggcggttccccgccgccttcgtggagtccgtcgggccggagcacaaccacccctggttccgcctctcgggctccgccgccggcctcctgcaggaggagcgggaggtcttcgccgcgcggcgcgcggacatcacctcccgcctcggccgcctcctcctcatggccccgcgccgccgcctcccgctccgcgccgcgcagggcatgctctggcacctcggcctcccggaggactacttcagatgccgggactatgacatcgcgcaagacggattccggattctcaccattggagacagtgtttgccgtgaggaggaggaggatgatgggagggagcttgtgctcattgataatggggaacaccaagaaatgccaaaatcagtgctccaaatggatgccataaggagatttgggtccatggagacggtgccgatccccctcttccagtcaaaggggctccggctgaagcagaagatcgaggcatggctggaggggtttcagaagctgccttatgtctctccctatgaggatttcagcggcatttatcgcgacagcgatgtttcggagaagcgggtggtcggggtgcttcatgagcttcttagtctgttcgtgacatgctctgccgagaggaggcggttactttgcctcaggcagcacctggggctgccacagaagtttcaccgtgtgtttgagcggcatccgcatgttttctacttgttgttgaaggagaaaacatgctttgttgtcctcaaagaggcatacctggctcggggagacactgcaattgaagaacatcccatgctggtggtgcggaggaagtatgcagggttgatggaggagtcgcgggagatcataaggtgccggcggagtgggaaaccttttccgtcgaagcataaagatcatgagcagattgaggattctgagggtgcaaattctgctccaattttgtcatagaaagctagaactttgcctggtcagaaaaaatgagggcatatgcagtatgattttcgtgataataccaagggggattctactcttggaagtatatggctgcttgttaggaatatttgtgtagaaagacaggagggtgtacaaacaggttggtgactgatgaaattaaattgcattatcattttatctgatctctgcaagtcattttggtttgtgcacagtagtacgcactggcggcactgcaaagccacatttacatcaagcctttgtaaagtccaactatatcatttagccaccacttactcacaatcttttcatcaaatcattgcaaatctcaatcacctttcttaaaagggcatagattgctgaatttgattttgtccatactttttacatataaaattcaccaagtatgctgcaacttgttgctgatttgaattttaattgtcaatggctcctgtatttatgtccatgcttatgcctcatggttggtattgcacttttacagttgtcgtaactcagtatctccctttttatggcatggagataactggatgcactacatttccttaggctgaggtcttcacttcttggctggcaaatgttttatggtgtttgtttggttaatgtggtagagttacaaaacagataacatgatttccattgctggaaactttttgtgtaacattatgcgtgcaattgtcagtttccagaatgagaatcaagctttcgtttgcatgcaccagtggattatttaacttaaatttctctgttgaagtacttgtcctgttttaacatctacacaatcggatgaacattagttgtttatattgcgccttaactaatttagataatcctagcttttttgtttgtttgtttttgttttttttccttggcagggagatcatagtttgttttggtgctgtctgtcttggtagtaagcagtatgacaatcgatcaattgcgagaaattagatagttgtgattggcagatgccatagtcagggcattagctctttgtgctattctgtttgttgtgattgctgaattagatcaagaccacattcagttatgtcaaccagggaagagtgttcgttgttgtcaatgtttctgtaacttgattttcttgtataaattttctccaactactgattagcactctctccactcgcttgcaaaaggtacagtgtgagattttctgatatcacatcttctccttcacattttctaaatttaaagctaacaataatttcttcatttcttgcttttgcagagattagtatatcactattcccaaactggtgtctactctttaccgtcttttctggagaataattgctgcaagctttggaatgtgtagtttttttttcatcgagtaattcatccacatttt

SEQ ID NO: 21282 - DNA, 3280 bp, Oryza sativa
cctccatttcccaaggcggcaacgcgcgtcgcacgccacgcggcaccatttcgcttcgccttccccggcaaaatctccccaaaaaaattcgaaaccgcgccgacgcctccgcttcacgaaaccccaaccggcgacgcggcgcgctcgctccgacgaccatgtccttccccgacgaggaggaggacgaggccttcctcctcgccgtagcggccacggaggaagcggcgctggcctcctccgactcctccaagcgccgccgcctctccatgacctcgtcgacctcctcgtcaccgacttcggccactcctccccccgccgccgtccccgaggggccctacctggccgcgctcaagggaagccacagctccgcctggaagcagcagcaggagacgctgagccaggcgcgcaagcgtcccggtgggtcccaaaccctagccaccccaggtagcggcagcggcagcggcggcgcgcaggtcgcgaggggcggcgcgtgcttcaagtgcggggactcttgccactgggcaagagaatgcccgcaatccgtgccagctactggcggcggaggaggaggcggggcctttggtggaagcggaggagggggtggtgggtatggggacgcgggtggggcggtggaggagaaggcttgcccctgcggcgccgggagttgcctagtgctcacatccaacacgcccaggaatccgggccgcaagttctacaggtgccccatgcgggtgagcattacgaatcccatcaccctgtactgtaattgggtagtatcgcttcaaatctatgtggtctgataacgatggttcgcaacacattggatcccacttaataaaaacatagagcctagacacacttgcaattatgtagaggggatatgagacctctagggggtttagtttttcatgatgttgtgccaaattgtcaaagtgataaactgattataccgttgccgttagtgaggcttgctggcttattggtcggtgttccccactctagtgatctttatttatcgtggcacatctgtatatgattgaaatcatactttaaaatatcttagcacacctcagacttctaatcagaatggtgatacatatttgcgatatgaaaccataaacatgataactattaaaaaaaccataaacatggtatgtgtctctgccttagtataatttcccattctgttgtcttaaggccagttcagcgtggtactgttgttttgtggagtgtaatctaattagagagaccggtcaaccaattgtactaggactagacaaatttcctgtgcaactgagtggagtttgattgtaatttattgaaagtagaattgtgtttgctatagaacacctgtttatttattctgaaaatacaattgtatatattatacagttaacatctgtagcagtgatctaatatatcatgtcaatctacaccattaatacagacccaccaagattagtagcataggtttttcttattttctatgattagcgtgtaaattctagccgctgagaatgaacgttgtggcttcttttgagttagttttaatagtataataactacctgggtcttatacagccagcttatatccatttactttatgttatatctattacgaattatagtcatacctagactgaatttgacatggactcttattcttagatctgaaaattcaattattttgaaattttatttttggcacgattcattttttttttcaacctaaactgttataatttggactaaccacaaaactaatggtgtatattttattccttttctcctatcaactgataagttttagaccttgagagcaagtgtatattatttgttactatttttatgagacaagcctgttgtgctctaaacaagaggttatgaatttgattgcatatcgaaggcagtaaacaaaaatgttgatctaaagccaccaggccattctaaaatactccctccatactcgtaaaggaagtcgtttaggacaatgtttaagtcaaaccttgggaatataaatcataaataactctcaagttattgagtttgaaaaggcaaaagttatatgaatagatttgtcttgaaaaatactttcataaaagtatacatatatcacttttaaataaatatttttatagaaataagaagtcaaagttgtgttttggagaccgtgtcgctgtcctaaacgacttcctttatgagtacggagggagtattgatttggagaggctatgaagttctgtttcaccaatcactacttgaccacattattactcgatcatctgtcttgatgggggaacttctattcagttggaacatgggatgcacatcagctccacatgcattcatgcataactactttgtatccttaatacgtaatcattgtttaatatttctgatgtgtatgcatgtaccgttgcacctccaaagccttacactgcatgatcatactctggtgttcatgtggctgatgccttgtgtaacctttggtagaatatgccagccaataaaggatttatgtcgtgtcggctgatacagtgtgcttggaattacatgtggttaatctaaaccggtcattttatttcttaggccagataactagttgtctagttactttttctcctttacttttttgcttttcctattttttttgatttatttcttttatgttatttttattgccattaggacaatggaggttgcaactactttgagtggtgtgataacccatctccaggtcctgcaaatgtcagtggcaatactgtttttcagtcagatacatcagttgcgcatatgctttgcccctgtggtgctggagcttgcttaattctcaccacaaagacaggaaagaatgttggaaggcagttttatcgttgcccagctaatcaggttcattcatgaccctgtttatcctcccaccctctctcttcctctcttctttcctcacccaacaaagcagggaaagttgttttactgtacaatattatgctgatatcccctataaaatgagttctggtactgtgttgattatctacagctgtctcattcttgctaaatgagtgcgtcatttgctaggcccagtatgattatcatcaataactatagtacctacagatggaagttactttagtgctttggattgtaccatgggaattttgaactgtttatcttgtgaataggaccaagatactgctcaccttatgttagtctagaagatgtggacagtatgatggttacagttgcacagcgcattcgtgaactaagattttttggatcagtt

SEQ ID NO: 21283 - DNA, 10728 bp, Oryza sativa
atacgtccatttaagacttggtttagaagacagcagctagccagctgatttagttttggttcaacttggttccagggctggttaacacgattattcttgatgatgatgatagtttgcttactagtttaaatacgctcaatataaattctccccagtttccattgattggttgatgcatttggtgtgaccccatagctggactcaatgtcctacttttaatgctttatgtccaaaacccgtagtacttctaatgttaacagtgcgttcttcttacccttgcaacttcgtattttattgttacaattctatgtcttgtttgctcttcataccaaaatgttcttttgcatttgctttaagagatatagtggtaagttcctatgtgtagttaaatccttttgttctagtggagcacttatttctatctgcacctttctggatagcaattgatgctaggatatgatatcatcacttgttctgttttacctttttcattattgttatattcttgtatgcatttttttcgaaactagggcatttcatatctctttcttaatgtacgatcgggacatatctccagggaggtagctcttgtggctatttcaagtggtgtgatgaacaacagcttaggacagctgctccactgcaagcttcaacacaatatcatactgatgttgcttcaagtggccaaattcccagcaagaggagctcctccgcctgcttcaaatgcgggcaagagaaccattgggcaaaggactgcccaaatcaatcttcagatccttatcctgacaaaggtgggagaacatttacttctgcaagctctcccgatgcgtgtttcaagtgtggtaagagcgggcactggtcccgtgattgccccaccgcaaattgtggttctagtaccgtctccagccatgtcaagtcctcttctactttgggctcatggaacagccacagatactgatagccggtacctgtgaactcaattgaactgacatggacatgctgtacgaaacttggacaaatgcacatgacacgtgttgcttaggtacgcattcttgccaaattccttttgctacttttaagtttggtaatgagtttttactgaggacatttccgtcttcatgctggttgctctgggaatcttttgtcatctgctctagacatttccactgatgtagatataagaaaaatcagcactatgttcaattctatgctctgttttcgtactgatttcatgttcattttcgtgctccttttgaaagctttatttggatatttacatgagttagattgaatgcccatttaaaagtttagaccctgggacctgtagggtagttaatagatgaggtagatatggtgcccttaaaactttagggcctggaccctgaactacactttaatatacaaccttaccttctgacaaggctaagtgaaacacccacaaaaagattgggaacagttgttctgttgggttggataaacttaatactatcacccactgtgccattcataggacccgtctattaaaggataggaacaaaggctgaccattcactcactgcgccaagtggggagaatgctattcactcaaggccacagaagctcacatggtcatgagctcgtgagggcaaggaatctcctctcccctggatattagttatcatcagtagtagcagcagcagcagcagtagtagtagacagccgtagtaatcatctttgcacaaggatgtggtcctggttgctggtgcccagccaattgaactgcaggatggttggtgccatgacatgtgcttattgtttgcccctgcaaggctttgaatagtcactggccaacactacctgccatcacaggtcggtttccctcagcgatcttggggtcccctatgcgtagatctgagatgcctccactaacctcgctgggagcttgatttgctgtttatttgtttgctgtctgttcggtcggtcttttgcagttgttactttgcactcagtgcttcgcctctaggctcaagggagggcctgatttagttactccatagtcaactagatagaaaattttaaacatctctctggtaatttatatatgcccctataacatactcagtgcttccgtatagtctggtaatttttgcttggtctttgactagaacatgaatccaacggtttatactagttgcctgcatccaacggtgcttgatttgtggcctacgtggctcaaccaagatccgagaaagattttattctttcactactttagatcagatagagttcctccaaggaaatctttcagagtcactagacaaagtgttgtcatgattcttgattagtccccatagcctgcacttagcggtagtgaacctcttgaaattctttatggccccttgggagcacatgaattagttcaattcctacgaacttcctcttccccccccccccaccccaaaaaaaaaatgcctatatcctgactgtaacagtcagttgttgctacaaatcctccccggtgtgactgtaacagttcgttgctgagttgcatggttgcatgcatgcatcaactcatgagtcagtcattacacgatgggaagcatttaggagtactttcgtggcacccagcaaaacatgacaagcagccgaggacgctgggcctgcctgttcgagctgccactgccgcctgcatcatcccaaggaggaccaccacccgggagaagtggaactggatcgattggcaagaacacgaggccgcgggggccacagccgtgaagcgcagcgagacaaatcccatggggcctctcctgcctctcccctctcttaaatgcccctttggcctcggcctccccggaccccggtggtggatttcgctaaggccttcttcggtcaatccctacgagatcttattcggttaatccctgtgaacaatcccctctaaaccgaacaaaagcgaacaaaaggcctaagtttgaaaaggagagaagagtagtacagtactgtagcaaagatgccggcgagcgacacgctcacccaccctcctttgcgccggcccccagcctacaggggcatatggctccagcacggcgtgtacaacaacgtagtgctcggggcatccactgtgcgtgccggcccgcccctccctgtccctgtggatgtggcctccagctgattgatgcctttgcttgttattattgctgctggtaggagaagtagtgcatcccgttattttcagccacttcactctattattgccgtggattttttttacctctatttttttttctattgcatagcttagccccctttcctaagctactccctccgtcccataataagttacattgggacgaagggaataattgtttactttatttcttaaaatagttaatttatccttacaattaagtagataatttgtatcaataatctagtaaaaaaatcaacaaaattttgagatgtggtctatgagtgatcagtcagtgagaatatgaagaagctagagttaactggctcctgaataccgatatgagtaagaatatggattatttggggataattggagattatagggataacttttgctgtcacaagttccccataacatgggtttagactttagagtagcatggtttggccatttagggtctcttgcctgctactccttcggtattattattgctgttgacttggtgcttctgctgttgccgactttgccatgagccatgatgattgtgctctcatacatggggtggccgggtgggcactcatcagggggaggaggcatccttccatcttgtcacgccaaatggggttaaccccggggaattttttccccttctctcatcactcacctctctgaagccgatccacatcggtgtgtatgtcacatctgccgatggtctcttcgctccctttctccccgtcacactttgcttctccctcactcactcacaacctcttcttcaaatgcctctgttctttttgcgacttctactactgttgcgtaataattgtagtactagtaattcaatggtcgatttggccacagtaattcctctttaatttaatggactagacatctgttactatcatcagtgaactgtagtactccctttcagaatataaggattttttttcttgcgctgattctcatcatttcgatttttgcaaagccaattaaatatttggaaaggcaatctaaataattcaacaattgacaattgaaatgaaacattactgtttgctaagggcccctttgaattgcagggtagaaaaaacggaggaataggaaaaacataggattctgacaggaattgaagtgtaaaacagaggattgcaaaacacaggaaaaacacaggaatggtcgtttgattcgagtgcaggaaaaacgcaggaatcggatgagagagatagactcaaaggaaattttccaagaggttggagctcttgctaaatttcctccaaaatctacatgcaatgtgtcattccataggaattttataggatttggaaagcttcaatcctttaaatcaaagggccaaataggaaaatttcctataggatttgaatcctatgaaattcctacataaatcctttgatttaaaggggccctaaacaatgtagaaactcttatattttcgaacggaggggtttacgatttttttgagctccaatccagacagtgtgaggattggattggggcgtgatgaattatcaatcagcttgtggagcacagttgaaggaatggtacaaggagagatggcatggaccactactcctttcatcctttggccattgaaaggtgaagtgttgggagattgagagagatggggtaagctgtaataacaagtgagggaggccaagacaaaacaagccgagacgcgcacataaacaaaatttcctttcgctttgagttggaaacacgtcctttttggactgaaacttgatggatgtgtccctgttcgggacaaactcgtaaggtggacgtgacagcgcgacgtgcccatccagatctgccgagattttactactaccatcactcgtgagggagaaacaaacctttctccctattgcttcagatcatactaagggcccctttgatttgtaggaaaaatgtaggaattttggaggatttcaatcctatggaaaaaaaatcttatgaaggcctttgagacaaaggattgaatcctatccaatcctttaaaattcctatggaatgggtaatcctatgcatattttggaggaaagttagcaagaggtctaacctcttggaacatttcctctgagtctatctctctcatctgattcctgcgtttttcctgtggtccaatcaaacagctattcctgtgtttttcctgtgttttgcaatcctctgttttacaattgtattcctgtcagaatcctgtgtttttcctattcctctgttttttcattcctacgattcaaaggggccctaagattttactactaccatcactacaacaccaacctattgtactactactaatgaattccacttggagccaatagtattcctcccttctcctgcactttaggaggtaataatgagttgctaactaattaatccaaggcctccatggctccaactaactagtaataatcttttgcaagagtctttttttaatatatatatagcggataaaatttggtctttgcttcgtaatactccctcagttccaaaatataaattttttttgacctcaacgcagttttcttgatactactttgaacaataatatctataaaagtaatatattttaaataaaatgagtggcatatgttgatagtttgttgaatgataaatctactagtaacatcaaagttgcatgattgatgttttttatttttatatgatattaatagtcaaagttaaaaatgtttgatttgtcgctattctaaaaatccttacattttgggatggagaaagtacttattatggtctgtttggtacaactctagagatggagctgagtctatccaaatagtttcagcttcgtctaaaatggaagcagagctagggtttacaaaaccgcacggttaccatgcggttatcgcggttaccatgcacggtaacctttttagtttttgaaaccacggtatgtctcgcggttaccacgcggtaaccgcgcggttaccgtgggggtgcagcaaccacgccaaaaagagggttactgtgggggtgcagtaaccgcgccaaaaagggtaaggggaaccctgagtagagctaggtggagcgctctcataatgtgaaccggggtttaggctgctccacaattctattccagactcaactcctagagtaaatttaggagttgaagctctaccaaatagactcttataaagtacttagctccagacaagtataaaagattaaaagtatcttaactagttatcctctgtgtcttgagtgctaaaagagtttatactgcaagtagcgtttagattagcagtctcacgtggtggcctctctgaactctcacaccctagaggttctgctgccaaattgttttacttgcagctttctacaaagggtaactagcagatgttatgcgaccaggaaggacaggtcacatttggcatcttgcgagggatagttttgtgggtctgctttggggacccatctaggtatcccctgttaatgaccagcttagagaatcccttttggtgctgaattagttagctacttgttgtagatgctcctgttggaatatgtgtccagatctttatatgatgcatactccacgactagactaaagataaccagtaaaggcttttgtttggattgatgcccaaaagaaccttttataacaaaattaagaatactacaagcgttcaagtaaacccaatcatgcaaaatacgctagctatcctgctagtgttggtaatgattgtagaatttatccttagctaccagaaacttggtatggaaacaactttaatgtaaaaaaaaaaaatcagccctagcaactttcaaaattctgactttaatttgtcagcaaaattgttcaactttattaaccttttttggtaatggtcaacagatcaaatcaaacaacccataaaatctctcaaaattgggtattttctactactgatgtgtgttcgtggaggagtgcatgcgtgcgtatagcacatgaccttcgcgtccatttattattattattgtcctggctgttggatgctaccaagatcgcggcagcagaacagctaagcgagctcctgtagctggataacacctctcgggccagttgccgcgaacgcatctccttttatctggtgaaataattaggtaatcagagtacaaataaatttgatgtgaatcgttttatccccttgcacttaacatcacttaggagcacatatagtagcttttttttttgttgtttctctctttaaaacgtgcattagtaatagcaaaaaaaaaaacgacttgcatgaaaggttaataaaactctgctgttactcgactctgttgggtgtgagtgtgacttttgtgttgaattcctttggtttttaaggcatttacgttcttggtaaacgagttttactttaatatatgttgcaaaagataatattattgtttagaaaataaaaataatcaggagaggcataacatttgaatacattctttttttgtataatcttagattgatatgtaaaacaagctatagcaattactcccttcgtcctataatataacaacatcctggatacatcctaaaacaaactatgaatcctcatagcccctgttcaaatcgatagcagtaggatatgttattttagatgttactgtctctccattttgtattataaaactacgaatctcgatagccctcctgttcagattgatactagtatgatatttcatccgattctagtttactccgtttagtattataagttgtttgacttttttcctaatcaaactaaatttatttaattttgactaaatttatataaaaaatataatattactttcaaaacaaaaccttccattttgtgaagttagtagaagaggatagatccagtaaattgtagtacatacgaatgtcaatcttaattattgtagattaatacactggtaagggtcgatcaggcaaataccaaagctgactcccgaacaaaacaaacatattatcaaactatattcaatggtaaatttaatgaaactaatttcatattttagatgttgagatttttctacaaacttgatcaaacttaacaaagtttgactagaaaaagtcaaacgatttatgatatgaatcggatggagtatattttgggacggagggattacaatcaaggcccccccccccccccacacgcacacacgcgcacacaaaagcatggtgcacgaaatcaattataaaatgagttcgtactcttgcacgtgttgtatgtacgacttcggtacagaatcaccaagtcgttacagtagaccaaattcatttcactatgcacacagctctcctgtgtgttcctgctaatgattcagatccacttaattctgttgcagcagttggctaggcaaaaaaggtagtgggcacctctcgtaccacatttaccaaaaatcacatgcaaatgcgggcaatgtatcaagtactaacattatatgggagatgccgatagttgcagcttcaagaatctctagcttacttaaacaattcagattttcatttaaattttgagaactgtagttattgaatttagaaaatgaattaaatttggttgtgtgtctaaaagtggaggccgaaatgtaaataattttcactatctaaaggagaaaataaactagaaacaaaaaattagaaaacttattttctagattttcatcagctagctacttggctgttttaccagattgttggttatgagtgagggaactccaactcgaataattatatgcttggtttatcaagcttgatttttttttctaaattagaactagcatagattaatcttgttggcacgctttttaaattgttaaatgcgttttttttaagtaagaggttgtagggttgagagtgtcctacctcgttttaggtgtgtctgaaaaagctaagccatcgtagtcaaactccatacaccattcttagaccaggttttaaatactgtattttagaccataaactcaatatataatgatgagctaaaaaagagtttgggcatgtcagtagaggacccaagcacaagctctgtttggcgtgcaagttggcaccagtcctacatactgtagtactccaacgtacacgcccacattgctgccatccactgcggcagtgctgcttctgctggtgggccccacctcgctccgctgtggggcccacttccggtgggggccagaaattattgcgcacaagacccgcaggcccaatggcgagccgccacgtgtacccgcgcctcccctccccggccaatcgggaggcctcgtccctctgggatccacctgtcggtggcacagagacctccccacacacgctcgtctcccactacacgcccccccgcatatattcccgtcgccaccacggcgcaactgcgcgaccggaccgaccgagaccgccttgtctcctccttttctttccctacttttttttctccactcgtgtgtagtgaaaaaaaaatcgcccactttaatcatattccctctgtctcaaaatatgactgacgattaattttagcaaggtctcaaaattaaagtgtagtatttttatcgacaaaatcatttttcatatattcaaatgttaaaaatctaatggtaggagtactaattaaattgacattaacctaattgccggtcaaattctgcaacagtagaatcgcaccttttttaaaaaaaatttagcacggaagaaactaatatgattaattaaattttgcatagtaccggtactgtgttggatagttgtacggaaaaggctatacgtactaactttttcttactaaattcttactaacactgatgtgtcatgctatgagtgcatctagatttttttttaacctccatctacttaaatcaaatggttgagatgattgttataaaagtttagtaagaaaaatttagtacatttagcattgctcagtactagtgttgtgactcgactccaataataaaataataatattactattccatctattcatgtccttgcgaagccaaatagcgctgaggctactgcttgcagcaacaattcttccttttctatttccatatatagaaacaccaacctcctcatttcccccctgaccccaaccccaaacccactctactctactgtgcctcacctcttgccactactatttctagtagtcgtgtatcatcatttcagatatcatatcgccacctctcgtttttttaataatatcagcggcgagcgagcgagatggactccccgtcgcctatggcggcgcaggcggccgacctgtcgctgacgctggcgccgtcgggagggggtggtgggggaggaggaggcggcggcggtggtgggtcgtcgtcggcgtgcatcgacggcaaggacgtgcggctgttcccgtgcttgttctgcaacaagaagttcttgaagtcgcaggcgctgggcgggcaccagaacgcgcacaagaaggagcggagcatcgggtggaatccctacttctacatgccgccgacgccgcaccccgccggcaatgccgccgccgccgccgcggcggcgacgcccggtgggatgtcgtccgtcacgacgccatccggga

SEQ ID NO: 21284 - DNA, 31697 bp, Oryza sativa
  unsure (1)..(31697): unsure at all n locations
cctggcggtggtgagcagcgggcgcgcgatgctggcggcgcccgaccagccgggcgccgggcgcgacgacatgatcgacatgctcaactggaggcgaggctcccacggccccaccgcctccgccgccgccaccacgccctccccggcaagcaccaccaccacgctcaccaccttcgccagcgccgacggcagcaacaacggcgaggagaacgaggagctcgacctcaacttgagcctctagctcccaccaccaccacctcctcctccgccgccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatccttttttgtcttctttttcattttgccgtcgatttcttggcttctctcttcattttacctttcatgtttgcctctgctgctgtatatatctgtgactgtctctgtagtctgtacttggatggcacttgcaaccaaccgcattgcaatggcctgcagaggctcgatggtcacactgttcatctcatgctcgaatcgccattgacatgtccatctacttctacttcttctcatcgtatcaaagcgttttcttttcttttcttctctgaagccgtgagttttctctggttgcagctgcatctacgtgcctgtcaatccattcaactacgttcatatattctcctcgttgcaatttttttaatacgttttctcatactgttcatggacctggatagattaatatccgtatacatatactgtacatatttggtggtactagtgtatctatctatcgtctgctgcactaattcatcatatccaacggctgtgactgctagtactagctcttgtttgtttgttcgattctgtggctgcagaatagtagcagaaggatattagacaagaagttttcaatttttttttacatacgtcatgcaaggtgaacgtgcatactactacggtgtatggtaaagaaggtgaagtagttgctggtttttactactactgtactattttaatccttgtgtgtcccaaaactgttgctgctgtttggcgtacgtgtgcatgttgcgttttggtgacatgagatgagatgcaggtttgggagcggtgggtgttgaacagtgatgcaatcaatctcgctatgtatatactccttctcgtgctactgacatgtggggacatggcatgagtatacagtagtagtatactccatgtgtgtgaatgttcaggtcggtgtcccatcgcgtcggatcgtgtttcacagttgcgagagctttttctttatttttggctactgcaacgctttctctcttcttcctcttttctgccatgaaagcctactatacgactagtcatctcctgacttgaaaaaaaaaaccagaagaaaaggcgagagagagagagagagagagctcctgtttcgagttatggtgagaggtgacgcgactcacgcaccggacggacaaatccgcgccgtccaatagccagccagccagaccctctttgcgggccccacctgtcagcgccacggtccaatccccgtgccccggcccgagccggatcgtctgcgcgccaaagcccaaaacgacccttgggtggttcgaccggtcgggtcgggtcggcaaactcccacgtgagccgttagatcgggttgtcaggcgatcacgaccgtccatcgcgagggctctctgttctttccggcggttaacagtagccatccgggaaagctacgtcgacgtggaggaggaggaacatgtcgacacttgcatattccgagactcgtactcgcgtactagtaccgagtacagtactaatttttgttcgtacgtacacgtgggcgatacggccagctatacgtacactcgtaccgccgcaccggccaatacgtagacgtacggagtgccgggcccaccggtcggcgtgtgtgtgtgactgcggctgtttccggctgggggcaggaagcagcagacagcggcaaccgatctggttcctcgccgtctgcacaactggcggggacgacgacagcgtggacacgacacgcgcatgtgaccgcgccccaccctctggggcggcgggcccacctgtcagtgcctcctgctgttgcgagcgcgcgtataattaacttcggtactcctccgagccaatgctaaaaactcgtccgttaactttttacatcatgtttaaactataaacaaaattttatgaatattatttattttgttgtgatatattttactattgaagaaactagtatggcgtattttaatacacttattctatttatttaaataatataaatgatcaaagttgtttcacaagttaagatttttgtcgtgtactaaaatctggaggtagtactagtaaaattatggcgctgatgaatggtgatgactgccggagccacagctcagagctactgccaccagcagccattttcaactcagccgcagccaaagcgaacagcccgtacattaggaactttaaattaaatcataaagtttaagggcctactatttgtttgggaggaaaaccaagggactcaggggctgtttaggatccctcctatccaaacaccacctcatatttctatggattaatatctactagtgtcatttggttcataggaatgtagatataggaaaaccaaataaaaattttctttcctacaagttgtaaagagaaaacataggaaattttccattcactcaaacctattgaaaaattcctatatattgaagtgtgcatgttttcctattcctatatattaattcctccaaaacagataagtcttaaatgttggctattgctaataataatctactactccctccgtcttagaatatagtagtaatatagtaccgaatatgatgtaccctactactacggatacggatataggccagaatacgtctaatccgatactagattgctatactctgaaaattttatttttgataataatatttcaatccaacaatctatcatcttaatgactttctcggatttaatgtatgactcttcattcttccacataagattggctatacgggcatcgagaaatgtaaatattaatgaatcgcttgttcacgaggaatgactagtagcatgtttaaatggatgataagtagaattgcttatccttggtctgtgtggcaagatgaaatttaaccatgagcttttgttttcgtgtccaactttaatcgtccgtcttatataaattttttacggtttatatttttattgttattagatgataaaatatgaatattactttacacatgacttttttttaacttttaaaaaatcaagatgattaaagtttgacatgaaaactgatgaccacacttaggccccctttgaatcacaggaatgaaaaaacgggggaataggaaaaacataggattctgataggaatacaagtgtaaaacagaggattacaaaatacaggaaaaacatagaaatgaccgtttgattgagccgcatgaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttactttgaatcaaagggggccttaaaatgggaccggagggagtaaaatgcagacgatgagactgacggtcacaggaccagccgcggcggtcccggctgcggcagccgtgttgtctctatgcgtgcgtagctgtgtgttggaacagccgccctgatgattctctgtggcgcaacatctgtgccacccaactccctcattggccgcctcagttatctcttgtcgcctagcgtcctcgggaaaggacagggatgaacagtcgatccaactaacaactgtttcaaaattatgtatgtacaaataaataaataaatttgttcttttttttaatcaaagaagcagataatttagcccactggatttggtaaaaacaaatatgggaaaataatatatgtatccgttcgtatctgagacgattgcaacagcagctctggtctgatacactgatgtgccatctgtgtgtgtgtgtgtgtttttcttggattgttgcttgactggcacggggcagctacttgctttaacttaattaagcaggaccatttctggataaactcgtaatttagcaaaccggtcttacttctttttgtgattgccgtgcttgtgtgtggtcatcaactcatcacgagtgcacaacaagttacatgagtataaatacaagttgtaacatctgtattaaaaaatgtcattattaatttattggtaggtcaacttacacgcagtgaagaaaatgagagagagagagagagagagagagagagagaggggctgcgtggtcttaaaataatttgtcagtttacggaaataaataaataaatgatgagcatgcagcgttggtcgtatgtactggttaattgcaattatacaaatggtataatcactatagcatggcataagaagaaaacaccatgcatttctctctctctaaataaagtacaaaccctctttaataattcgattgtgaaatacgatagtgaaacagtgattgtacgttagccgttgatgcacagtacccgtaatcctagtggagataatgtgatcatgtgcagagctactgttttgcatatgtatcttttaaatatttgcattatatgcatgaaattacattggtagattaatattaaaaaaatattccatatcatattgttttattaggttttagaaatacaccacaattaaaaaaaatacatggatttacattaattagtccatttgtatgctataaagaggacatacctaggtcatgtttgatagagcttaagacattcggttgtattttcttttggaatctatagctcatcaatctatattctaataataatttgtagatatagaattagaatccagaggatgaaaacttgatttttctatatttttaccatctaggcacctacttctcgaaaactccagctctccaaacacaatgaaaatgtagaggtttttcccacctaagaccttatttgattaattcccataaagctttattcgattaatcccactcacaacagaattaataaaaaattggaaggagataattctgcacctattaaggtatagaattaatctctctgatgagattaaccgaataaggctaaagaaaatggaggggattaagggaaaatagtttcacactaaaatatatgtgaaattatttccattcaaatatccctcaaacctggcgaacaaggtctaaactagatgatgaaatttcctgaatgggaagcgaagtagaggaggacatgcattatttagcaaagcgattggcatgatgccatcggttttaactatttttgtctctatatcgaagcgaattattaaagagatcagtgttgtgttctgctcgtgatcaatgaaactgtttatacacgcctgcatgtggaccgctgcttttatgtcctactcgtatcatctacttgcatggatcttattgcaaggacacataaattcgagacagaatggtttcgtttgtcattttctcccaaccacctctagatcttctccctcacactttctcccaactgcacataggtcccgatttaaatccaacatagctggaggcacaatgtttgaacaatttttccggatcgtaattaatcacgtcaatccatatactacccccacagccttaaatctggaattacaacgatttaggggcttgtttgaaacgcaagagcaacgcctcgctctcttcagcgagctaagtcgatgttaaaatttaaaacttcaatgcttagtatgtgttatagttatcattagactaatcgtggtctcctttaggataaagattgaaaaacacataatagaaaaaaaaaaggaatgtgaaaggaataaggcagggttgcgcatgaaaaaccaaggaataaaaaacagagaaatttttgtaggatatgatgtttgggtcacaagattatcttgaagacatgatttatcctccatcctattccaatgctagctagtaaaaaaaaaggatgaagtgaatgtttgaaatactttggaattcttgcgttttttattgcaatgcaagctacagtattcatccataatttcattgggcagttcctgctacgtacaatggtggacaaaccctttttagtcccggttcacaaccccctatagtctcggttatacaaccagaactacaaatccgggactaaaaatgggcatttttagtccgggttgaaataactggaactaaaaaaggatctttagtcccggttggagttactaaccgggactaaagatctagtcctggttagagttaccaaccgggactaatgttttttttctttttcttttcctgctgctcgcatgattttgagccccacaaatcattcatattatccacagatcattcgaacaccacagatcattcacaaaatccctaaatacatcaagctgcattttctatctccaaatacatcacaaatcattcacaaaatcacaaaatcatctctacaaattcattcacacatcacacatcacacagatcagaaaaagaaatcacatcgcacagatcggccatcagaaaaagaaatccacatcacacagatcggccgcacacatcgcacagatcaggaaaaaaccacatcgcagagatcgggtgccggccgtccaccgcctcgccagcctcccgcccggccgcctcgggctctgccgccgcctggggagcgtcgccgcccgccgcccgccgcctcggcggccggtgcctgcccgctgccgcctcgagctccaccgcccgccaggggagtgtcgccgcctcactggccgtctgctcggccgcccgcctcgggcctcgctggccgcttgcctcgcctgcctcgcgggccgccgcctcggccgcccgcagccggcctcgcaggccgcctgcccggccgcccgccgctccgcgccctccttaccgccgcgcgccgcccggcctcacatggtaggaggaggaggaggaggaagagaagagaagggagaggaatgggagaggagaagggatggaggaggataaggatggagaagggatggatgaggctatttaattaatgagaggggaggggaaaggaagggggagagaccgaggcggccgggcggggcagtggcgccagctcggttgattttttttttgtcctggttggtataaacaatcgggagtcctgttgtttataccaactgggactaaaaaagaattggggtctaactcggtccgataactttttgaaccggaactaaatttagtcccggttggtattaccaaccggggctaaagatcaaaaattttttaaccgggactaaaaataatctttagtcccgattcctattcgaaccgagactattgtgaattttggacgaccgagcaaaataatttctccaccagtggtagtaaattaaaggcacctgaccaatgacaaatcttaaaaggaccataaatcctaaagagaaaaaaaaaatctgtggaaacaatttgtttcaaagtaccccttaatttgcatgattttactcgaaacaatttgtgatgacacaatactttcacggattttaacatattttctcttcgaactcataagaaccacgcacatcaatatattacagagagagaaaatttcgtacaagtgcactctgctgtgacggtcacgagggttttacatggaatgaaaaggatagcaaagacttgcttaagagtgaaaattttgtaagacattgcatccgcgcgttcaattccacgancacggaaacgacgagaggcgcatncaagcattcacaacgatgtctctcttctcgcatttgtcgcgctgcatatgcaatctacacagcccatgatgatcgagagcactgcacaatcgtctgagagagagatccatcccgatcgtacgtacgattcgcacagggagattgtcgctggatcgaagggcacgcagcacgtgtagcacacagtccggtgactctctctctctctctctctgagctgttcatggactgatcgatcatcagctgcaccttctgcaagctagctgcctctctgcatatcgatatactgtagatatataagcagtgttgtgcttgttgcatctgcctggctgatagctggagtgtatctggtctcaggcccaaggcccgaacggattattatcgtggattatcaacatgatagtaatagggaaaagattaatttttgaaaaaaataaacataatgaatagtttaaaacaagctgcttaaacagtgcagcaaaagaacttttttttagaaaacatggtactagtaggattgagcaaataatatgtttcaataatccaattgataagtgaagtgagtgtagctcaacaactgattaggttccttttggtggaactagcctacccggatccaaatcctatatttgacatggtgctcgcatttacgcctaattattcttttagtggtaggtgacgtatatgttgacagcgaggcgcccgtgattattcatcggattagtagtgtggattatctattcgattataaagataaattaaacaatttaatatataaagtaaatataaatagcctaaaataagtggtccaaacaatgcaatagaagatttttttttttacaaaacatattatgttacatacgtggagcagataatctgtggcaatggtttggtgaagtaggttgtaggctatttacgtgcttctgacctacttatattgcatacccatttgttggtctgagttatttcattacaaaaatattacctccttctctaaaaaaaactttcatttaagtaatacaacgaacctgaatactgcatacgaacctagctaaaagaagtactccctccgtgccaaaaaaaaaaaagacaaaccctggtttccgtgtccaacgtttgaccgtccgtcttatttgaaaaaattatgaaaaaaaattaaaaagataagtcacgcataaagtattaatcatgttttatcatctaacaacaatagtaattataaaaaaaatcatataagatggacagtcaaatgttggcacgagaacccacggtttgtctttttctggacggagggagtagatgataaaatagccattgttgggctaacagcaacacatttgtatgtacatagtacgtttgtgctatgcagccacagagaatatgttggatggcaggttgacagtcaatgtctctaatactgtttgcaacaaagcccaacagagcactgacttttcctcacaaacaaacatgataatgtatgaaactgaacatacacatattgcaactacttaattatctatttatgtgcctgcacatatatagcaatacaacatgttgctatacatagcctggtcttttccaaaatccagggatgtactttgggcaaaaacaaaaggcctaaaaaaagcttttttttaagatgggactaaaactttaagtcgcccctatcacatcggatgtttggacactaattataaatattaaacgtaaactattaataaaacccatttataatcttggactaattcgcgagacgaatctattgagtctaattaatccataattagcctatgcgatgctatagtaaacattctctaattatcttaaaaaatttgtctcgcaaattagctttcatttatgtaattagttttataagtaatatattttaatactctaaattattagtgtctaaatatagagactaaagttaagtccctgatacaaacaccactagatagctagggtgtgttcacgttctcgattcccttctttcatgctctaccttacctacatcagtttcatgctacaccaaccagcgttgtaaattcatgaatagtcaagcaatcgatcgcctgtttccatgtgcgaacagggcgtcacatggactcgtgtgccccacggcggtcaacagcgccagcggcacagtctagtccggacgactaatggcgtttgatcaactaattattttttaatatagatgacattcggtattgaaatttgatcgaaatttatttttaattctatcatttcatgtacagccgattgaataagttgtggataaaaatgtcatatatatttctttaatgatttaaagcctaatgctgagaaataaactgcaatggatgaaaaccctaaaatcagctgtaaagttaagttttaaattttagcaaaggcttatatgacgaataatgtaaacaactgtttttttagtgtgaacaatccttggtggcagtagcttattattttaagttctcgtgctaaataaggatatcaaaataagtaagaaaaatattttatacgtacagactatctctgagagcgtgatccaattgggactataaaaaaatacagacaaaagggcaacattgcaggatagagacatgactgatatatatgaatttatatgactcaatctgctggtttgtattttcctggaatacattactatacacacatgcgtgccttgaactgttgaacatataattcctccaagttgcaaaggaacagaacattcatgtcatcctgcaagtgtgagcgtggtccaaactaataaatttattccccttcctgtcaaatgggtctcactggattttcagttagattttgttcaaccacccatcacaccaaactttgatttcgaatccgatccaatcctctctttccccctttttatgccttttttttaactgatggtgccttttctattctcttttcatctctgatggaagtgacgaagtagtagtactatgtataagtagaaaatgttgtaggttggggggtcccactaacaggctgatgaaaagaagaacatcaccaaccaaatagcaggaggtgagggtgacagtataataatctctctagcagcagctattgataagcaaaaaatatggagacaatggggcctagtaatagtgcatactgcacagtaaggctttacttcttttgaatggaggaatttccctttgaaccgttcatttcaatcacaggattgagaaaaaaagaaattgaaaacaatgattttagtaggaatgcaagtcacaaaacacacatgaatgattatttgaatagaccataaaaaacgtagagatcgaataagagaaataggctttaaggaaatttctaagaggttagagctttaactaactttcctccaaaatctatttgcatcaagtcaatccctaagaatttcacagaagttgagaagctccaatcatttatttcaaaggactaaggatttgaatgctaataaattcctccataattcccttgtttcatgggaattttgggaatcttatgaagaaaaaactcctatgtggtgatttgaatgaaagaaatagctatccaaaaatccaatgaaattcatctggattgactcaaaacataggaaattggaggaattctaacatgagcttcaacctctttaaaagaaaccgtttatgtttgtctctctcttatccaattcctacgtttttcctacactacatccaaacggtcattcatgcagttttcctataatttttcagtccataggatatatttcagatgttagggcacttcaatcatgcttttttttttctgttcctgcgtttcaaaggagcccgataatggagctgaaatgtcggagaattgaatgagatttcccactaaaattcaataaacctcttgtgttttgaaggagcccttaactatgactatgaaagcttactctctgaagtaggggctattcggtagtgcttgctgcactgagctacaccaggagagcaaagtttaactatcctggtgtcaaatgaagtaaaagtgacccctaactgttctgatgtcaaacgtagtataaaagtgtatcatatccggattccacagtctcacaaaagcggttatctcgttgggctgagaactacactctaatcgatcaatcacggatagcctagtttgctttcaggcagctggcctggcccattgctaaatatgggctaactgtagggtaaaatagaaataagtccactatatatccccaatctttttgtcaacattaaatgaaattcatgtccttcacaccgagaccacctgaatttctttggtcatttggtcaagccctaaggttgaagtggcatgcgaaatcactggaacagaaggataggccctggacgatggcgactttcaggcctgggaatgatgtggagaccatatttcgctcggcggctgttaacagtgaaatttggtaagctcggagtagtcatcggcttagagtcagcatcggcttcgaagtcctgagattagccgatgagagttgtcaagtcgtcagttgtcggattcttgctatattcggttaaggaaattgatctactaaaggaagcttatccaaaagagaccgagttcaaagagaatgtggcgtggcaagttatctattaattaggaatagtttgttagtttccttttatctttaggaaagtgtgtttagtatcctataaggactttatcttttccttttatctttaggaaagtttctttcttgtccgacaaggaattgtatcaacccgtgggtataaatatatacacctggggtctatgtaatctatcttcacgatcaatacaattcggcgcatcgccaccttttaccttttctactttattttatcgtccggcgggacttgacacttgacgcggggctgcatcggtgttcgatctctggctaaagggtaagtccaatgttccgccggcccgggcaattgtatcgtttacgtcggcgtcgttcaaggctgcatcagtacattcgacctcttggattgctctggtttggatgatatatttgctacctatttatcatgtctctgttaatctagtcttagcatatcaatttagctctatcggctgtctctcgctttagggtttctgccggtatcggctaaatcgccttgctagattagattagcctaggcatctaccaccctgaaaatttaacaagatgctgtttccggacgagctacaggacggattttgacagtgcattcatgctaatttgttggttgatttggaaggatcgtaatgcaagaatttttcaacatgtgcccaagacaccggaataacttgcggaggatattgaagaggaaattgctgtctggagggtggctgtttcgcgagtaatcgccatgactgtctgcggggtttagccctactttcttttctcgttcttggttggctggggtctttccctggcaaccacggtattgtaagtcgttgtaacattttactgtattttccccccaaatcttaatgaaattggtcggctaacttttggccgacccgttaaaacattaaatgaaatccataaacttaaagttcatctattttcactatatgtcctctcaatgcaaacttagacaactatatcagtttaaactcgatccaaagcatagtaaagtgagagagtagcactatttcgttcctgttcacatccatatctttcatgaagtaacttatatatatgttgaactccgttaattaaaaattaaaggagtatataaaccggttccgtaaatatcttaaggcgagatatacagatgccaaataggtgtacagtactcgaaattacaaagattataccagtataattaatcgttgggattaagagcatgaacgacccagttacgaggggtgcacggagtacgtgtgttgcttgcgcgcgtgtggatcgacgagattcttttgcaaaaattacctaattaattaatcggcgtgctctctggcgtcgtcgatattgtttattgtttggctagagttcgccggcggcggcggcggcgaggtcctcacaacctggggaaggggcgggcgaggcggtcggcgtcggtgtagatgtgggcgcgggtgatgtcggcgagcgaggtgcatccgctgagcgccatggtgagctcgaactcctcccgcatcatccgcagcacgttcctcaccccggcctccccctccgccgccagcgcgaacaccaccggcctcccgatctgcaaacgcaattcaatccatcaagacgacgacgacgacgatgacatgtatcacgccatagatcatcggctatcgatcgaaggacttacgaagacgccggcggcgccgagggcgagcgccttgaagacgtcggtgccgcggcggacgccgccgtcgaggtacaccgggatgcgccccgccgccgccgtgaccacctcctccagggcgctgatggtcgccgggacgtagtccagctgccgcgcgccgtggttcgacacgatgatccccgccgcgccggagtgcacggccagcctcgctgcgcacgcgcgcataaacgcatcagtttcctttgtgattttgtggatttcaaatcagtcaaatcagaagaaatgcaagaaacaggaagctatcctaccatcctccgcggtgatgacgcccttgacgaggatcggcagcgacgtgatgctctgcagccacttcacatcctgcatcatcatcaacaacacacaccgtcagaatttctcccgatcttagcatcaagaacagtaatttcgataagttaatttgctggtaagtttgttgtagcatcgatgagcattgatcattaccttccagctgagcgtgcgatcgatctgcccggcgacgtaggaggccagcccggaatcgttgctctgcaaatgccaacgaaatggttcaaattgctgcatagaacagaccattttttcttcagagaaaataactgtttttttttttggctgaattaaccgaccttgtccatctctgcgaggtccaggccttcgaaattcttcagtgtcaagtatggtggcagaacgaacctgcaacaacgcagccattgatcacatcacttaacatttacgacaactcgctgaaattcatttctagatcgtgccaaattcaggtggctagttaagaactcacctgttcttgatgtcagcttccctgcgtcccagtcgcggagtgtccacggtcagtgcgatcgccttgaacccagctctctcggctcttctgacaagctgctcaaccacattcctgtccttgtacacctgtagatgtatgcaagatcatacaagaaaatgagatacgaaaataaaatgtagccaaagtatgctacatgagcagagtgatatgatatggtttacgtatagctggaagaaacggattcctggtccagttgaggcgacctcctcaacacttgaagtagcccaagatgacagtgtctgaaacatgaaggcgataccaaattaacattggcgttcatgcaagtttgaatttctgttttggtttggtttcgttatgcatccaaggaaatgttgtttgctattgaacatgacaacatgtagatagcataccattatagttcctgctgctgaagctgccctggctgttgcatactctcctgaatacatatggtattttagttagcccaattctatgcaaagatcaatgtagatcatgtgcttgcttgttacatgctaacaacttcagtttattttcagtttttgtagtagtaatatgcttttttttaaaacaatataatatgctaatgttgatggatgaaattacttttggttttgagtttgggctaaatgtaaggctgtacaacaattaagcaacataattgaaatggcatatgtaccgtcagggtgagccatcttctgcatggcactgggagcaatcattatgggcattgatatcttgaacccaagaacagttgcggacatgtcgatctttgagacatcgatcaggatgcggggacgaaacctagccagaaaaggttacagtcagattgtgggctgaaaaattaacaaatgttcaacctaaggaatgtgattgaaaaatttaagtcatttgctaaagctttcgtaggagaaagtgataacgttagatgttgtatgatagatattctgggtctgggaataagattatgattagctgagagtttcactgattggcaattttactgaactaatgaaatgcccttaactctattttgaaaagaatacgatgtgctcatgctaaactagtctacctagtaaaaagaccgagtggtcaggattggacaactagtaatgttttgtcgatccatcctacttaactatgagctatcagattgaacttgtacatggtagactcatagggaggcatttacacagatgaaatattttgatgcacaatatggcatagggaggagtagtggtgcaattaatttgtaacatgtcaagcaatcaagtaattaagaattatggcttacaagatcctggagaatgcctccctgttctccttgagagtccactcatcctcagctccagaggcgtagtagtcgtagatcatcttcggaagcttctgcttcgcgatggcctggtactccatgacattggtgatctcccccattttctcctgccttgtgaaccctgcaccgctctacacccaaagaacagcactgtcaaaagaattgagctatagctttcctcctactaaaataacaatcatctacatgcatgatgataacttattcttttttttttctgatagaacacatgcaactatgcaagtctgctaaaagttcatagcaacaaggtaaacaaaaaaaaaaagactttccatcatcagagaaaccaagggactcctttctcttggagtgcatgcagatacccattttttttgtttctgcagaaaatatgtggtattcttttaacagaaatgataaacaaaaaaagaaatcttcatcatctgtaccaacgatcaaacgacgttggaactgaacaaatataaaaaaacctctcatcactcatacaaacaagagaactaaaaaatcaatcagaaacaaagatgacaacatgcaatagatcctaataatttggtcattttgaaactatgcgtgcaacaaattcttggccacgccagaagaactattacgactgaagaaatcacgaaagaaaagatgactcaaatcaaaccgatagaaaagcaaattctgtacactgatatgcatgtagcttatcttaccttgagagacactgggaggaaggagcaagaacaggagcagggagtggtcagtggtgtttgtgcaggttatataggtgagggagagatatcttggagtttctgcacatgaagacaaagatagagggggagatgtggagatttgtgcgggagatgtgagagtaagggcagggagcaggttatgtatgagcttatgtaggttgagaggtaggatggttcctcctacattacttcttcagttgtttgatatctccattctcctcgtcttgccattctacatttctttctccgtttcgttagttaattttcaggagatgaacgcacgaaagaagtcattttttttctccagctgaattggagtggattatctccttccctagtcagggaagaaaaatgtatatataaattgttctccccttgtttagcaggataggggtgagtagaagccagaagagaacagtaggccagcaggggggtttctgttattaggtggggataagatggcaattttggtaattttgttggcatagcataggctgtactgcagatatgatgacttttaaagaccagacagatcatcgtccaacagagatggggattcagacagttatacaagattatcataacaagaccatgccatatataaatcgacacggcaaaaatacacaagagctctgagatatttaggctttgcaaccattttcaaagggcaaacacaacgcaaaagaaatgcacctgggacgaaccacgctcaataaggagagacaggtaaatctgatagatgaagtcaccggaaaatgtgtttattcagtaaggttttgaccaagcctcccaactttagctcacttcataccaggcaccacacaggctttacaattgccaagagtaccttctacaagaactgaaacaattgcaagggggtgcatgcagcgaactcttgatcggttcgcctgttgcaaaacaattagttaacccaacttggtaccaccattgcaaagcccgtgttagaactttcagttaaaaaaaaagaaagtctctttacttttcagtttaaaggaatacattatatttctgtctaccttttttaagacggtgatatttactacacagatattgctatattactagcactctggcatttccagggaggtgctttaacagcttgtttttacagagctacagatgttactagggaagagcattacatacaaaaagcattagtgattacttcttttttttctctctcattcaaatgcaaatagcatatgaacagatgtcaacagattatttctcccccataaacaaactcatcatgattctctcacaaaacactcactctgcacaaacattgccttacttcccactaccatcatcagtccagacactgtcccaggagttgttagcttttggtgcctcagcaaaatgatgccctggaccttcaaacgaagaagtttctgcgccctgaaccccacccttctttgcttttgttttgatcccaagcaagcgtagaacgaacctcgcaagttcaccataaagcattccagtccgatcacatagctacgatgaagacaacggtggatcaggaaggttataagtataaacttggatcaaattcaaatcaaattcagaagatacctgcaaaagagctgagataaacatgtggaatgcctgtgtgttctggctaaaaaggaaagcaactcgcccacaaaaattcacaacaccatgcatctgcaatcaatgagaaaaggttaggaaactgtgttctccactcccagcataccaatcacagggtaaagttcactttttactacaaccgatctttttttacttgccatttggaatgtcaacaagatcaacacatttgaccactgttttttttatatgctcgtcaacattaataaaaatataatgatataaagtgttgccaatgtttttgaaatggctacggcattctaaaatgacatttttttgagaacagagttagtaatgtatatgaggcaataaattaactacaagttagacaagaattgctacatggactttgaattccatctactaggcttcctacaatagaaataaaaaaaaatcatgaacttcatatgtaacaataacatggtgatagcaaatacatgttatggctgcaaattaagttccacagaaatttaaacgtggcaatcatgctctagtttgttaaagatcaattaaaaacaataatcggtatcaaatccaggagtgacttggtagaaaatgtgtattaccactcgcaggaaggacatccaaaaaccagggggtggtgctggtggcccaaatgaatttggaccttggttgtaagcacccatgcccataccatagccaccatagggacctcccatcccgctattatacatggacccaccgtacattccagaacttccatacatacccccataacctcctccataacttgaatacatgttatttccgtaaagtccgccgctactataaggtccaccaaacccaccaagcgaactatacatactggagccataacctgcattttgatcgagaggttaagattctgagccactaagtgtatctgattatgcgattacagaattaatgattacctccataagaatttccgtatccttgctgctgccaaggccgtgggggcacaggcctagagatggtgctgttcacattggaagcaacattgctctctgcggcagaaacaacttccccaggttttgctgtgccagaagcttcgacgatatcactagtgctacccccggatgggggcttgaaaggcgctggaccagatgaagttccagcacgttcccatggtttgggtggtggattacttcctgcaaacacattccctagtgaattaaggaattggcccaaggcctaccaggagaacaattactcttcttgtaaatctcaaaaggcaaaacagatggacacttatctatactaaaacactgatatttcaacttgacgtaaaatataccataagtttccctacaagaagtgtgcactcagacaaaacaacgtctcggaagcattaacagagaaatgatagtggataacttgcaagactaggggagaaactcataaagttatcttgcaaagataaatctactgcaagaacctggagtcacggatgctattacaatgttgattgtaagcaattgggaccagcaggcaggcaggaaataattcaatcccgataaaaactttgcaacaaatacttctagtaggatataattcgtaatcatggaagcgtacattgcaattactaagtccataactagtacacacaagaatatcacaaatgcagaatttgtgagctctgaatgattaagatcaacaaatccgattataggtcaactgaacaaatttaaacatagactgcatatttccgtatgagcataaacataataagccttcattccgcaccgtccgaatttctgataacactgcatttgcattccttacaactgagccacgatagttaggtttctcacaaattactccatttttaaaaaattagttcataaataaatccgactggaatcagttaacacctggatcatgggcccaattggatttgttccccgtcctacaaatacctattcattaccttataccctcccctgcacccaattgagtgcccaaccaatcatgcaaatgctgtcattaggatccccaaaattactgaggtgatctagcatgtagtcattgtgagaaaggaagcagtttcgttggcactacctcagcatatgctcacatctgcatgaaatcttggaataatttagaaattgaacgcatattgctcacaaacacatccaatagccaattctacggttcacaattgattagtccctaaaggacaattctacgtttcatgatcgtttagctgattagctcctagcctcctaccctaaccacagtcacaaaatccccaacataaatcaggaactcgaggaaccaaaatccccctccagaaacgaaccgagcagacgtaacccctcatgaatcgatcgatccctccctccttccttcccttctcccccggatcgagtcagcctaaccacccacccaaccggttccagaggggagaaacagcgcgaagagtcgcagaagcaagcgacgaacctgccatgggcgcggggttgcggaatccctcctccccacccccacccccttcccgccgccccctcagccgcgcgtcgccggcggcaaaatccggcgccgcttctcgatcgcgtcgccggaggaggagaggagacgaagccgcttgctattattgcaggtggcgctacacgcgtgggccttttcttcttctttttttttcttttttttttccgtttcctagttgggctcgagtcaggtcttggcgcgttgggggcgcgtcaagcgttgaccgttgactagccttcctgtgggtcattaatcttgtgttaatgggctgtgtatttggtccaaggccttcggtttaacgaggaataagaagaggcccataggagtactaaggtgggcttggggagaaaaaaccatgaaatttgtcaaccgcctaaatatttttttaaaaaaaataaatcagccatctaaaattacgatactatgtgatgaaccaaaatctaacttttttattttattgacttatcttttgtatctgaatgtttccttctttattagttttattgaattttaaagttatatgtctgggctataattctcaaaaaaaaaaggggcgaaaaagaggggacatttttatatagtaaatcaagcgatataacaagagtgattcaatcttttccccaaggatccccgcaacaaaaggacaacctttatccgaaggataagatagtcactagttcacctaacgaatagggaggtccaaaaggctaaaatgagatatactctactcattttctcattaaaagatatggaagtttaaccaggaaaaggggctggccatatgggtacccatattcatatccgttaggtgaagcctttttttttttccatactcatattcagttcatttcgtttaataaccatagtggtttatggtttaacaagcatccacccctagatttaactttatgatggaatgttgctcactatctagcattactcaataataatgatttacaaagagaaagaaatatttctaacatgcaccgtcatgtcattccagtggtggagtcaccgccgcccgtcaagcccgaatgactaaaagcgtttttttatgatcgactaattttaatatctattacatcggtggagcctggtcgatcgtccgatatgtttgggaggtggcttcgtcactatgtcattcatatccagttttctttcttagggtgcactcgttcccgcgggcaaccgctcccgccacctcgtttttcgcgcgcacgcttcctaaactgttaaacggtgtgtgtgtttttttaaaaaaagtttatatataaaagttgcttaaaaaattcatattgatctatttttgcaaaaaaaaatatttaatacttaattaatcatgtactaatggtcggcttcgttttccgtaccggaggaattatttcccgtctctcactctcgatcggggccttagcctatttcagtctatagcactgatagcgcgcgatagcgcattctggtagtatcgtaattcgtaagtgttttcttttgttgttaagttaccgtgtgattttgtaccagcctacatgtactaacatacacgaaaacactgagggcgatatcattaaagataagaacaagagaaggaggtgattgggttagcgtagcctatggagtgcattattttttttttacgccagccagtcactgccacggaatcgcacgaaaacggtcacgtgtgaaactgatcaccaccaactactgacctactgttgcgttgtgaaggtagttcgagacgtatccatgtgatgcacgtcgattcctgcaaaatccagtatatctagatccgagaaacaggcaaaaaaaaattgtatggtatacggagcaacatactccatacaaaaattgcacaattaattggcttaattacatcgcgatctttcttgcttcttcggcgtacaggagcggcagcgcgggcggccgccgccgccgcggcgtcatcccgtacgtatgtcgcacacttccgccccgcgaaatccccaatccgcgtgccgccgtgcgccggttgttattagcatcgcatccacgacgcccccaccacccgccgtcccgtccacctccctcgcagtcgcaggcccgcacgatgttgagagttagtacactttgttttagtgcattcgacttactgtctccctgcattttataacaagtttgttcttgccactatcgtttatctttacctatttatcgtttatctttacctattataaaaattgaagatgtttttgccacaaattttcgtacgtctttctaatccgattctgtttctgttttgcggcttcgtttattctgtttagccgtttcgtttattagcgagaagaaaaaaagggattagaccggtattgcaggtgagacggacagcgaaggggctgacgtcctcaatgcctacctaggcctcagcccaagtaacgtatcagcccataagagcacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagctttgctctctctcttcatttaatacattccaagtagaaaaatatgctgacatagatctcttgtagagagcctatagataaccattgtgggtgccctaatcttctaattgtgattggctatagagtatgctatttggtattttctccgtctcaaaatttaataattttagcctttagaatttattcccatttaatttcacaaattttattattaatacttgtgtccaactataaaactttttatgttttgattagtacggatgtagcaataaataaattaaactgaatttaaatttggtttctgtagaatttttcgtccatcgtcgcacacgctcacgctgtccgattccatcacctggcatcgaacgcgcgtcttccgcatcctgtgtaaaacacgcaaggccgacaaccgcaagcaatcaaacccacaagccaaatatgaaacccccgtttcaaaagttcccaaattagaactctaaattttcaaattaagatgatgaaaaacaccaaatcaacatgaaaggaagttggataaaatatatattcaaacgatttctcacagtaaatttcacctaaagtaaaacgtataataataataagattaaaataaccttcacccgttgcaacgcacgggcatttttctagtacaaaaaataaatttatcttttcagtaatcatttcgtattagagttttgtaaaataattgatataaatatactatgagtagataaagagaaaaataattatatcttgatctaataatatatatgtattaaatgggttgtttgattgatgccattttcaaccacactatttttggtaaaattgcaaaaagatataccaaaaagatatacctatatttagtttgttaccgaactttagtaaatatataagaaatcctatcattttttataatattgctaatttagtactattgataaattttgataaggtttattttgattataatttgaacgcccctgtcttttgacacgaaggaaaaataaacttgagtatactaataaacatgacggcgcccgtcttcactgacgcaagcagtgacacacgaattcgccggccggtgagctgctgcactgggcatgggttagtgtttcagttgttttgctccctaccctcgcaccatttgtgagctcatcacatacggcaacaacacacaccatcaaacctaccgagcacctgtcaggctgtcaccacccgaccattcccgaactcacgctcaacttctaacaccgtgtttagatccaaattttttctttaaacttctaacttttttattacattaaaacttttctacacacataaggtatatttggttgggtatttcaacttaccacacctcaagttagcacataccaaaagtgtggcgaacgaaattcttaacatagctttggctcaaaaatatgtggcaaagcagcaagaagctacctaactttctttggcaggctaaactatagaagcaaaacaaacaaaggataagcagttgtagctgactaacatgaggtgcggcattctatgggatggatccaaacagcctcataaactttaaacttttccgtcacatcattctaattttaaccaaacttctaattttagcgtgaactaaacacaacataaggaggtcgagtttagttccaaattttttcttcaaactttcaaatttttcatcacatcaaaactttcctacacacaaacttgcgactttttcatcacatcgtttcaatttcaaccaaatttttaattttaacgtgaactaaacacatcataaacggattgagatccttcgctgtcactgtatcatgtcctaaatgagtcccaagtgataaaggcgcgatgcagtcgaatgctgaggaatccatccattgctacctataaaagcgaccaacccactgatcgccctccactaccaaagaacaacacacaactcggtctctagttgaaaagctatagccatggcggaggagaaggagctggtgctgctcgatttctgggtgagcccgttcgggcagcggtgccggatcgccatggcggagaaggggctggagttcgagtaccgcgaggaggacctcggcaacaagagcgacctcctcctccgctccaaccccgtccacaggaagatccccgtcctcctccacgccggccgccccgtctccgagtccctcgtcatcctccagtacctcgacgacgcgttccccggcaccccccacctcctccctccggcgaactccggcgacgccgacgccgcgtacgcgcgcgccacggcgaggttctgggcggactacgtcgacaggaagctctacgactgcgggtccaggctgtggaggctcaagggtgagccgcaggcggcggcggggcgcgagatggcggagatcctccgcacgctggaggcggagctcggcgaccgggagttcttcggcggcggcggcggcggcaggctcgggttcgtcgacgtcgcgctcgtgccgttcacggcgtggttctacagctacgagaggtgcggcgggttcagcgtggaggaggtggcgccgaggctggcggcgtgggcgcggcggtgcggccggatcgactccgtcgtcaagcacctcccctcgccggagaaggtctacgacttcgtcggcgtcctcaagaagaagtacggcgtcgagtagatcggtggatgcgaagttgcagggatcgattggcggttgcgttcgctacgtgaacgattcgtccgttgtttcagtggccaagtgtgtgtgagtttgttgttaccgttgagtgcttgtgtgtgggatggttggtggcagcagagagttgcctccgattctctgagattgtcactaaataaagtttgtcctttgaaactaaaaaaagttggctttggttatgcggattgctgagtactcttatgcattatagaaatttaagttagtacgagtacttgtttagttgtttagccactaattcgggaattttctctccgtgtttctcaaggtgtcacgtgcaagaggacacacactccaaacgcctatatgggccgtgaggcccatgctatattgttgctgcctagcaggccatcacttagatttggccccatgtccacacggtgcaaggctaaaagggaaaaagctttgggaaaaaacacggtacaaacttagagtcacagcgtgatgtgcgcacactcatcttctgccacttaccgactatccttataaacacatactccctctgtttcataaaaaaacgaatctagcaccggatgagatatattataatacgatgaatctagacatatatatgttcagattcgtagtactatgatgtgtcatatccggtactagattgattttttagggagattttttagggacagagggagtatgaaaaaatacatattacttgtaaatgcaaacacccctgtctagtacatgaatgatgaatcctagttccactacaaagaacctatccataagctaatcagtcaccatactcataaaagaatctaattctaaagatgaaatatgaatatagtgtatgtcaagattcatctcctagattaggtctttttgcgggacggagaaagtacattttactatgtcctaacacacctctaacaatattggagaccaggcatcacgcaaaatgtctactccctcgcaaagtatattttaaagagagggactgctctctccgtcttaaaaaaaaataatcaaacttggactacatccttacctaggttggattttcttttgacaaatgtagtatgtagccatgtatgtatggaatttaaattcaatcctgaggaaataaacgggacgaaccacgagatgatcagatttatctcaactttatagcgcaaaccgcgagacagagagaacacaataatgccactccaataaccagaggcacatatgaatttcaattcactcgaaaaatatttctggaagggaaaggtttaacgctggctacgggacacgcttattcttgttcgaaactcacgtctcccacaaaaatttgtacagcagcttcatctaggaaaaagaaggaaattcacaagattgtctgagtgatggcaatggcaggtagcagcagcggcagggtgttcatgatggccaaaaaacagcatagcagaacgatgacccagctaaaagaacacgggcagtcatcgcaataaacttgtagcagctccccacggtgagctcttgctggaaaggtgacaacaattaatctgatgatgatatcttcagttcctgcaggttgacagacatggtgatgagatgcaaaattctgtagtaattaattactgtagtttgtactgcaaatgctactggtaagaaaattgtattgtaagatgtttcttgtagatgtcaacttgtgtagtgatatgaggacacctcaggcattatgtgaacagaaattaggatgccattgggggatactagtataataagatgagaatatttaacagaattatctaaaaaaaagaatattgaacagatgatgtagagtgacttgccggcagcttttactgcacacaacgaacggggggaaaagaacaactcgtgtctgaagaaaaatgaactcattttcaatttttgaaaacgttcttcatgtttggaagttggttgcagtgagaaccatgccagcatacagttaggaacggaacatccatcaagacctgaaactgtactacctccctgactgtttgtctctcagactacttcaatttactccctgttgatgagcatagcagtcacgccagaaaaatgtactactagtacttctactaaatagagtattaccttaatctagatgcccagcaagaaggtgtccatgcatacactgaatcaaaacatgctcctaattaattggctagcaaattaggaggtcagctgtctaggattttctaaacaatactactagtactggttaagatttgagtatgatgttttaatacttaacaatggtcaggtttgcacatgtaatcgtgtacactacctggttaggtcccccaccaggaacactacccatcagccaacatttttccaaatggacctgcactagatagtgcgaagttggaagtttgcaacatttgaaggaaaacaacgttctatccataagatgcaaggtgcctagctcactttggaagcttgcaaagcccaattaaaggaaaagcacaagagatacataagtcctacccttttcaggattttttttaattgattttcatttctaacactggtttgacaggctctaatgccaaagcaaaattgagctgaactttggttcatatatatcaagctttagttgagaaaatttgtatagaacaagtgtgaattgtgatgatggaataaataagatcaccaaacaattataacatatcaatagaagactatctaatactaccaaggttcataaagttgatcattcagagctgtactaactctatcttttcttcagataggagaacaagtactactaactaatcatgcacaggtagaaatgctttatggtactgtcaacactttcaaatatctaatgtcttttatactccaggtttccattatcatattcagagcaggcatacctctgttagtactaggaaaaatcttttattatggcatccttcttaaaaactaaggctgtgtttagttcacactgaagtttggaggtttggttgaaattggtacgatgtgatagaaaagttgtgtgtgtatgaaaggtttgatgtgatggaaagttggaagtttggaaaaaaactttgaaactaaacagggcctaaagtgggtctcactttactaaaatttattgtttgatccacaacccaccttgagatgttatatgctatatatgaccataaagtttttcacttctttaatttggcttttatgtggttgtaccaaagtgtcatttcaacatttcacttcagaaaaaaaaatatcataaagcactgttcctttagacatatagagcatttcttcaatttctaacttcctaattaaaccaattactacttggctaagtactgttcatcatgctttaataatctactagaactggtaagttctagtaatgagtacgcattgcaatgcaaataataaatgaaacaccttttcttactgtataaagatctcacttattttccataattttcttagaaggaactcttgtgatttgaacagtaacttgcttcattcaaggcttgctgcatatattgtcatacgaacagtatatacagcttgccagttcatgttgatgcaattcatactattaacttcgatcctttttccgtgtataatgcgacgtagagtagatatggcttcctacagtttattgcattaaaaatgcaaatccgtgcaactcagaacccatgtgattggcctgattcctacgaaatccttcccccagcgatgagcaatcgacacctgtttggcctgaatccatgcaaagcaaaatgcaggtatcccgcctcgaaagtttttggggacacacgtcgaatgcaacaaaagagtttttagtgggatttttcagggaacgaggccacctcgagcggcttccaagaagattgcaatcgaatcaagatgacgaaattgcgcgaacattagtcttagattacgaaatctagtctcttacctttggaggatgcgttgctgggatcgatcagttcttgctcttctccttcatgccggagtggcggaatccatcccacagctgcaacgcggcggtgctggtgatctggccctcggacgccgccgggtgcgccgccgcggcggcgtggccaagcaggaaggaaatggtggagccgtccagcctctggagctgctgctgatggtggtggtggtggtggccggacatgttcgacggcgaattggactgaagggtccccctattggcacccaagaaacccgaggacatggagaagttgaggttgtagtcgcctccggcaggaggcggaggcgccgccagctggtcctgggcgagcgagtagtgcgccgccatgtcggcgccgggggcggagaagttgaacggcggcgccggcaccatgccgatcggtggcgcgtcgccgaagctcgaggcggcggagaagccgtacgtggacgccccctccgcgcctcctttcccggggtgcgcgatgcccacgcagtcggcgccgttgccaatggcgccaccccccgccgacgacgccgccaccccagcaatgagcagctcagtgaacgacgcggcctgcgccggggcgctcgccacggtgacctccttgtccgaccccttgctggtctccgacgtgctactgcatccggacttgttgctgagctgctgctgctgctgctgcgaacgccgccgcgtgggcgcggcgtcggcggcggcgtggggaatggcggcgaaggcggcggggtcgagggacgggagggtgtcgatggcgggggaggcggcgttgatgagccactcgatggccttgctcggctggtcgaagccgaggcggtcctggaggtcgtagaactggatggcggtggcgacggagaggcggacgcggcggtcgcggattcccttcgccgtgtacaccttgctgtgcctgtccttccccc

SEQ ID NO: 21285 - DNA, 48932 bp, Oryza sativa
cgtcccccaccgccgcctccatcccgaaatgcggtgaccggggcgggcaatgccttgttccgcgagagaggctccctttttttccgcggtgtttttcgcttgcttttgtgggtgatttttggcctcgcctcgcacgcgcgcgcgctctctctcgtcacgcgcgcgggccggcgcttgctgctgctgctgctgcctgctggctgcagctgtgccgtgcagcagcagcggaagtaggctttggagtggcgcggcgtgtgtcagatctgcctgcggcggcggcagcggcagcggcagctcactgcctcatcactggtgtagctgtcacctgtcagtggacggccttggggaggcgccgccgccaggctacggcgttagcgggcgggataacgggaggagaagggggttgggttgggtacttaggttgggttgccgatcctgccccttctccgaggatgcgacagctgttactgcatgggagggacccaaggggggaggcaagcagtggatgctcaattcctgcacgtattacagtgcttgcttgttcctctaacgtggagcgcacactttttttggagacatatttactttgacacaagttgggcaaccatgctactacattcacaatccattagttatgatgtggagatcaattgtagcctagcttaaattcctagacaaagattatgcatttggtaaagtaagattgatctactggttttaattttttgatctctagcaagcctgcgttgcgagaaaattgtaggggtatagatgtccgtaagtattttgctcccatttcgatagtttggcgaacataggcacgaattaactgctactgaaatctaacgactagcaaggtttatcattgttgtagcttaaccaggctggaacgaatctcgccgtctaaagccatgagagatatatatcgaaacgtacacaagctcactgtcgatagaaatcgaaatgtgcaagctcactaccgatagaaattgaaacgtaccagctcactgcatatagaaatacaaacaaaccttgcatcacgtcctaaataagtgattttttttgcgaatatattttaaagcgtttgcatgttcctctttctatccgagtgcatcccccactctcttgcttcttttcctccctcccttttatagtctgttaagtcgaatttagttcaaatctaccaaaaaatttattaaattccaaatcatcaatgttaattttgggccaagccagtgttgcaagaaaattatagtggtatggatgttcacaaattttttgcccccgtttcttggccgtcgatagtttggcatatataagcaggaattaatggctactaaaatctaacggctagccagggttatcttttctatagcttaaccaggctggaacaaatctcaccagctaaagccaggagagatgtacatcgaaacgtatgcaagctcgctgccgatagaaatcgaaacgtgccagctcactacagatagaaatacaaacaaacaagttatcttttttttgtgaaaatgctttaaagccgttgcatgtttctctttccctctgagtgcatcccctattctcttactcttttcctccctcccttttataactcgacaagtcgaattcagttcaaatctatcaaaaaattgtttattaaattccaaatcaacaatgtcaattttgggccaaaccccaactcacctcctcctttttgggtccgcaacatggcccaacccactagccgctacccacctagcctcaaactatgttgatactaggctccgattaagtgcttgaagtaccacctcagtctaactatatgggcaaaatttcttatattatggggacagaggtagtattgcccaagccagttgcaaccatgtcgttaggagttcagacaccatcatgttgttgatgtctccttcttccttgacgccatcatgcttggggagggtgccgctgcgaggatacggtgttagcggcgagtaacgggaggtggtggtggcttgggttgccaatcctgccactctccatggcgcatcgaggatgcgacaactgttactgcatggaagggaccaggggggcaaacagtggatgctcatattcctgcatgtattgttgtagttgcttgttactccaatgtggagcacacacttttttttgaggtgtgtgtgtgtgttgtggggggggggcacatttactttgacacaagttgggcaaccatgctactacattaataatccatatatagtcatgatgtggagatcaatggtagtcttaactacctagacaaagattatgcatttgctaaagtaacattggtctactggttttaaagtcggttatctcttgatctctagcaagcttgtgttgcgagaaaattgtagggtatagatgtctataagtattttgctcctgtttcttggtcgtcgatagtttgacatacataggcacagattgactgctactgaaatctaacgactagcaagatttatcttcactgtagcttaaccaggttagaatgaatctcgccgactaaagccaggagagatatatatcgaaacgtatgcaagctcactaccgatagaaatcgaaacgtgcaagctcacgactggtagaaattgaaacgtaccagctcactatagatagaaatacaaacaaacctcgcatcaaagtccaaaataaatgatttgtttttgcgaagatgttttgaagcctttgcatgtttctctttctcttcgagtgcattccccactctcctgtttcttttcctccctcccttttagagcctatcaagtcgaattcagttcaaatctaccagaaaatatttattaaattccaaatcaacaatgttaatttgtgggccaagccagcgtcgcgagaaaattgtaggggtatagatgtccacaaataatttgcccccgtttattgggtattgatagtttggcgtatataggcaggaattagcggctactgaaatctaacaactagcaaggtttatcttcactatagcttaaccaggctagaacgaatctccctagctaaagccaggagagatatacatcgaaacatacgcaagctcactgtcgatagacatcgaaacgtgccagctcactgcagatagaaatacaaacaaataagtgatctttttttgtgaagatgttttaaagcccttgcatgttcctctttccctccgagtgcatcccccactccattgcttcttttcctccctccttttacagcctttcaagtcgaagtcagttcaaatatatcaaaaaatgtttattgaattccaaatcaacaatgttaattttgggctaaaccccaactcacctcctccttgttgggctcgcaacatggtccaacccactagccgctacccacctaacctcaaactatgttgataataggttccgattaagtatatgaagtactacctcaatctaactatatggacaaaatctcttacatgagaggtagtattgcccaagccagttgctaccatgccattaggagtttagacactctcatgctgctgacgtctccttcttccttgacatccctcatcgctctcttctatctaaggtgttgattccctcgtccttcttcattttcatcctctttcaatctccctacaccaacacacagtcaagctatcattgtgttcaatttgagtgacatcaaagtcatcttcgattgtgttcaattcctggttacatggattgatattacacatatgaatatggtaggaataattcgattggttttacatcttcctagatatacatatgaatgtatatgattctcatggcatgatatatgtgctcacatacacgcacacacatacaccgttatacacactcccacgcctacacacatatgtacaaatactaactagatatactagctatagcaatagtagtaagtattttttttacataataatagtagtaagtaattactccatccgtcccaatatgtagcaatttaggatggaattagacccatcctagaactacaagtctaatcccatcctagctaggttgctacatattgagacggagggagtatatatattggttaattgttatacctactgtcccaattgtcccgcaaactatcgttttgtgtcattgtcacaatgtagccgtagttgtgtgtcactcgaaaatgcactacacttttaccggatcaggttaattgtgtctacttctgcctctcttaggccattcccaacctaagacactagacatagttttcataaactccacatcatcaagaaactagtactagacactactcttccaatgcaaacaccactattccatacttaaatttaatgctacctatctcacatgatgtcttggatgttgtgtagaaaccatgtctcatgcaagacatggtttccttctctttcctcatttattcacttgccatatcatttttcatcctatgtggcagcttatttaatgttatggacatcatcctagtcattgggttgggaatgaccttagagcagttataatagcagactattagccagctacaaacatattttaataagataaaagatgagagagaagaacagcgggctacagatctgtagccagctacaacacggactccaagatacaatgtgtgtatgacagtgggaccatatactaatagtatagtaagcaactattgtatgaattagctattagattagctatagataaattgaagttagtagttagctatactattaaccttgctcttatgactttacatgagcaaaggtacattgcttgtatcgttgtgcgctaccattacataataataaacctctaccatgttttgtgctgtattgtttcgctacgaggttcagatttagggtgagttggagagataggggattgagaaaattagaaagatacgtaaaacgagatgagtcattagcgcatgattaattgagtataaactattttaaatttcaaaaattgattaatatgattttttaaagcaactttcctatagaaattttttgcaaaaaacacaccgtttagtagtttgggaagcgtgcatgtggaaaacgaggtgttttctcaccttatctcacacaaacgaacgcagccttaaatgtgagttttggaagaatttatttgaaaataaaaaattaaaaaaagccatgagccactaggaccctgacatttcatgttcctgctacgtcaaatagctgctcgatcagtagcgaacctctccttttcggtgctttttaactaacggcgtggcttgagctgaatgaagaaagaaaaaaaaagacggagtaggactagtaattgacaccatcattgacgacggcgcggctgacaatctctgggaaaagggcacaccgcacatgtcgtttcagaattcagttagacagagcctgccgcctgcagttattgcgcaccttttccttttttttaagacctttttttacgatagagtggacttttctttttcgagcaatttctatgagcctactacttcgcggctaaccaacacaaccctggttgcttatagatggtacttcatacgtcctaaaatataataacttttattttttattatatctgtttcataatataagattttttaaattgctcacacacacatatatatatatgacactcatatggggcaccatgatatctaatgcataaaatcacttaaatttttcataatttttaaattgtgagtatatacctagttataataattcgattcatacctatacctatcaacaaaacaactcaaaattaactttatttcacaatccatgattgcatacctaactaattatatgtatggatgctatatacctagaatcaaaatctaaaaaaaacaagttcaaatttgtatatatatatgtgtgtgtgtgtgtgtgtgtatatatatatatatatatatatatatatatatatatatatatatatatatatatatatatatatatatatatgttaatgaatctaaacaaatatgcatgtctagattcattaacatctagatgaatgtgggcaatgctataaagtcttacattgtgaaacggatgaagtaaaatttatcataaaatataacaaattttccatctacattctcttcacaaccaatcacagcttttcaccattcacttctcccacatacattcacttttaaaacttatccaattacaaccctccaccactcatttctacatactttcttaataaccgtgtctaattctaaaacttcttacattctaggacggagggagcaataactagtagtagcaatactttatgtgtaattcttcttctttttttagtgctacatgtactaaaatttcttacaaactttttactaatagaaatctaattcatttgattgagttaactagaagttataataaaaggttaaagattcaatcacaatgtgacacctcatatgtgtaaaaagtttataaaaatagtttagtacgcatatcgtttcccttctcctgttagaaagcggggatggttaaaattgatcttcataggaaataaatactccttattagtactaattattccatacatggatggtaattatgtagaaaagatgttgcgatggagctctggtggccacacaacttatgtggagttggctccgcgctgcgcttgcgcatccatcacattgttcacatggtttcgctctacctgtgcccgatccggcctattgccatcaaaaaaacaaaggaagaaaactatatgatctgcggtaggagtatgtcaaaaaaccataattacaccttgtttagatcctacctcaaaattttacaccatatcacatcgaatgtttgaacacatatataaagtatttaatatagattaaaataataactaattgcacatattgcgactaatttgcgagatgaatcttttaagcctaattgctccatgatttgacaatgtggtgctacagtaaacatttgctaatgatggattaattaggcttaataaatttgtctcacggtttactgacagattctgtaattagttttttagtgtccgaacactctatacgataccctatataatattggatgtgacacaccaaaactttacaaaggccgtgtttagttgcaaaatttttcttcaaacttccaacttttccatcacatcaaaagtttcatacacacacaaactttcaatttttccgtcacattatttcaatttcaaccaaatttttaattttagcgtgaactaaaagacatcccacctttaaacaccccctacatcctgcacgtcctgcgagtccgtgacataacagagtactgtaccctagttgtaggagtagtacgtaggagtagattcttcagagggacagtcgtacggctcaaagcaagcactgtatgaatagcacggacaactgacctttgaacaacgtaccagtgattcagcacaagttcccactgtatgcatggcatgcatatgatacagtaagatgaagttacagtggcaagtttggcctatgtgcatactgtagatgcctaaacatcgagaggttgcaacaggctctaaacaaaactccgttttgtatcaggtaattagactccttggctggatagtataaataaattgtactactaccttgtccgaggtgaaaacacaaacatattagttggtgaagaaacaaatatagcgattttatacaaaacaagaagcacagaaaaggggaaaataataataataaaaagcagcagataatatgaaaatagatacacaatggagacgaattttacgtgaaaaacccttgcggaaaaaaccacggacgctgattggcaatgatcactattgaggagttggatacaaacgcaagagatatattgggctgtcccaccctcctcatgcatgcggcttacaagggatatatatataggagaaatctaggagtcctaatagacaaagactcgaagtcctgataggaaactaatccgaatatattgtgggcctaaaattcggatcacatatttaacggcggatgatttgatagttttttttaatgaaaaatgtgtcacataccattagaaataagagaagacaactaaatactccaacaattgtaagggatgctcgagcataagaggtttctacttatcatgactaaagcaaggttgtctgtcaaatcagctataaatcagtactctctcgtctaaaaaaattctaattatgaatctgaatataaatatagatttatagatagaaatttgtttttcatagtacggagggtgtacaacataattattgttcacatgtgaaggtcatttgaacaattaaaggagatcgtaagagctcgtcatatgagcagcaagtcagttcaaaagtatggcatcatagcatcatgtcgacaatattgaatgaaccagttgaggcgttggtgtcaccgattgatgcttactctgcacctgcgatatgtgatcttcacgcttccacacatggaattatacaacaatccaatcaagtattagtagtttgaagtgagcaagctcacacactttttcaaatacgagtagaaaacagataataacttgatgagaaaggttaggatactccctccttccctaaatgtttgacaccgttgacttttttaaacatttttgaccgttcgttttattcaaaaacttttgtgatatgtgtaaaactatatgtatacataaaagtatatttaacaataaatcaaatgatagaaaaagaattaacaattacttaaattttttgaataagacgaactgtcaaacatttttaaaaaaattcaacggcgtcaaatattttgggacggaggtagtaagtatatacggagctttcttctcgcttagtaatgaccagtgaagttcatgaattctcggacccgcacaattgtcaaattgttcgtgtccttctcttgaaatccaagtcaactatcatcttcgcaatgaagaacacacattcatacgcgatcactaaaatagtatggcactcgcacatgtacaattcttgttagaatgcacgaagaagccagtcaatcttcatcagcacttccaccaaatgtttggatgaactcaacactgctacttatactagttctttgcatacgcacaaactgtgtgcattttctttaaaaaaaaatgaaaaggcaaagacaaaattgtcggcctcgaaaccctctttcttaactctaaatcgcggtctgcatattaatagacaaactaaagtctataacatatacaaatacaataacacacctagaattatatagcaatcaactggcgtgagggacagcggcaagagtaggagggagatagcttgtgaaatcgcaagccatgacacttggtggctctggcggtagatctatggagtccaagtgtaccggttcgacgtcgttggaggaggagaggaggtcgtcgcagcggcaaaacatgatgagaaattttacggtatattgtactgcaagtatatactaccagtatatttgatctaacggtgtaaattaatctgatctttctcaaaattattctgcagtataaattaaatagagtatatttgtcttttcatctatttgcgtgggggtaattttataaattcgtatttcctcacttagtcagatctgatcgataggcgcccagtcaaagccgccactgggggaccgtgccataggcgcgcagctgcgatagctcgcagcagcaagggcagcggggcggtggtaggtggaagcagcagggcggcatgcggcattgcggcagcagcagggcagggaagcctggcggcggcgatagactataagtaatgcacaaatcacaaattaatagttctactagacaaggactcttgtctgaccttgaccaccataaaagttcacaagtaaaccaattcacaagtgtttgtagagaattagacttgttaacttaattacttcgagttgaactaattagatagagctagataggtttaattattgcttgtgtatccattttcattgaagcggatgaagcctgaatcatcaaacaagtctaatgcacatatacagtagttatatcttgtcacgggctcaggcttaacactcaagagaacttatatcgctagagactgacggaagcaagttcctggaagcggacagctgctgctgggcccgacggcggcgatagttctacgcacaacaatggcagtacggtggctttgctcctggcgaagactgtcgcttccggctccggcggcggcgacgacgtcgttgcgtacgaggagccacacgcgagacaacgtgaaggcagctgccgactacccggcgtaccgcgtactccctccataaaaaaaaacccaatcctgggtttgaactccaagttcaaactcaggattgggttttttttgggacggagggggtagactggattgatatcacgaacggatgacgagatccgaaaaataccaccgatggaaaataaatcctgttggaaaaaatctcaattaaaaatgactaaacaacccctttcagatttttaacaataccaaatctaccctttcatatactacaaatatatacttccgtaaaagtcctcaaacaggataccccacatgagatccacccagaaggcgtggccatcatcagacatgaaggccgtgtcaacgtagaaccacttatcgaccatccactcgccgggaaggtttggccctcttgatcatcttccacgacgggagcgacgacaatggccgccattggtagacaacatctggccagctgatcaccggcatgtcccccggcttgtccgcgggtttttcttccactgccattttgcccagatacgttagagcgtagtccccttcatcatcatcaatggcggtggtggtacggcggcgcgtgacgagcatttgagtggtatggatcgtcgctttgtggctcgataacatcgggatcatggagagggactcgtcgatggtgtcgtagatgaggttgacgccaacgatcctcttggtgaagttgaggtagaacacgatcaaattcctgtccatggtggcgatgccggagacgacgccttgatcctctcgtctcctcctcccagcttcagcgtgaggaaggatagatttggcgcgtcggtgacaagcgctcggagcttgacgtgacacatcaacgatttggtgtcaatgtgatcgccgaacatgttgtcgtcgaatcccaagatcacttggtttcacaggggaggtccggggtgaatggtgtgctttttgcgaaaattttctatacgaaagttgtttttttttttaaaaaaaccatattgattcatttttttaaaaaaactagtacttaattaatcacgtgctaatggatagcttcattttacgtgcactgcagattaactgggaaccacgaggaatgaacacagcctaatagtcatgatcgaacagcaaatttatcctatgtatatatgtcgaaacatcgacagactgcaacagattctaaacaattatagtccttgaatggattataaatatgttctaccttgttttaggtgaaaacacaacattttagctggttaagaaacaagactggtgattttatagtacaaaacaagaagcaaagataaggaaaaaaaataaaaaatgagcagcagaaaatttgatggttttttcaatgaaaaaatgttttaggtgaaaacacaacatttttagctggttaagaaacaagcctggtgattttatagtacaaacaagaagcaaagataaggaaaaaaatttaaaaaaaaagagcagcggaaaatttgatggtttcttcgatgaaaaaaaaaacgatgctataaatatagacaagtcatagaccattaggaataagggaagacaatgaaatagctttgttgaaaatgatgctcgagcatgagaggtttctacttatactaaagcaaagttgtctgtcaaatcagctataaaccagcacagcatatttgttcacacgtaaaggtcatatgaacaaaggagattataacagctcgtcatatgagcagcaagtcagttcaaaagtatgacatcatgtcgtcaatgaatgaaccagtcgaggcattggtgtcgcccattgatgcttatgcacctgcaaaatgtaaccttcaccttggtagaatcgccaacttccatagttcaggcaagtatgacgtgagaaagctcacacatctcccagaagaaaaacagaaaagttgatgagagagattgggataagatggacctttcttcttgcatagtgaagctcatgaactgaggaaattctcggacctgcacaactgttaaattgaacttgtccatctcttgaaatccaagtcagcttttatcttcacaatggttagactggacgatggaaataagatatgggcagtagtggcagaaaccttatgacaaacgcatttatactatacatggtcactcaaatagtatggcacacgcacatacaattcttgttagtttgttttcttcatgagcatgtagagagccaattaaaatgcatgaagaagccagtcaatcctcatcagcactttattatcccaacataccaaatgtttggatgaactaaaaactgccaattataccagttcttttcaaatgcacaaattgtgtgcattcttaaaagaaaaggcaatgacaaaattggttgttctatttgcactgccacgaaattcagtctgaactctatgttatcatatgaaagaagaatagtcttggttttacagggaaacaactacactgtatttgtcaaatgtttaccttacatatcgtacagttatgtaggcagcttagctattgctgtttggcctattccatgataggtaattggcatcaccgtgtggcctgcacattattcaaaacatgaggaccaagtctagttaatagacaaactaaagtttacagcaacacacgtagaattatacagcaatcaattggagatttttgtttattgatgtgcgcatgtacagattacagaacactccagacgtatgtgcagaggaagttaagttattaatgaaaaataaaaaaaaagatcaagaggaatatttattgcctggctccgaaagaaagatggtaacaccataaattcatacaggataaacttaaaaagtaaaccttaataattaccttggatttttcacgtgaatcagagcaaagagaatggttaagaaaaggctcaaggagccagtgataagatatgcgtatccaagaaagtcattcttgccacctagccaggttgatgttgtaagaattaggcttttcttgccgccaaaactgtaggtattgtaattgtttgctatgtgcatcgtaatgatttcatcagcctgtagatcctcttcaatgacaccatagagctttcgaaattggggaagagcagccgtacgcatccacactataagatcttcctgctggttcagctggcagagaaacaagtgttttgctaatgacaaaccaaaaaaaaaaatctgtgcatgattaagttataaacaataattgagatatacaagtactcactggtaaagcagggtcaagttttcctcccccaattaaggatccattctgaaagttaaaaggatatacatccttgccaaacttatgctcccggtcacttttccatgaaatattcttcctgttgacctttatttccgtggatccacaggtaaatccataagtgtcattgaacaagctccaggcaatcaagccacatggaacaattggaaggccatcattcctttcaataggatcacatgaactatgtgtgtacttctgcccatagcgtagttgcttatcacttctacttttgacatacctgtcagcatcaacaaattccattgttcgttaataatacacagagattctttttcagaaagagagagccagatacatcgatacaatgacaggaaattgaataaagttgtatcatcagttcatcacctgcgatgattctggtagaagttgtcgagttcataatacacataaattggtgctctcataaggtatttaacctgcaaagatacacactatgaatttctggcccaattacacatgatatggacaggaagaaacagcaacatgatgtaatctgtgcgccaaaaaaaccctagataattataatacaaataaaactggagagaaaaatcattatggaaaaaagggatgttagatctcacaggaataccttcacttcttgagtgcagttctttgaaatcgagctatctttaatatacgcctgcctatttcttttgtaagcattaggtacacaatcaatatcataacggtgagcaatttctgcaacctgcacacgcagaatatggagaacttagtgtgtattagtatgatccaccaactgatggtagttcaacatccaccggacagaaatgaaaaacaatttacatgatttgaagcatgaaggcaaacaagcccaacaggaacaaaagtaactccgatcatcaagaaaatagttatcacctgaaacaacgaaggtaataccatattatatacattaaacaacaaattaaattctgtagaaagcatgtagttgagtcaatgccaacttacacatcctggtgtcattgccggcttccaagctgggaggttctgctgagtgaacctatagaacactgcaaaaccaacacgattaactgtatgaccatgtaataaagtaggatttgcatatataataaagaagcaaataaaattaaatctgtagtctgtaaaacaaatcattctctcatcatctaatatagttcatcatctatgcgaagttcagcaagcgcaaataaatacaaaatactgcctaaaatgcttcaattatccatatttacatggtttaggaggaacgatagagatagctattcatttcccctccgccgattaacaccatgctaaatgacgctcgccaaaattcatatgtaagtatcatgaacacttccagcctatgacctcaacgacgccagatcgaagcgagcccgtcgtcagagctaagctacgtgtacggactcacctcccgatctcgccggcgggaagccccgctgcccgccgttcgcggcggcccccccaccaccggacgccgacgtgctcgcctcctccatcatcccgccggcaaatccccccgccgagtcggctcgccgccgcgggatccgaatccggcgagagaatggcccgaggagacttcgcgagaggagacggagctagacgagacgacgaagcgagccgcggaatctgggcctcctcaacgtttgggcccatgtgatctcgattaaagcccggcccatctaagtgacggcgtgaggtgtgagggtttgcgattgacggcgagggctaacggctgtaacggccggggaacccaactctgcctctgcgcgtcgcggtcggggaattttttttttctctcccaattacgccgcggcgaggaggagaggggcggcgacgcggcgcggcgagggggagaggtgaggagaggagaggggaggggagatgcgggaggaggtgaggagctcgtcgggggcggcggccgagccgcctcctacgccggttgcaaggtacgatcgcgggggggcgctcatttttggcggtagattcgcaggggtcgcggtgggcgtggtcggtgaatcgggctctcggtgcttggatcgattgtgtcgtggttgggttctcgaggtgttcgttggatttgttactggggcggcgattgctcgaagggattttggtcttgtgtacggcgagcgtagtgaggcggtgagtgtagatgtttggttaaaccctagggcgggagcgagctactggcctgcatccatcacggttttgctctcgggcgagatatatatccctctaggtggaaaccgggcgatatttggtgagttgatttagcgcgctgtctcattcatggtaagtaggagttgcttgaatgccaattccaaatgtatagttggaaaattttgatcttgtgtacggtgagcgtaaggaggtgcggtagagtgtggatgtttggttaaaccctaggacggaagcgagctgcagatcaggcgatttattatatcgtggttttgctatccgacgagatatttttatgcgatttttggtgagttgatttaacacactgtctcattcatggaaagtaggatgacagagttgcttgaattctaattccaaatatatagctggaaaacttatgaactggaaatggtgggcgggtattggatgactagagaactgcaactccgggagctcttgagccttgcatgggcacacttaaactcatgtttttgttatgtttctcagttctgcaggaccctcgtcacctgctatgcaagctaatgttgccagcatagattggtcgggtagcagacaagcttccagagttgattcctcatcacatgttgctccgcatgcccatcagccttctcatagtttcgatgccactggaactgctttggattctgcaccgtcatgtaggccatgggaacgcggagacttacttcgtcgactggcaacatataagcctacaacttgggcttctaggcctaaggttatttattccctcaccagagctattagtataacttacttctgttgttaatggtaggaagacacagatggccgatactttgagggtgatgtttttgctttcttttttttttgttattgtgtattatagtgaaattatgatcatggtaaatcaacttatatgcatagacttttcttcattcgtgtcatttataataataattttgttgcttgcaaccccatctttagcccttcagcttataagcataagcgaaaatttgaattttaaaacataattttagagttcatattgggtttttttcatcttagtttattttccagcatctgcttttaaagcgctaagattacacatataaaagttttacccataaattattttttaatcactaataagctgtttgcttataataagtataagcggaacgttgaggctcttggatatattgaaatttgactctggttcatgtctcttgtgcttgttggaaatgcagttttttttattgtatatattaggttcaaaagaaattccggtttccatctgcagtatttatttttgaggaatattctatactcatttgaccacactttaagaaaaacatgtattgcaggctgctagttctttggcttgtgctcggagaggttgggttaacgttgacatggacaaaattgaatgcgagtcatgtggtgcacatctcatattcagtacattgacatcctggtctccagctgaaggtatgttttcagtaactaagcttttgtagacaatatgttagtttgaaaagtttctgggggatattatgtgtggtttaccaagtttcttcaggcttcggcatcttttaatggtggaaaacaaatcatacaacatttttattttaaatgcccatacctaattagagagcataaacttctgaaaataagttgtatgtcttattacaattcacatggtttagttatgatgtaatgccttaaccatgccgtgactagcaacacatttatgctttctggtttgtgcatttgctgatgtgaatgccattcactgtagtcaaataataccattataaaattctttgtgcagaactaatcaacaatagttgaaaacttgtgaattgtgatggtcataaaaaatcggattgcctttgtgaattttttttgagaattatttatttgccgttcatagtttatgggcttccttatttgcctaccaaatttgactgttcctttatgtgccatggtatggaattttacatcttctatgtgccactgccgtcacctcaggtcgaaagctactgttaggggtggaaggcttgtcagtattttgataaaatccccgatctacccctggcctacctgtcaagtgtcaacttctattcctctctcttattattcttcctcttcctcctctgcttttctccgctgaccgctgcctcaacccgcatcactctgctggcccttctccatgtggatcgccagttggtgctattccagcggggagcaggggaggagcttgaggcgtatggttagcaaattaaggtgggcacatggttcaacttgtctcctgctgtgcatcaggtccatttcaagagcgtagagtacagctcgagtatctcgatctcatcttctttggtttcacgtggttgttgtcgatctgcttggccctgagctcatggctgatgcagcattttctctccttggccatgccactacccttgctataatttcattgattgtaatttgattacatgcattcagtggctgcatttactttattacgaggtgattctctgtaaattagtgtctcctatttgacgcatctgttcatgtcccaagataaattgatgtctccttattgacgaattgtttggtcgtaatttctccccatctcagtttgtatgtgtctccatattagtggatgtgtccccaagtagcgttactcactgagcactagctcatggtgggaaaactggtttgtgggttctttgctgtcgagccatactgtggagaagtcggtatatcttgtggagttcaaaggacaacactacgttcttcgtcgatttgccctcaagccaatcatcagacagggagaagagatcaagggcattctagtcttttccatgctctctaaatggcttgctcacgtaactggagtgccaaagggagggtgagaaaatctgatctattggcataaaagaaaataacaagtttcagatgacataaggaacttggggggttacagcggaaaacaaggattcatcttttcttttgttgcatgaatctcatctttacaactaagtcatatcttgaattaacacccaacattatgtcaacaaaggaagtaaaatgtcattacgcatcatcaataaaactctatgcttagtattctactgcataacaagtctgactgatgttacttatatctcaccattgtgctaggctggaaaataaattggtacctctccctttgcaaactgaattttgctcagctatgaaacctttctttctatgttctgtattagtttcaaatgctggagaagcctttgccgagcagcttgatgcatcacaccataatagctgtccctggagaggcaatagctgtgctgacagcttggtgcagctccacctaacacaatcagcccttattgggggttttaaagatcgatgtgatggacttctgcagtttacttcccttccagtgattgcttcatcagcaattgagcacatgaggctgaccaggagttcccagattgaccgcttattatcccaatcaattacctttttatctggagagcttagttacaaagcagagagcacaacaggaattgatatccagcaagattcctcttgtagctactcaaaagtatgtttacttttcttccatgttctcatgtgatgtcttggttttggcattattagtttacaatgactttggagactttagctttcgttgatataacttctgatttgcttttgctttctaggctaggaagcttataagcctttgtggatgggagcctaggtggcttccaaatgttcaagactgtgaagaaaattcaacccactcagctaaaaatgcagattcggtggaaccattttttccccgttttgctgaacatcaaaaaaattcattctctgggtcagccaaaaaagataaaggaaaaggcaaaaggccactcaaagactctggatgtagcatgagatcacctttgttagattgtagcttttgtggctctacagtcaagatctgggactttagatctgtgtcacgtccttgtcgttttagtccaaataacattgatgcacctgaaacaggcaagaagcttgctctgacacgtggaattagcgctgccagtgggatcaatgaatgggttactgatgggatggaaagagatcctgctgaagggcgtgatgaagaagcaacaaatgagggtaaatcattatcaaatgctggagtggacctgaatctaacaatggctggaggattaccatcaattcaatcttctataccaattgcatctgagcgtttcaacggaggattgggaagagatctgatgattggacaacctactggaagtgaagttggtgatcatgcaacttcatacgagtcccgaggtccaagctcaaggaagcgcaaccatgaggaaggtgggagcacagttgacaagccacaggacaggcttcagcatgctgatagcatagaaggaagtgtgatagatcgtgatggtgaggaagttgatgatgctgcgcaagattcggacatcccgaataaaaggtcacgtgggtttgatctatttggttcctatcttccatcttcttctggagctggtcccagtagaaacttttgctttgatcctgatgcggatgctggtaaattcagtcatgctagagctgcaggtctagccgctgttgacagagattctatgagggaatcttctgtagctgcaatggatactgttcatagtgctgatgaagactccatggagagcgttgaatactatccaggtgatggtaatgatattgacatgccctcatctagtgcacacagaaatattgaaatggatgatgtcttgggcctgaactatagtaaccaagcacagcaaagtgcatgtgtacagcctgcttctggaagtgatggaagggaaataggaggaagcagtacaaatgaaggggaggaagtccttgatgcagtaacagcccctgcttttgcaagggatcaacttagtgtaggaattagcggtggtagtgttggcatgggtgctagccatgaagctgaaattcatggaattgatgtttctttgcaaagggctgaaagtgttgtaggtgatgcagaacctaatactgagctaacagagacgatgggtcatactggtgaatcagttcctggacctggactaatggatgagtttgtacctgacgaagttgatcggcaagaacctcatggagatagccaagatatggtgtctcagtcagtcggccaagctgacagtggctcaaaaatttatggttccactaaagctgattctgttgagagtggagaaaagataggagggcatgctgttggtcatgcaagcaggatgcatccttctctttcttgcaatgcagggatgcagaccggtttggatgtatctaaagaggaagtgacacaggctggcaaactattgatcgctggtgatgtgccaatggggttagattatgaccctcagaatggattaggtacttatgatcaacctttttccttgttacatataaactaagtgtatatttgcaatgtgtcctttgcaccattttctgtgggtctcgtgctatgttcttttccctagtacaatgcagtatttgtcatagatacttgctgcttgctagctatgctttctttgaagttggtacttattcttgacttgtgatattctgttctgtggattttgcaacgtgactggttttgtaatccagattcaaatattttatacatttcacagaagattcaaatacttgatgaagactagatttcatttccagcacagttgtattgatcctcgttatattggtagttttgcattgcgtccttgtttcaaataggatggatggcttttatactgattgctccctggacaattttttttttatccaatggaatggatgagattctacatcgattgatctttttctctttagttagatctctgttttcttctatccaggttctattcttctcaatcttgttatttgtttctcaggagcaacaaatggagaaaatgattttgaatcaggacttccagaatttgatcctgttaagcatcacaacagttactgcccatgggtaaatggaactgtggcagcagcttgctgtagcaacactgaatcaagctcaagtagttcaccactttctggctggcaattaacagttgatgcacttgacacattccaatctcttggtcaagctcaaaatcatgctatgcgatctgattccgcagcctcgttatatatggtaaaattcgatcgtgctcatccctcttttaaattcaccatgaaaatttggaagtttgtggcaacagatagtcatactggcttatgagttgtgacgcaaaataataatttagagtttatattgatgcatgtctatgccatatttggttggccctgaaatttactgacgaaactcatcatctgtgtaccgcaggatgatcatgtaactcctaaccacaagctcgccagaagggcatcagtgagcagaagccatgggaaatgctgatttgaggcccttccacgcatgctagcctttactaatcacccaagtttgcagcaatactataccagtaatttcacagcttatccgaatcaaaaagaaaaaaaaataaagacacagcttctcaatcataagtaacattcgccagagatccaatttggcacatcgaggagcgtatttacatgtaattctttctgaattatgttgggttggacatcatccccagtatgttgcgctgcccatgatcagacaggataaaccggctaattaataatccatgttagttacaccgtgtgacctatatagttgttgctcagaaaccggcaatttgatgtggtgtccaaacgataatatcatagtactgtatttattctgaaagagtcgattcaatgaagttgtccccagattgacatgaacatgtcgcatgtgcaagttaagcttaccaatccattaaagtttattacgattgattttatttcttactattttttttgcttgtatgtaaaatttgaacgcatgaacatgtttgaattcctacaggattattactgcaaacaggctcggttcctggcttgtgggcctgagggcctctgcttccatgcattgtgtgatcttttcctcttgcccgaatccgaccatccaatgagcgccgcccagagtgccacgtcagcaccaacctccagataaagaagcggatgagacatgccacttcacactctcttcttctctgctcgaatcggagggaagacgacgacgaggtcgcccgcgcagcaatgccgctctgcagcttctacgcctccacctccctccccgtcgccaagccccactccctcccctcctcctcctcctccaagccctacaccgccacgccggcgccggcgccgacggcggcgtcggcgtcggcgtcggcggcggcgctgtcgctgcacctgcccgagctgccgtcgcgggtgaaggacaagatcctgagccttgagctgatgggggtggactacgggcgcgcgctggcgctgaacccggcgctccgcgacgcggcgccggagtccatccacgccgtggtgacgttcctccagtcgcgggggctccacttcaaggacctcggccgcgtgttcggcatgtgcccgtcgctgctcaccgccagcgtccgcgccgacctccgcccggtcttcgccttcctcaccgacgacctcggcatcccggacaccgcctaccgccgcgtcgtcgtcaagtgcccccgcgtcctcgcctgcagcgtccgcgaccagctccgcccggcgctcctctacctccgccgcctcggcttccgcgacgcccgcgccctcgccttccaggaccccatcctcctcgtctccagcgtcgagcgcaccatgatccccaagctggacttcctcgcggggctcggcatgcaccgcgacgacgccgtcgccatggtgctccgctgcccggcgctcttcaccttcagcatcgagcgcaactacaagcccaagttcgagtacctcgtcgccgagatgggcggcggcgtccacgacatcaaggcgttcccgcagtacttcaccttcagcctcgacaagcggatcgcgccgcgccaccgcgccgccgccgacgccggcgtctcgctgccgctgccggacatgctcaaggccaccgacgaagagttcatggagatgctcgacaaggagatcgagctgcagaagcaggcagcttaattagccagagttttaattagcggcgagtgtacatgcatttgatcatggtagaattaagctggattagttgcatgatttgtacataactattgacattattatttggtgtcaccgttggtgactcgtactaaaatatggtaccattttctcccccttctttcgtcaatttagttgtaatttgtaaagtagttgtatatgaaatgtatatatgattttgcaatgtatgttgaacttgtgaatgaagatgaagtagagtctagtgaaaaacaaggtgatccgcaagactgcaactgtagtatgttccaagaagtgtaaaacagaatgatcatcaaagattcaaagatgatattgctagagattattattgaatcaattgccatctagcaatatggattaatcagctctcatcatctgattggcttattagccgaaacggaaatttgaatttttcagctaaattttgaagtttattttgagttatttttcatcgtattctattttccaaccttgcctattaaatccctaataacacatatataaaatttattatccataaatcaaattagacgctttgttcaatttttatatggcttatagcaataactcaaccgatcaaacactatgggtgtgttcggtggacatagttgtggctgtacaactacaacatctacagaaaaagttgtactaccgctagccacagtcttaactgggtgcaatgtagctcaagcgaacaagccctataacgtgtaccgtttgtctacaaagttatagccctacattaaaatacatatttttttcttaaataatttagccgaatttttatagggatagtttgatgtgtgtgtcttttggttggatggtgaatatttatatttactaagctatcatcaactccgtactagctaaaaggctaacgaaagcccagttccagccttacgtggtcaagaggcccaaacaaaatttcagcccatccaacgaaaccctagctctctcttgccctcccataaatgcagccgcggcggccaactcctcgccgaagtgctttgccgacgccgttgttcttctctgatgcgaatctgttgattctttctcgcctcttcatttccttcttttctcagaagatttcctccatatttcaactgctttttgttggcttatcgacttccaattttctgatgcacggatgcgttattaggagcgtgatgatatgatatttgtcgccccagtcttaggatccggattccgggcctgtgctgattgacatgttatcagatctgactcaatagccaatgcgttcgcgctcttcgatgttcttcgctttgcagttcttgatttgttgttttgttgtggcttttttcatctgattggattggtccattggttctatgttgaggatgatgatgtgatatttgtcgccccagtcttatgatccgctgtaatcgcggatgtgtggtgattgacatgtaaatctgactctctcgtataactccaaaatccggtgtgtgttgattgacatgtaaatcttactctttctcctaaaaatacttcatagataaactatgaatctttccatcttgactagaggttttacctattcgctttttatgcatcaagctttttgtttgatgcgtgcgaatgcttgtgtgggtggctcaatgcgctgggagccctgaccggttgaaaatttgttgtatcaaatttccatgattccatcgactgtactctagaaagaagaatgctgtaattcgcgtaaatgtgaggaacattgggacaggaagagtgctgtaattcgtgagatagcacaaggaaatcaatccattaagacgtaaaaatgtgtagctttacgagttaacgttgtggtgggatcatgtgatcaaaacgaaaccaagatttcccatggaactggaaccgaatgcctctgctcttgctcatgtcggtggtgaaattggcgacgacgttgtaaggcctcacagtgtgtcgacctggactgtgccttagtcgcgccatgtcggatttttgctgccgtattgcttagacccgcgtctcagctagggcgcttgtgcctaaactgggggcgcaaaacctcgcctggaaaagaggacgcgcggaggaatcgatgtgaggcgcgtgcgctgtgggagttgttccctcgctgcccgatgctcttgtgcgagattcccctgacgaaatcccctattcgccctcgaaaaatcagtaagaagtcacgcccaaatctcctcttcccgccaccgatttcgttgccaatcacacaagaacacgagaggaatcacacaagaacacaagagaaatcacacaagatgaatcacccaagaacacaaagaggagaggaatcacacaagaacacagagaggaatcacacaagagtccactgttcccgtacccgcttcgccctcgctgccgtctgttcccgccgccctcgccgcccccgccgtcgggaaaggcggatccgtccgccgccgcgtcgatcgatgacggagctgaccgcggcggcgccggtggggtcaggatcagcggcacggtcgacggggaggaggccgtgccgccgcggcgtgggaggaggaggccgcgccgcctcttctaccacaccgcttccgccatgcctcttcttagggaggggaaccgttgcgccggtgccttctcggggactcctcctcgccgctgtctcgaatcactcgccgctcctcacgccgacgagcgccgcgtccgccagatccgccgccggcccagcccactcgctcctcctcgcggcaacggcggctgctcgaggtctccctcggcgaggtcgccgcggtggaggcgtcccccggtcgagcctccgccaccgcgccagccgccgccgccggggacgcctcctcgccgcggcttcccgtcggcgtcgcggtgagggaggagaaggaggtgcggcgagggatagagagggaggggaaggaggcaaggcggcggcgccgccaccacgacaacgaggcggcaactgctagcgccgtcgcctcccggcgtgagaggagaagagtagtactcgaggagaggagaagtctcacgcgagagaggaaggggtggaaggggtaggtggaggaaataaattttcgttcgctccaccggtccggaagctagggtcacgcccactgtgggcttggtaccctttaccagtgcctctatccgattaagccatgggtgcttgcactgtgggatgggtgtcttaggaccaattttttgggctgggggtacgggccccatagcttgcactatgagaggcctaaaggatgcagcttcctcaagagtcaaactgctacgctacgctagtagatttgatgagatgaaccgattatgatttgcaagatgcgcctggttctttaccctaccaatttattggtagtgctctttaccctaccaattcattggtagtgccataacctagataaatttcgacgctaccaatttttttgatagagcaaaattaatgtttggtttgataccaatatgaagccaaatctattatattattaaaacaactttgaaaggaggtacacgttcgctgtgggggctagaaattcccacattaatcggagaaaaagaaaaaagaaaaggagagtccaagtataagtacaatctaaaaatagctaaaattcagaattaaaaataagcaatatggaaagaggagtccatataggaagccaatacgacattaatcaaaattcaaaataaaaataaaataaaatccaaaattagaaaaggaaaggagagtccaaaagcaatatggaaagaggagtctatataggaacccaataaatccaaaattaaaaaggaaaggagagttcaagtagaaatacaattttaaaatagctgaaattaagaattaaaaataaggaatattaaaaaaaagagtccatataagaacccaatatgagattaattaaaattcagaataaaaataaataaatccaaaattagaaaaataaagtaaaagaagagttcaagtaggaatacaatttaaaattagttaaaattaggaattaaaaataagcaatactgaaagaagaatccatataataacccaatatgagattaattaaaatttagaattaaaaaaataaaataatatccaaaattagaaaaattaaaagagagttcaagtaggaatataattttgaaacaactgaaattgaaaattaaaaaaaataaaaaataaataaaagaacacaatactgtattaactattttttaaaaaaaatctgaaattagaaaaagaaaaataagatttcagttagaaatacaatttataaataactaaaatttgtgataaaaataaatattattgaaagaaaagaccatctaaaacaaatgacgagataaattaagtaacatgcctataaaggagtagagtggtggtggttgatacgacatataaaaattattaatgaaacaccaaatagaatcctaatgacaattaaaaggaaagacgtcaggcaggttgtgaagcaaacgagtaaggcggttgccgggacttctattcgatttttaaaatctcaatgacaataaaaaggataagcagtgggcggggtgtataagagtatagttgcagagccaccgacggttgacgggacttctagaatacaaaaaatgaatttcaacgatagttatgttcgatttttagaatcacaatgacaatagagagtaagcggcggacgggctgtagaggggcatagtggcatcgtttgatatgacttctaaaagttataaaaaatgaaattacaagtccaatatttaaagtttcggaacttctaaaaagtaaaaaaacaccaataataatcatgttcaattttaaaatttcaatcacaataaagaagggaggcagcgggcgagctgtagaggagtataatggcaaagctactgacggtttggcaggacttttagaaagtaaaaatgaacccaaacgataattatgttcgatttttaaaatctcaatgacaataaagagaagagacagtggacaggccgtagaggagtataatggcaacgtttaacgggacatctagaaattataaaaatgaaacccaacgtgacaataagctctaaaactgtaaaatccaatttttaaaggttcgaagaagaatgaataggaataatggtagatcaagcaagcaagcaaataaagaaggagatgacataaggggcagctggtgtgacttctaaaaactatataattgaaaacacgaggatgataaggtttagtctttcaaagtcttaaaaacaatgagatagctatttaataaattttaagtaaaatcatactaaaaaatatatgattttgtttgggtgctaaccgtgcaattgcgcgggccacccagctagttatggtagtatggtgagaaatttttgaatgtgaccaaattaaacatgagtaatatcaattatttgggtccaatccaaactagcatgtttactatttaagttaccaaaattcatgtttactatttgagttactaaaattttggtagggtatgttttggttttaatccaaaacagccccatgtttacactctacagtcccctagtatgttctaccgaagagtttcagactccttgatctctacttttttttttttttggagttcagactcgctctgatctacacgaggtatttcagtccaatgcagcaaagattcgttttttcttcattcagaggaagtaaaatacggggttttcagcttcttctggacaaagcaaaattcagcttcttctagaggaggcaaaagttcaggtttaggaatagaaaggatcgacgagccgacacgtcggtctcattcgatgggccgagacgatacaaatattcctccggcccactgcagagcgaactcgattcctccccttcacctctacgcgtaaaaccacaaccaaaagcaaagcacacgagagagagacccacccaccccaaccatcccggaggcggagagcttgacgccgccgccgacgagccgcagcggcggagcaagcgggagcgggaggtggggatggggtcgagcgacggggacaagccgctgcggcggatcgcggcgtcgttcgaggagctcgaggcggtggccaagcagcaggcccccggcccggccatggaggtgggctccttcgcccgcgcctgctccaacgtctccgtcctcttcggctgcctcggcatcgccttcaagttcgccgagatggactacgtcgccaaggcaagcccccgccgccacccccgctctctagtcttcgctctcccttgtcctcgaggtttcgtcggaattgcttgactagattgacctctttttgctgcttacctcggcttaattgttggctagtctgtgtggatttggttaggttgagacctcgaggggattgattatctcaacttgagctgctttaatgctaggagattgtgtcaaaatgatctgaaattctcacctagatgggtggctagatcaactgtaagggtaggaatgtgagcacgcatcaggatcagatcacctcccaaattgtgatgactttgacttagtggatgcttagtagttggtgttagaatcatatctagtacagttccatgctgagagcaagcaactcagatatatctgaattgacatgactcaatccaaattctgaatattgacatgagttttttttgctgcttaggagttaggtcggctattaattgtttgctactacctccgtttcaggttataagactttctagcattgcccacattcatatagattgaatctaggcacacatgtatgattcattaacacacacacacacacacacacacacacacacatatatatatatatatatatatatatgaatgtggacaatgctagaaagtcttataatatgaaacggaggaagtagtctgcatggttgtggctagattgaggggatcacctgaatctgagctgcttaatgctaggtgattatgtcgaaatgatctgaaattatcacctagatggctagatcaagtgtcaggtaggaatgtctgcacgcatcaggatcagatcacctaatccgtgttgcgatgactttgacttggtggatgcttagtagtttgtgttagaatcctatccagtatagcagttactcgtaagtttactatttagcaaaccagtttttctgtttatcaggaccttgtacttctgcaaaattgatgataatgccgccttggttcccccactaggcatcccttgagtaacctgtttaactataacttgcttttctgagcttttgttgtgtgttgtctgatttagttcctctcaattgagtgcaggttgatgatttgctggaggcatccaagtcaatctcaaaattgcctgagatggttgagttggacattcagaagggcaccgtcaggcaagctgggagccatactaggaatatgctgagggttaagcgtgggattgatatggttaaaattctgtttgagcaaatactggttacagagtaagttaaagtcataaactgaattttggtgttggttccttctcagttattctaaagttggtactcttggatgcatgttcagtaaatgtgaccaaaacgtttgcatactaatttcaggggcaactccttaagggatgcagcatctaaggcttatgctcaggtttttgctcctcaccatgggtgggccataaggaaagccgttgctgctggaatgtacgcccttccctcaaaatcgcagctcctgaagaaattgaatgaagatggtgagtgacgggtctgatttctctaaacttccatgctgacagcaagcaactcatatatattttttggttgacatgattgcatcacatcgtttttgggatatcttagaaagtacatagtttgttatttttgcataactgtttgctacaagagagctagtaatacgtaaatacacatattggtatccagtgtatctgtgtatatgaactaatcaagtgccagaaaagagtagaaaatgtaatagatgagttatcaaattaacaagatatattagtttttctaaccatgttatgacattattctgaccttgggagattttgctcctctgtttcgttttgccccctgcagaaaattcggcaaaggttcaaatgcagactttcatcagagcatctggaccagtaattctctacgttgaagatctgtttacctcaaggaatttaggcatggactggtgaaccaaagcctacttatccacttcgaatgtactaatccaattagacggtgtcaatacgcacgctttgtatgtactgatccaatatgatggtgtgctttgagctatgactacaatcagttgtatctggtttcgacctgttaaataagcttcagtctatgcgaatcagctcagtgattgacctgctgtgctgttctggatgctgtttttttaacaggtgaatgagaaattaagaattcgttgttagcacataatgcagtttgaaacaactgaaattctatttgcatatgtccttcctccgtcccataatatttccttcgtcccagaatataagggatcctccgtcccaaaatatgacagagggaagatatcaaatatcatagagaatttgagatggctggtaggtattagccaaccgatgcaaaatttccagcagtttgctgcttcatgtgaaatgattcactacagatctcgttgtgatttccaaatcaatgtatctttcagtcaattatagtcggaccatatgcaatcagttttacacaccaaaccaactgaaactgaacatgtgggaaaacacacatagtgatcagatatcagtacatcagatattgttaacattgtagtgatcaacacggatttgtcaacattgtagtgctcacaatatcagaacacaatttagcacaatagatcatgcaagctcaagcatgaaattttaatgatcgtgcaaagtcaattttaatgattcgttgtagtaacttttgccggtagaaagggattatgcttgcataacaccgagaaaaattatattgatcttcatttctggtaattagaccatgatgccaagaacaccagaaacaagatcttcagttggcatcctcagagatgaaaatttttcataatctaatcatttccaagacttcatacaaatttaaatgagggacaaaaagcatcttgaaaactccagatacttgagagctgtccctagtgtgacttgacatattccgatgttaaagcattctgattccttcaccatagtcctggttagaggaaagcaaaacgaaaatgttagattttatataatcggaatgagattctcctttgtacaataacggaatcgatactttaccttcacgacgacacatgagcagccgaccacctctctagccttacacatgaatcaattttgcaaagctgcatcaaatatagcaagtggaaatttttgagaatcaagatattgcacctttacaataagatgtacacattactacactgatatgcacgctggattaactgacacaacagagaactttgctaatgtagatgtaaccaaattctcactcatgctgatatttaggacctaaaatattgggaataagaagagaagcaggtactaaacccagcccattcgccaagagttcttgtactaggaacagtgaccaagtggctttagcaagcctattaactggttggtcttgttttctccttaaaatggaacgtcttcttttttactacctccatcctaaaaaaatcgtatttctagctccaaggttttgtcccacaaaaattgtatttgtagccatgtggagcctgaacagcgctgatgaagactagaggcggggaggggggtgaataggctgttcctgaaaacttaaaaacaaatcgcggcggtaaaattcaaacagacccggaacttcctggtaaggaactccggaacttccggtgttctaagacagaaacttccgggtaacagaacagagatgaaatttaaatttcgaaacaagagactaagccaatcttcacaagatggtgcacaggtattctaagcagaggatatatcacagaatcatccacagaaacatcacaagagcgattttttcccgaagttcggatcttgtgatcctactctccgttgaggagctccaagagctgggtctcgattaactccttgcctcacttgtgcaaaaaccccagaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttacctcgttcccttttggaggagaggaaatccttcacaaacttacccgggacatccacaatatgcaacggattctcgtgggtgacacctaaccgtctaggagatcatctccaagagtaataagcaccgagatgacagcccacaagatattccaaatgctcacccaagatcctagtcttcacacctctccaaatcttcttctctccctctcaatctctctttcacacaagaattaggctctagattcagtggaaaagacaagaaacacttgggagaggctagcaatagctctaggttcgaaaagtgaaagtggaatggccaaggaacgagctggaaacgagctgtatatgtataacggctaggtgacgtcatctagacgttactcacaaatttgaactggaaactagataggaagttccggacctggaagaccggaacttccagactacacttaggaaaatctttttcataagaccggaacttctggacctggaagacaggaagttccggacttgcaattttggacagatggagaatttgcaaaaaaaggactcctagggaaacttgacacttggttcacactaagagcacttgatatatctcagagcatcacttggaatccctcttaatagtacggtttttcctaaaaactcgatttcaaaagataaactatcctatgcactttcgagttccagtccgctttgattttgtactttttggggggtctccaagcatctatcttccacaccttggactaatgcacctgaaagctactcaatgagctcattagtcccttaaccacatttgtcattaatcaccaaaacccactaggaggattaatgcactttcagagccagcaaattgattgatctagataagattcctaatgcaagcagcaaatttttggtgccaaatccatttggcgctaaagcatgtaatttgggctgctaatgcatgtaattaagcatgctaataatatggttaattctctcaaacttccttttaatcatttgtatatatggaatgtgtgcatgcaatgggttcattaaataaggccattgtgatcattttccaatcctactgttttatcctaaattagctataaatgtaatttttatgggacggaggaagtatataaaacgttggcaatggcttgaccgttcgaaaaaacagctttagcaagcctcacggagacccttgacaaggtcatcatgagcagtttagcacccgtcttcttcatcacaagctgggctctccattgtctccaagaactggagcagctacctgaactggggctgggatatcctccctgattaggcgaaaatgaaatgtcagttcactgaaaagtgaaaactgggagagaatgttgaaattacaacatcctaatcacagcagttaccttcctagaattcatgctaaaagcacaggatgcaaatgcaccatccatgcatatgatctgcaagaccgcaatcgacattcaacaggttacagttcaattgatttcaaagcaagcacaaccaatctccgcgaacacctgtagccctttgctcaggtattttgggtaagaccatgcccatctttcaacccagaaaattcatcagtacaaaacgttcgcaaagatcactttacccaacctccacaaattatgctacatataatttgacacaaagaaactacgcgattaaacatggcaatacaagcaagaacattgccacagtaggtataacgttgcttgatatcaaaggtttacattctcaatcatactgatactagcaaccgtctacaaatacaccatttctctaaactaaagcacaacgaaacaatcgcatcatatccggccatactcctagatccatcttcgaacattacacaacccgcatcaagattctacggctacatacagaaacatcaagacgcgtggcaccagcagcaacacgcggctaaggagctaaagaaaatctcaggcttcgagcgcgcagtgatctgagagcggatggggatgcgccgatgaggggagcagagctcagcgccgccgccgccgccgcggcggtgccgcctcctggggtttaggggggcggaggctggttgctcagctgggccgcatatccgcatctgagaatattgtgggcctgaatttttggcccttttctactaaattgtggcccattcatgagtagaaaacttacgggctcgtatacatggatgggctgagttttagggatgtatttgggaagataaaaaaaaaaggaaaaataacaatagtaactgaaatgaaattaaacactatactagtataggtttagaaaaccctaatttttgttgattcaagtctggcttatggccccccatatttcttggattttaaggtttgacaaaagaacccttccatgtaaaattttacagtcctatgaaattgtatttgcccaaaacagcaaacatattatatcaaaatgatgcaataatcttcaatggtcgacaagtttttttatggtagcaaagtcgagtaaatatgtgtttttgtagttgtttgagattaaattagattgagtattgtgaaaatctagaaccatataactcaagaggtaaagtctacccgtagagctcctcgttggcttatcagttaaggccaaattttagtattataacttacttttaaatttatttaaggttttctttttctccttttaagcattgggcgttatgttgctaagattaccagtagaagtacagctatgcctatttttcaatttataagccaggaaaaaagtacctaccaagcatgtcgctttaaaaagtatgatcggttttcttaaaaaaaaaactagcataaatggtttaaatgaccattgtgcgttatatataaaaaacatatacaccttccattttttgattggttgtcatatttgctttgtgcccggtaccaatacaaccccccatgacacttaatcagtattgatcaacgtgtgttgacgtttcgtatccatgcacgccatcatgatctgcatggcgcattggcctcgcccgcgcgtcgcgccaatttattgtgatcgcataaaatccatgcatacgaactactcccaaattgatttccgcaacacaccatacaaaagcatcattagcgtcttccacttgatttctgccagctcccaacgtcttgcgacgatcaaacatggatcttttttttattgtttttagcaatatgatgaccaatcgcggatgaagggactacatacgactcagacgacaaataatcaattgaactatttcaaataaaattaaataattaataaccttatttttatagacgagtatagatggtactccctccatctccatctacttttgatagtcatatttcatcttggcacacagaccaagaataagtaattctacttatcatccatttaaacatgctactagtcattctttgtaaataaacgattcattaatatttacatttctcaatgcccatgtagccaatcatgtgtgaaagaatggagagtcatgcattaaatccgagaaagtcattaagatgatagattgttgaattgaaatatgcctatcaaaaataaaatttccagatttgaaaatatgactatcaaaagtagatggagagagtattaagctatctactaggctgtttgaaggtactcttttttctctctcgctcttccctctacataaaagttcgcaaaccccctaacatcatgccattattgatgccctaagccaaacacttagtaataatattttacaatccttactacaaaatactccatattattttgtctaaaatgtaccctctaaacaacaaaacttccctttacgtaaaagttcttacttgtgtcacctactcgtataccctaacatcatgccattgttgacaccctaagccaaacacttagtgtaacaatatttttacaatccttactacaaaatactccatattattttgtctaaaacgtacctctaaaaacaacaaaactactttagtggagggtgtagttagtaaaaaagccggctttgtctcctcgtatatacactctctcggccttgctcggttcctcctgtcctgtctcccctctccactccaccgccgccgccgcctccgcgaaatggcgaatctgccgccgtcgctctccatcggcgccgcctccttcgccgcgccctcgcccccgccgccctcgcctggcgcctcctcgtcgtcgtcggcggcggcggcggcggctccgggggccgccaaggaccggaagatggcgtccgcggagcagctcgtgctcgacctctgcgaccccgagctgcgggagaacgccctcctcgacctctccaaggtctccccttgtcgcgagaagctatgcgttttctctcctcttcctcaattttcattttttttatcctcctctctctcgatcgatcgctgtgggctccggcgagggggattttatggttggattcgggggggggggggggggggaatctgtacgtgccatgtggtgcctacgaaagttgcagcctttgtgatgtaatgctctgtctaggcaaaagtaggttgggacttgatcatctgatgctagtagtctgttctgaacgcagatcggctcacatgctactcatccaggggtaaatagcttgctccatctactgtttgatcagtgtttggtatgggaaaaaccagtcctttttttttgtacggagggttcttctctgggagttcgtggtatgcagatgtggtagcttattagtttcattacattctgccttccccatatccggcaatgacgagaatctagagattttgtgcaatccttcaattaattttagttaggtgaatcatataagctttatttgtgagtgggaatttgcgttttgttttgatgtctatgctgtgatgatgcatattcagaatatttgttctgtttatctgctatacatgttcatatctcctggttgcaaaagagttaattatctccagagggcatcctcagcttgcgatttctgtttctgtgtctgtgttaggtcacttgggatttctgtttctgtgtctgtgtctgtgttaggtcacttagtttgttctacttagggttgttcttattaaaatggatagtgctgtggttgtattctacgttctgttaggattggacagcagaaggcacagcccatgatttattaagagtaccaattaatctaagaactagaagatatacatatatatatatatatatatatatatatatattaagtcagaatcaccatgctctgtactttttttcatttaatcttgataagttacatattcactagatattttctttgtcgctatagcatgagtgtaaagagcaaaccaatcgtaaccactaacataaacaactactttttgcttaacagaacattaatagtagcccaaattggattttaatatgtgaaattgcttattttgctttttaatgtttgaagtcataggcaacaaatatagaatacatcattcttttttaaaattttaatttgacaactgtaacaatgaaaaattgaatacctatgaatccagagttgctaagcagttaaaaatatatgacttgttgaaatttttctccatcaagtcaacttcccgccaaattgtgttcttggtggcgtgggaccttgggagttccaatagcttgggtttgcattcaaatcctgggccagcctccagatgcatggtgttagcagatctcctttgaagcccaagccccacttgcagtgttccctagtcctctttagttcatgggtttgccttccataaaaacgaaaagggtcggcctgcaggtatagtggattggacaaattgatccaggtgcccactgtttccgacatgatccacgtagatgtaaaggggccgtggcccaagtaaaatggtgaggtccaggctgcgcctggaaacccaggcccaaaactattttgccaaatcggacatcgtgtctgagtcggattccgacatggcaacacctgtctgattctgactagtaagtacctcacaagtgtgaacacccaaatctgagtcagaccccgacaaacttatccttgtctaggactgtaggtacactttgctgaattgaatccatgcagcctatgagtacgaagatttgcttgggcataggagcggtgaatgaaatttgcaatctgctccaccctagacgagacaatgaaaacagtaactcacaactcatttttcgtttatgaatttaggcgtaactttccttattttgatgctttcatagtactcctaaatgtactgtttggcatcctgtggttacacaccctgaatggtctgatacaagagttaaatgtgtgattgtgcttttgtgtgcaagtgtattggggactgtttctatctatggagtggaatcttaccaattcagtgctttatggcatatagcttcttgaagattctcctatttggtagttgattagtttttccgttttgctgttcagcaaagaaattcataaatcattgttggtttctcgtcacgcctgaccattttgggaatagagattttgttgcctaacgattttcatggacttctttttccagaagcgagagatttttcaggatcttgctccactcctgtggcactcttatggaacaattgctgcactactccaggtaggttacaattcttcatgttgtttaagtcagtgtggttgagtacgaatgttagttcttccgaaaagaaattcatttgagtctttcatggttttctcattcagtttatttgtggtttggataatgcaggagattgtgtcaatctatccatcactttcacccccaacattatctccaggggcttcaaaccgtgtctgcaatgcacttgcacttcttcaggtacacctttacatgagaaagaaagaaaccttacgacagtgagaaatctctacttatgacactggtgcctcatgatgggatgagagaaggctattttttcagcatgttgcaatgcataaaagggggattgataaaatgctactacctctatccccaaatataagggactttgcctatgtaattacataggcaaaatccttatatttgaggatggaggtagtatcagcttaggatccctaaactgatttaatacaacatgttgctttctaaacttcattgtatttttattgcagtgtgttgcctcacacagtgacacaaggattcctttcttgaatggtaataagtgctgccatttttattccaagtattaaatatttccatgatgatactcattgttcaagaatatttcccctcttgcccaatatactatgttcacactattattgtatttattaaaaaaaaccatgtaacagataatgctgattgcatctatttagtttcagctgtgagcaatatgacctacttatggactatggcagtcccaatgctgaaaatttcagataatactaatcacatctagttagttttgcgcataggaatgttcatctgtatgtggctttatgcttccagttggctattgtgagtgacctgtttcctctcttgatttttcccttcttcttttcagctcacatcccactgtatctgtaccctttcttgaatactactagcaagacaaggccttttgagtacttgaggcttaccagcttgggtgtcattggcgcacttgtgaaggtaattgcaagccagaactttatgaaaattatgagggatatgggtgtgtttcttgagtggaagcgtagatttttaaagctagaccattttctgatctactaagatccctattcagctgttcaggtgattgacatgtggttcaatttaaccttacctatgctggtggggtgggcacttcagcttctacatgttcctcttttgactcccttctacatgactttttgggaaatattttggcctgaatttataagagtatcattgtgttcacgtatatctaatatgagtctataactttccttattccaacaacttcacaattgatacacttcgggtggcaagccctcttgtataagagaagctgtgagtttgaactacttatttggtatatctagtatattatattctttgcctgttattttccttctgggtttacttctggacaagctgcttgttcaattttttctctgttcttgaatggtggtttggtccagttctcaaactatgttgagagggagggggtgaaagaaaaaagaaaagatggtgcaaatggtatggactatgggtagaactttccctttcttcatgacagttcttgtggacactggatacttatctagtcatgctgatcaaatggcctgatttgggtttggatccccaaatatccctatgtgaactgcaaagtttgagccaaacaactcgatgatgttttttttatgggcatactaccaggtttaagccctgtagttaattttataaaataagatggtaaaaccatcaacagttttacagagtttgagccaaacaattcgatgatttattaatgatcaagttgcttttaccagactttgattttgtcaatgagcatactcaataagttaattcggttttgttttgcaatatatgcaggttgatgattctgaagtcattgggtttctgctgcaaactgaaataattcctctgtgtctccgtactatggagatgggcagtgaactttcgaaaacggtgtgtagctacctgcctcctttctctcttgtagttcttccactgttttcagctcttgacaacacttcacatgttctttggtatgtttaattattctagactgaaatttacatagagcaaaactcttctttctctatccctgttaagtcagattatcttacactttatgtaaccaagtcatgttggaacctaatattacaatggtcatgaaccgcttagattatgcatcatagttggctttgtagtttgcttcctttttgtttggtttgatcttataaggaagtcgtagtttcttttgacaattttctaagctgctatatgtgtgagttaaaagagggaaaacaaatatttgttcgggaataatgatgcacttgtacctggtagcaataggctgtagtactgtattagatggatttggtgcttcatttttgctaatccaatcaacgtatttttgcaggttgccacctttattgttcaaaagattctgcttgatgatgttgggcttcgctacatatgtgctactgctgaacgtttctttgccgtagccagtgttctatcacagatggttcaggcacttgctgatcaaccttctccaagactgctgaagcacataattcgctgctacctcaggctgtcagaaaattccaggttcattccatcatctgtacagattacaaaatgcagaaaactggtcaatgcgtaaattcaaaatagacctggggcctcctataattcgttttttcatctcatgcagggcatgtaccgcgctgaacagctgcctccccaacgcgctgaaagatggaaccctcaacaacttcctccaggtgtgtgtctcaactctcaactcacgacattgccagttaccatcgctttaccgcaaaatatttacattataatttacacagaaaagtttcaattgattcctgattccaccttcatcttacttgcgcaggatgatcatgtcacaaggcgttggctccagcagctgctgcacaacatgactatggccggcatgggaggagctcctcatggaggccttgatcacatcatggggatgtgatcatctgaaacgaagctggctgtttgcaactcatcatatgcctgaagtcaggactcaggactagtccatctgtagttagcctaccaaaaggattatacttttagttttacctttaaaaagaaatggcgtgtgccattgaaggataagaaatgtgttggttgtagttaaaaggtactgcttgctatcctgtgatgctgtaaaaatgcaacagaattgcgcagctctctgcacaagtagttctcagcttttggtgaacagtccgaaatggagaaacaaaggtaaaaacatcagacttacatggttctcttctgtggtgttgcatgacccgattacatttgatgagcatagtaggccataaatttgctaccttttgttcttgcttttttttaattttttttgggtaaatttgcaatgtgatcagtcacatgatggctcattggtgcaagggcaaacatctagccctttgatcacaaagttttttttccccctctatccttaaaaaagttttttttttcgccaagatttgacacattttggcagtaaaatgtccaacagatacacaccggcttgtgcactacatgcacacgctgccaactcatgtactgttccaaaaaactaaaaagctaataatatacaagttgtatgtgcatctggctagctccatgggatacatgcatctcttcaggccaaaggtgacccttgatgccaccacaaagccatttttatcagcagccatctggagcactcaagctgcagccaccatttctgctagtcaagcagccaggcaacccaaccctctgctgctacctccacctaacccaaaccccctaatctaatcaacatcaaaaacgaaaaaaacaaaatctttttttttaaattatcaaaccccaaacccaaactctaaaacgaaattactaagcagctaaagcttaaatcaaccccaagagcggccgggttaatcacgcaattaagcagctaatagcttaagtcgccccttccagcacctcaagagctcacctcactcctcccccttctctgattctgtctataaaccccgcctcctcccctcccatctcatctcaactcatctcatctcccttctccagatcaaaagacccttgctttccctcaggatcggccatggcgaccgccgttgcgtcccaggtacgcgccgtcctcgcggttttttggatcccctggttgtcgcgctgcgcgcgatggtgctgagttcatgggggttcttgtggctgtttctgacacaggttgctgtctctgctccggctggctcggatcgcggcttgaggagttctgggatccaggtgcgtggtttggtgcccctgatggtagaacttgcttccttttgggtggaatcctgtgaggattccgcgggcttggattggtcaatgtgtagtaggtggatacaaatctatgggatatatctcagattggttcagtattgagcgctattgagagctaggcaacgccagatattgctgctgcttgttaattcgatgtgcagatcaattatcagggttcagggttttggtttagtaggctgtttatcctgaattcacagcgttcttgaatggtggtgctaaactatgtgctggatttcattctgtgtgattcctcagggtagcaacaatattagctttagcaacaaatcatgggttggcaccacattggcgtgggagagcaaggccacgcgaccgaggcatgcgaacaaggtgctctgcatgtcagttcagcaagcgagcgaaagcaaggttgctgtcaagcctcttgatttggagagtgctaacgagccgccgctcaacacatacaaaccaaaggagccttacaccgccacaattgtctcggttgagaggatcgtaggccccaaggctccaggagagacatgccacattgttattgatcatggtggcaatgtgccttactgggaggggcaaagctatggcattattcctccagtaagtaattcctgctttcaatcattttccttgtttaaaatagaacattatgcttatgctttgtcggtttcgttcatagtctatttatctgattggatattgaacgattgtctcgttgacactattaattaagaacttacaaagatatagtcggtagtatattaggattatttctgtagacactgtttccaatgttctattcaatggcttaaaattgtaaacctaggtgagaaaacctgctcttgataggagacttgagtatgtgcacacactattaatacagttccagtggtatctccatgggcatcaccctcttcactgttctctaaaccctgtgcatttttgcttgttagggggagaacccgaagaagcctggtgcaccacataatgtccgtctttattcaattgcatctacaaggtatggagattcattcgatggaaggaccactagtttatgtgtgcgccgtgccgtttattatgatcctgaaactggcaaggaggacccctcaaaaaatggtgtctgcagtaacttcctatgtaattcaaaaccaggggacaaggttaaagtgacaggttagttgatttctttcagcttcagatgaatgcaaaggctttgtgagtttcctatgaggttgtttaacttctaattccaagcggagcaaaattagttgttttagttgcgtttttcctgaaacccacctttggtagacaacctatttctgagttcatacataccaacaacaaataaacggttctctgcaacaaaggttccaatagcctctcctctaatatgattatgccccttctacaatatgattatcttatcttgctcttttcctttcttactaaagtttgcaatcgcatcttagtttacccttttctttgttagtcatcatgtcctttgtggcacatgatggatgccaagtatctcacagtgatttccttctgaacaccaggtccgtcaggcaaaataatgctcctgcctgaggaagatccaaatgcaactcacatcatgatagctactggcactggtgttgctccattccgtggctacctacgccgtatgttcatggaagatgtcccaaagtacagatttggtggcttggcctggctcttccttggtgtggctaacactgacagccttctctatgatgaagagttcacaagctaccttaagcagtatccagacaatttcaggttgctagacatcatctgtcttgactcttcgtattaattattagtactacatgcatacttggctgaaacagcgccacataatgaacatagatgcctctgtcaactgatgccatcatagaattattgagctttgactttgagagtaccacataaatgagctgtttttgttaagtatattcgtgcatattgctataattgaattgtgttgaatttgtaggtatgacaaagcgctaagcagggagcagaaaaacaagaacgctggcaagatgtatgtccaggacaagatcgaggagtacagcgacgagatcttcaagctcttggatggcggcgcgcacatctacttctgtggtttgaaggggatgatgcctgggattcaagacaccctcaagaaagtggcggagcagagaggggagagctgggagcagaagctatcccagctcaagaagaacaagcaatggcacgttgaggtctactaggatctaagtgtccaaggattatgattgttgcgcagtgaaaaagagaaaacaaaacgcatgatctgatgattcttgtagggtggtgtaaaatcatcattttttttctgaatatgaatcataaaatcacccatgtaattcataagcttctgcatcacatgatgaacgaaaggaagcatgtaacttttgcctgtcactattgcagctggtacctttgctatctaccatactgtaaggtgttttgtctgaagctgattttcaggtacctgtcaatctgtcattgtctatgcatataaaagtgatgggatatcgttgattcaaatcattaaaatataatccgccgaaaaaatcactaaaacgtgctcttggaggctggagtagccatcttgtggcttgtgagctgtttatgtttatcatttcaagtgttctatagcaaatttcgtcctcaaagcacaacctttttattgtcaaacttgaatttcagctgtctatccagatttttgcagtattagatggtgtctaatcaagtgctagcttgctatattttagaatgaaggaaatggcactcttatctgatctcactaaatcttcagagaaaaatgtctgagagtcatgaaatacctgcatttgttgctgagctatgctttggcccattcagagtttccgaccattggtgatcaaaattcaccagcagcagccagccacgttgtgtttggtgaatgacgttattcagatcaagctgaagcaaatctaaatcctcctgatacaaaatatacaaactctgaactacccttgcgattttatgacacccacatgctttgtcttgtatctagtagattacatgagctgtttttctgtttaatcacctaacgccaccacaaacgttaacgtgcctcagcacaatcccaacaagatctgaaatctgacgctatacagcactaaggtctcttttcaagtgaatggaatttacagagatttcacggaaattgatccaaaacctgttaaattcttgcattccaaaggagccgtaaaaaaactaaaagaacagtgttacgcaaaactagaaagcatggtaaataattcttttagtcatttatatatatatttatatcataaatgactatcatagtactcctataaaaagtaaatctaaaactagatgtgacacattttaatactataaatttagacaaatgtacgtccagatttgtttataatacgtcacattcattactatgttagttttttagggagggatggaataccatgtaagatttttcatcacaaattatgta

SEQ ID NO: 21286 - DNA, 825 bp, Oryza sativa
caccccgccgacgtcaacccgattaatccaaccgcggccacgtcagcaggccgtgaccatccacccgcgtcgcgtctccatttgctttcgcctagtactaatcactctcgaaatcgcaattactaccaccgtaataatctcgccgtcaccctccgcggcggcgtgcgctgctccgcttcactcccttccatccatccccggtcgccgtcgtctccgcccaggccagcactgacttgtccgttttatccgcctccgcttctcttccactgaccccttcttggcctttttgggtgtctctcatccatgagagtgattagttggaggttaccagctgtaagtacaccaacaagccctaataatagcgaggctcgtcagttgggaggagggagtggcgggaaggaggaggggaagttgctgggccagcgttgtggcggcggcggccggagtcgtcggacgccatggaggccgtccagccgccggtaagcgatccggcccgattccgtctctctcttctcctctcctgtgagtgctgtgatgtgatcgcggctgatacgtgcgcctcgtgcttatttatttatttttaatttttgttgttgttcttatgcttgatcatgaggatgggaactgggttcgtcggcttgcctttttatgggttgggttttttttttcggggttaaattctctgcagtgacttcgtagttcgtactgttgtatcatcccgctatatcgagatttctttagaaatattccgggtttcgcctgtgtgctttctgacgtgttcgatgatcagttatttgctagctcttcacaattcagtactcatgt

SEQ ID NO: 21287 - DNA, 562 bp, Oryza sativa
agaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcgaacgagctcggtcataagtagtataatatatattttaatgataattttttgataagtataattattttctagttaatcacactaataaaagagtagaaaatgattaaaataaatatattatgctaacacatgctaatttattgtgtaaatagactactaatatatattatatttacctattagtttatt

SEQ ID NO: 21288 - DNA, 223 bp, Oryza sativa
caccagcagcaggacgagcagcaccaacagcactagcagcggcggccatggaagcagcagcagcagcagcatcggaaatggccatggcggcggcaacccgaaggctcaaacaaccaggagcaggagcaggtaaattattttagacttgctaattgtgcattatttcagtttctagatgtaaagtttagtttcattggatctttttttttttgcatatctcttt

SEQ ID NO: 21289 - DNA, 367 bp, Oryza sativa
agtaaagccccgcaggaacggtactcctggagaggtcaaccggagtgaggccgtcgttgtttgcaagatccaggcgaacctcgcgattccgcagcaagcaccagaacgatcccaggtccccggccacgaccgccaggtgcagggcggtgttgccgtcgtcgtcccgcgcgttgaggatcgacgccgccaaaccccgtccatcgacgtcggaggcgaatcccacgacctcctgcctgccccggtcgacggcgacgtggaggaaggtcctcccgcgggcgtcgcggaggccggcgcactcggggcacttgtcgagcaagagggcgacgagcctcaggttgccggcggacgcggcgacgtggatggggta

SEQ ID NO: 21290 - DNA, 251 bp, Oryza sativa
gacgagagcgccgagtcaaagaagatgacggagtcgacgcagatgctgggcgtcggcgccgtcctcgtcgccgccgtcacgttcgcggtggccttctcccctccgggcggctacggcggcgacggcggcggcgcgccggcgctggcggggcagtaccccttcgacgcgttcatgtacgcggtggcgctagccttcgcctactccatgctcgccacgtttagcctgatgtactccagcacggcggcggtgga

SEQ ID NO: 21291 - DNA, 1241 bp, Oryza sativa
gtctctttatcaaatctcccatcttcctactgttatgggctcatggcgacggcaagggcatgaacacccgcgtcaggtctgaattcgtagcatctccggccataaggcgagggtgcggaggcgtgcctagaagctgcttcgagctccttccatattttgattagctattggtagatacttcctttttcctaaaatttaagggattctatatttttttctaagttaaactaaggatccattctttaattttgttgagaagagtatgaacatctaacataatcaaggaagtaaatcatgaaaatatatatttcaaatggatgtaatgatgctcatttgatactgtaaatattattattattattttcctttattagaaacacggtataaaagtagatgctaacaatacacgtacgctcgtatctatgaacacgcacacgcgcatcctacttctataagcacctccaaaaaactggactgacatatattttgaggttgacaaaatcaccatgggcacctcgttggtgatgagtacgtcgcctaccactaaaaaaataattagtcgtaaatatgagcatccgtgttaactctagaacttaaattcggacgaactggttccgctataagaaacttggctagttgcttagttgtctgaccaaacttgagacaacaacttaggacataaatagaattagaatttttatactttactactccctccgttccattataagtgcagccataagttttcgtgcccaacatttgactatccgtcttatttgataattttatgaaaaaaatttaaaagttaagtcatgcataaagtcctatttatattttatcatctaataacaataaaaatactaatataaaaatatttcaaataagatgaatggtcaaagttggaattaaaacttacaactgtgcttattatgggacggagggagtagaaccaagtgtgtattcactataacaaccacatcccgtgaatcccgtggcaaggtcaacatcgctacatggccgcatagtttgttttcttgccgcacggtttggatgcacggctgcataagaaaggtcagagctgagcaaattaagcttaggacgccagtgacttgtgattaccggtaagcgtgctctgaccgtttccatttcttttcctttcactttgtttttcttttcttatcttacggagcttatttaatggttgtggcgtgaaagaaagtttttactgttagtaattaatg

SEQ ID NO: 21292 - DNA, 695 bp, Oryza sativa
ggttgtctaatatcaccgtaaatttaccctgttaggatcagtacaaatcattatttacttcatgggcccatcaccggcccacataaagatcagcccatcactgaccgacatagtgatcggcccattaacggcccacgtatcatcgctcgcccccacatcccgacccgttcacctctcccgattctgacccgctcctctctctctctctctctctctcttttcctcgtgagttcgcccgccgcctcgcctgcgccgatctccatcgaactcggcgagcagccgaggcggacctgctgcctccttccgccgcaagcatcctcgccgccggtgagcaccaacccacacgcaccttcctacccccgcaccatctgtcttcgcctaaaccctagcttctcttctcctagatctggaagcttttctcttaatttgccctaaccctagcactaatagcagcagtttgttacggaataaagttttgggggggggggggggttcgagtgaatccccatgcccccacgttaagatccgcccggcctggggaggtgtattcgttggatttatttgcttgcttttgggttgtagctcgcaatttctttcttaccacggtttactgtagaatctcttagctctaagggtttgtccatttttttatttttgggcgtagcaatgattgaccacagaggcacagaccgagc

SEQ ID NO: 21293 - DNA, 402 bp, Oryza sativa
attcctgcagcccttagcatatgtgagttactgtagcacttatagctaatcacggactaattaggcttaaaagattcgtctcgtgatttccttcataactgtgtaattagtttttctttttatctatatttaatacttcatgcatgtgtctaaagattcgatgtggtgtttttgagaaaaaattttgaagaactaaacgggcccttattacatggaacaaagaaatttgatggccaggcactggtgtcggcatcagagccacgaggtttggagtgggcaggagcagacgacctgactagttaggatgcagcagtagatctggaggcgagagccgcaccgagacggggaagctggcctgaggaggagggcgggggttggggggggagggggggcgggaggagg

SEQ ID NO: 21294 - DNA, 616 bp, Oryza sativa
gctctctatgcaataatgaactaaattgtgatgtttattattgcagggaacacaagtatgctcacaagtagcctactggaaattcatacagactttggacaaagaacagctgcaagccagagatgatctaggttttgggggcttaacaaaaatgaatggagtccagattcgccggcttttctgcaagcaaattgctaggcaatatgacgagtagactagagctttcaatataaatggaaccatgctggagataaccattgaagatgtggatcacatactcggcgtgccatcggaaggtgctgaactggttgaagtcccacaagcaatccaagctgacgttgatgccccaaaggacaaagatgaaaacaaagctctacagacaacaaaggccgctttgtttgcattatataaagacaaaaggggaataagataactctgtcagccttgcaggattcattgaatttgaacaaatcttgtgacgatcactttaaaaggcagtttgtgctatatacaattggtctgatcctatgtcctacaactgagagatttgtccattcagattacctaaatctgctcataaatataccagatataaagagaacgggctgcaggaatt

SEQ ID NO: 21295 - DNA, 17514 bp, Oryza sativa
tactttcaacttgtaagtcaaatgttatagtatacctccatgtcctcacaaatatatgcaaagaggtccacactatgataaaaagtcaaacaatctcacaaacttaagccctgtacacctgattcacactagggaacataaccattccacagttggtctatgcagaggcacgcaatccaatgaatccagtctactacaaacattagcagtagaaccgacacaaatggcgtctaaatccccaaaggggaagacatgttagacctaagtacataaacccgagtccaataacaaaaatggggtttgcactagagtgtaatccagtctaatacaaacattatgaacaaccacaaaaagacatccaaatcccacaaggctaacaaatttgcatagatcataaagttctcaataaactagcgtaacaaaatcaattaacctgcctgcctgccctaacttaacagaaattaaattaaggggctgtctatataggaatcgaatgatctatataagttaaaacctatattgatctacacttcagatcaatatctcaggcttcatatttctagcttacatttgagtacacacaaagaactagaaaacaaaatacaacgtggatatagtacttatgtagcaatagtaatacaacacacaactaaatcacacacatcatcatgatgcaaagtttctgaatctatacaacagttcttttgatgacccatctaataattaaaacaaagggagagagaaaaaaaaagcacaaggagttattataaggatgcacatatcagaagcaatggaaaaaatgaaatcaaaaatagaacattgcatagcacacagggaaaatagaaacataatcaatacataaatcatagcaataattcactatcagatcaacagctaacaataattcatcagctagcaagctaaacaaatagttgaagactacaaataaagtacaaatagttagagatacaaaataatgcaacacaaacttttataaatccaaacatgagcaaacttcttcataaacatcattcaaaacaaatcacacgcatctactaaaatagcaactcgcagattcaacaaatcacaacctaacatccggagaacaagggagcaactatagaatcaactcaaattcccatgggaaaaactagatctaactttacacatcacagatcacagagcacaattcgtaaatcacatatcacatatcacagatcacacatcacacatcacataaacgaaactttctagaacatcgcatagcacaaatttatgaacaaatatatcatagaaacctaaaaaaaaatcacaaaagcaaaatcgaacacgaatcatggggattcaatgaaacaaacaccgaaacaaaaggtgctcagatctacgaaaactagaacgactagtactacagaatcaacgaaacacaacatgtagcatgctaaataggagatggaaatgaacaaaaaaggaaaaaaaaacaaaaaggaaagccactggaataatcttgcgcaatcgacggcgcgacacctccgcaacaacagcagacgccgagtcggctcgccgaagagcagcctcgtcgcctcgctaaatcgctgccacgtcgccggagacgatgagaacgagacgacgaaatcgtcaacctctccttctataactctctctctctctccgtcggcaaaaggagcacaactagcggagcaaaacaacaacgaatcgagcagcaagctaacaaatgaagctggagaagaatcaaaacatactcaccggagaaaaagaggagaaggagctcgaggacaagatagagaagcccacaccgcaaactccagtggaatcaccgccgcgacgtagcctgcacgaatccacgccgcggcgtagcttacgccgcgtcgtcgcctcccggagtcgccgacgaaatctccgccgaaatcaccggaagagacgacgaggaaaaaggcaaaaagcaaaatgaatctctcacactctctctctagtctgattcagacaatctctccggtgcggatttcaaaatttaaatagtgtatgtgggtcccaccattaacactcacaaaaaaatctctctgtcggcaacacaaaatgggtcccacaaaaatgtaaaaaaaaaagaagcccatttagcccacatatggaagcccgaacttacaataatcaaaagcccacatagtctagatagcacgaatcttaaacaaaatccaagggacaaaaaaacgaatgatacagcccaacaaaaacatgcgacagccatatagcctttcccaaaaaaaatcctcctaatcacaatgccgtcgcggagatgacaatgacagggacgatgagctcgaggtcgatttaccaccgggagctccttggccccatcctgccttgatccgtgccatcggcacttgcttccagcgaagacgaggtggtggtggtggctccgctgctcatgtgcctgtacaaggcgagacgaagttgtagacgacactggagggggcaaagctggcagagatggagagggccagagggaatacctccgcgacggtcctggagctcgacagcccgcgcgggtcctcgatacgcgcctgctcaccagccatcgccacctaccggtggtggtccacgccgtcgccagatccacggggagcggctcggctcaacgccaccctacttgtcatcggccttcttcaccacctctgcgccaaatcaaccgctcggatcgtctcctcgatagcctccttgccgcttccgccaccaccgcctcaccgcttccgccgctcgcaccgcctcctcgtccactttcgcaaccaccgctacctcaccttggctcacctcatcgtcagcccgctcgtcgccggagatcagaggcggaggcgatgacagatggtggtggcatgccaagcgacggcggggactctggctcctccttttaaccagctgtcgttcgatccccgccacctccgctgcctctatcgtgcatgcagagctggcctcatccatcggttctttctcagtgcaaatcaatggtggaaactcgaaagcacaagccacaaccatggtgtatgagagaagacgagtgaacttggattgaaagcagaggtggacgacgaggcactcacagctcacagctcccgattcccaaaggctacctgctaacttatgcgtgccactaacacctagcaaatattcattttcacccctaatagtattttttatcctatacttcactacatataaaatattttcgaaaatacccctaggttagtactcacgtatttatgtgcaggaccttctaagttttaacttttcaatactggtttggtctgatgtacaaagagtaaccttttatatgactccatattaagaccgtgtttagttcatacctttggttgaatttagaacgatgttacggaaaaattagaaatttatatatagaaaagtttagatataatggaaaagttagaagtttgaagaaaaactttggaactaaacacggcctaagttgatgataggagtcatttactttaaaaatatgcattctataaatttcgtaattttcatgtaatttgataaattttgtagatcctattaatctaaaagacatatcttccaaagtatttgttaaacgcatacagatacgcttaaagaagttatttgtctgttaacaaatctgtttttaaagttgaaaaataatttacacgggacaagtacagctatctaaatacggcacagaagaattagccatgcataaactgatcgtattgctctcttttttaataatagaataaaatatcgtggcctttgctcaaacaagctacaaccaattattacgtagctcacacaatagcaaactcacacagtgagtccggaaatcacagtatgaaatttttaaacaagcataaactaatacaccaccaacacaagataaagatcccacaactattgaatcctatttgagaacctccatccgaagttggcaaagagctgcataatcgttgactcaagtttacgacatgtatcattaattagtttgatatcttcttcacacctctataattgcccaatactgaagccaatacgttgccctgaaaagtacctgcaaataagatttttatggtaatttatcaaagcccatcttattcctactaagtcagagagcccaacataaaacggatgctccaacaaaaataagattcttaattttttttatcaacaccaaaaaggtgttcgggagtgagctttggaaaccacactccctagcacacaaaacaaatcagcatttatctcataattaatcaagtattagctaaaataaatttgaaaaatggattaatatgattttttaaagtaactttcgtatataatttttttttgcaaataaaacactgtttagcagttcgaaaagcgtgcacgcggaaaatgagagagatgagttgggaagatggagataagaactcagcccaagccaattcctgaacatatgagacatcctttgtggaggatataaaccaaaggaaatgtgtacagatctccaaataaatcttaaaaaatgacaatcttttttgtaaaaaacatcttaagccatttatatttgattctaattcggatttttagggcgttcagtgaaaaatgttggactacttataatcgaagccatccctagagccactgtgcattatgcagataaacaaatttcagacatgttatcttatcctatgtggcactttaaggccgctcatatgaggctcttatactgtgaatggtctaagaaagatgatagaactacagttttttggtttataaaaaaagagaaagtgatggatacactcaggctgaattttttttaaaaaaaaataaatacagggaacgggtaaggaacaaagtaatttcatttttttatgaagtaactaaaatacatgttaattgttagggctattatataaaacatataatttaaagtcataaaacgatggaataacaataaccaaatcgatcatcatcaaccacatatatttgacattgtcctctgttttgttttatctgatatgtaatttaaatatatacaaacataatgcagacaaataaacaataaataatacgtgccttactgtgtaatatggtttatacaggttacatggatagggcgccaacagcgcacaggctttctagtctcttaaggcctttcacagtgctcctaggtggagtgttgccttattgtgccagctaggaatttcgccgacatgtcgcgtagcaccgcgtccttgttgagccgctcgctcccaagcaaggaaacgcgattcctcgctcgcgcgaggtagagggaacgcctggagctcgcgctgtggagggcatgcctccaactcaccgtcccctcgcgccctctccagcgtcgacctcgttgccgtctcccgctccgtgccgccgacctcgatgtcgccggggagctcgtcgccgcgccgcttcgatccgtgccgccgccaccatcctcgtcggagaagctcgccggctcgatggggaaagcgcggagaaggagaggagctcgaggtcaatgccgcgtccaacctcgccgccgtcgccttgatccagtgggcctaggccagatctggccgctcagcccggcgtcgtagccgtcgccgctcggaccgccgcttcgcccggctttgagaggaagacgaggtcgcgtggctccggtcgacgacgaccgccgtgaggacggccgtgccgccgctcgtcgtccgcgaggaagacgaggtcacgcggcgacctccgcgaggaagaccccaccgagagcccgtcgctgcggagcggggtagggggagggaggcgccagcgtctgtggcctctggacccgacgatgagaggcgccgccgcgccgaagtccatgccttcttgcccgccgtcctcgccccggggcttcccgtccgccgcgtccctagcgtcgttcggtgccaccgccaccctcgccggctgttgacgtaaaacacgaggcctgggagatctgcttaactccagtgcaggtccaaagctcgccttcaggtgtgttagcgtgccagttgatttgatcctgcaatcaacaagaaatagaaacagagagatcgcggttaaatctataaatgatagccaatcggctaagtgccgataacatatcatttatctttgagccgatgtcatatgtgaatcgatcggagactataaatagataataaagaactaaatctactcgatcggttgtagatattaccaatatatagttcttatatcgatatatatttaaatcaagtgattgggatagatcggtcgccatgccgagacagtataaatcacttggatcgaaatatatattaataacaggactatatatgtttataacatagccgatcatatagatctagcatgtataggctaatactccgatactactctatatcaggatattaaaataagtataatatatcaaacaaaagcttaatatacttaaatgcaataagatcttgacataaagggcggatttaacatgtcactgaagcatatagagcaaatatggttaaatcagataatatcggctgaaactccgatactaccctaatcggcaaccagaaggcatgctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctatcctctactaacagatgttagccgattgtaggttaggtagcgatatttgcagagattatgtacgatatatgataactcaacgaattacgtaaacaagattagagtatcatgaagatggaagcactaatcccgagaacacaagtcgtcgtaacaagttttacctcttgttgaagatcgaaaccgatgcagctcaacccgaaagcaagaactcgtcgaaataaaattaaagcaaaaaggtggcgatgcgccgaaattgtattgaacgtgtgttttccttttttttacatagggctcgggatctatttttacccgagaattacaagatatgtccatactggacacgactattatctctaacaaactctaagataccataagtctttgcggcagacttttgccctaagcatatcactaaggaaattatataaaacatcctaattaatagatacaattgccttttcaggactctatccacgtgggacaatcatcttgaagcatatcaactcaaacccaatgttggatacgagtcatattgccggaatcggctgtatcacctaatccagtctgattcagatttagccgattctagtcgtagccgatctggactccagccgattcttacactgttcccgcaacaatccttatctctgattccgcttcgatcccatcttcacctccgatgctaatattaccaaatttggtcgttaacatcggcttcttccgcgagggaggaggggagagccggcaccgctcggccccgaggacgccgccgccgcaggacccgctacctcgccatgcgtgcagccatcccgccgtcgaggtcaccgccgtccggccccgacaaggagaggagggggcgggcggtttgccgtcgtacgccgccgtggagccgagtgagggagagcctcgtcgttgtccacacgctccgctccgcgtcaccgacctcggtgtcgccggggagctcattgccacgccacttcggtctgcgccgccgccactgtccttgtcggagaagctcaccggctcgatgggaaagcgcggagaaggagaggagcttgcatgaggttgaggccgcgtccgagctcgccggcgtctgtgccttcttgcccgccgtcctcgcccttgccacttgccgtcctggtcagtggcatgcgagaagaatggatagatatagagagggagagatgaatgtgaaaagagagatggtgggacctactaatatgggtgggacccacaaacatgtattgtttaagacacatgcactgtgaagtgtggttctttatccggttctttgtctagctggaggctttgagctcctcatgtgtgttacccgcactgctactggccttataccgaattcagggcgtgttctcgagcgttagcgacgccacgtggctcagcccgattgcaaggttcgctccctcgctcgcagccgtcggatcgcgtatccatggtcagaaatcgatgcggtggagctaattgtaatataggaagtttaagggggctttttccaaaacggtgaatacctcttcgcctgttcggtcttgcgcttgtttccgtctaaggacagaggaactccctcttccttctcctcggtcgcgttgtcgccacttacctccaccaattccgccctgatcccctccgaacgtgctcatccgcgggctctcgacgaacacctccggccgcgacccagtcggactcggaggaggccgccagatttttctactccctccccctccgtgccgtctctctacccctctgcctccatttgccgcggccttgggacggaccaccatcgccgtgcggacggacgaccggagcacggcgtatacgacatcgtgtgcggcagcgggcccctcgacgagcctgcgcgcgtcggatttaagtatgtctttttgttgttctgaagaaattgtgtgtatcatttcttcaggtgccctgttgcaattgaagtatggaggatagtttgctacgctttcaacattagctcgctaagtgtgcataaacctgtcagtaatctggctacattattttcaaatagcactaattgttgttgtcagcgtatcgatttgctgccttgtgtttacacctaaatttgacacctatggacgaaatagggaaaaattgccaaagtttggaaagtgccgggtttccttcacaagggccggttagaccacatctatgtggacggtctgaccggctagtagggtcggtctgaccgcaggtatgtgggcggttagaccgtcagggtccgagtccgagtctgttttcgtcgggtctcgggtttccttgctcgggaaggcatgtttcgtgtttccattggtttctatcccgagttggacgtggagaagggcctgtagagagcaagaccaacccctatttaagggacaaggccggttcattgtaaaaccccctaatacaatctacttgaatcgttcttttactgtgttttctattttaccctagtttagtccatctttgtcggtttgcgccgtaaaccgtccgccaccgctgcgagagtgcgacacctctttgtaggtttgtcctgaaaaccttccgttttgcccacgagacgggtagttatcctcatatcgatctaaatcggcctagaggctgattttgatctctaaatcggctccattagccggtttagctgtttttctacaaaacccatcttgatttggccgcttggctagattaaggtggttggcgaggcgtttaggtgttgcgatcgtgcttatcgacttgtcacaaaaagttgccaacacgatttttgacgactccgttggggaacgatctaatcggccatatcatggccgaatttcatttaatctagtaattactgttcatcaaatcaggagtttcggcttaatagccgaaatcaatctacactgtactgctatcgctacgcactggtttcatcgccggattaatctattcggcggcgaagttaattatctagtcgtcactgaatccatctgaatacttgccgttcagcccgccgcgtataccgaggatcatcgtcgggaggcagaggccggctcgacggcctcgtttctttttgtttcacacggcaacagaaagatttgattgatcaaagctagtactgtacacgagttagaaaagatcaggctattcaatccgatctattactgttcacattaaaaaaaaggaagataaaaaccgattcaatttgtatcggttacactgtgaagctttagattagtttctaaattttgctaagtctactcggttgattatcaaataaatcaaatacttttgccgagtacagtacatacgaggaagtcaagaccgtatattaatttattcggtcaaaatatttcggctatgagctatatggccggaattaatcaaggaatttcttcatcaactataacgagcaggaacgggttcaacaatattactacacaatacattaggactgatcaaggcattatcccgctatctcaagtcgtagtttcaccaaaggtaacttccgattcggccaactcatactttgctattcaaaaggttaatgatcgttgtgtagatgcatatgctacctctagttttgctcctatacaatatgcttataatgctatgggggtcaatgggtgattatacagccgattacacaggaatcggctatatgcaaaacctagctaacggtatgactggtcatgacaccggtctaaccgcatcctatgccggtccagaccgtgccctattttggccagatcggacctcctatggccggtctgaccgcaccactaaccagggagtttctccaagttttcataccataactagcagtactgattttaattattattcatcacctgttaatactgttagtcatgctattccacatatccctaatgcctacaatgatattaataggggatatcctcccgatactaggtatggccaatataacaatattgtgccacaacaaccaccttttaggccaccaagtccaccaccagatccaccaaagcctgaaactgtggaggattggtttagaaatactatcagggagaatttcacaaaactaaggaatcgtgctagggagtaccaaaagccgtatcctgatttttatgacgctgtcccatatcctcctgattataaaattcctaaatttaccaagtttagtggtgagaatagtaggactacatacgagcatatagatcaattcttagcgcaatgtggtagggctagtagtatgaatacatgtaaattgcgcttattttctttatctttgtccggtactgcttttgcatggtctacttctttaccggaaaattctattttttcatgggctcaattagaacaaaaatttcatgattatttccacactagtgagactgagcttaggttgtctgatttaacatcggttaggcaaaaatacaatgaatctgtcgttgattatattgaaaggtttcgagatattaaaagccgatgttttagtttgaaaataactgacaaagatttggccaacattgcatatgatggattgcttgattctattaaagagaaattgaatggccagatatttcttgatattgatcatgtgttgcatgaagctctggctcaggaaagccgagtggatgacaatagcttacaagctagtttagatgaaaatgcaatatcatgtatagccgaaccaagcgatggttcggattgtggtaataatttgtgcaatgatgccgtaacgagtatagccgaaccaaatgttgattcggattgtcttattagtttggatgataacgcaataaccaatatagccgaaccaagtattggttcggattgtgttactagtttagacaatgatggaatagtcgaaccaagtaatggttcggattgtgttgctagcttagagaatagcatcattgaaaatatagccgaactaaatgacggttcggattgtatcacaaacaaaagtgaaatagcattgtcacctaagaccgaatcacaaatcggtcatgtggatgttggaaaagataatgaaaatgtcttgcgggatagtagtgagatagaatctaaaatatttatgcatacatatcaaaggctgtatcctgaatacgtagattcggtcccgtacccgcaaggatttgaggagcccaatttcacaaaattcacaggtgaggatgctagaacaacaatggagcatatcggccaatttattgatcaatgtggtaaggccggtaatgatgatttgcttaagttaaaattgtttcctctttctttgtcaaactttgcatctacatggtatagtttacttgctcctaattcaatttctacatggtcacaaatggagcatgagtttcatggttatttcaaagatgcaaacttgatgacaaagaccgattgatacttcatcggtcacttgtgaaactatttcggttacctctatgcctaagaccggaattgttagtgatcctctccttgttagttctattgatgttggcaaaaagaaagggaaaagtgttattattggggatcctcggcccaagaataggatcaaaaatgcgaaggccgaagatcataaagttacaaaagatgagtcatctagttcccaaaagactaaaaagccgaagctcacttttgagatgcttatggctaagtacaagaaaggattagctggtcaacgatttgataaccaaactagtgattcgaaaagaccaagatcatctcgtaggaagagatttggtcaaacatcaaagcaatcgaagccatcaactataccaactccatataaacctccggttgtgatgccatggtatccacatccaatgtcactatttggttatacttttatgtattacatgccatggatacctcaaccacatatgccgtatcatcgaggatggaagcaaccacctaggacaataccaagtcaatataattcaagacaagactgtttcccacaaaagaatcggtccggtagatcaaaggtgaaaagtgtgaagaaggtgtgggtgaggaaagaagccaaagctccggaggtcgttgctatcaaggagaaatctcaagatgttcaagtacctactgaagatgcggcgaaaactatacaagcggagaagactgaaaccaacgccgttgctgtcgacatcggcggtctgaccgagccagctagccagtctaaccgccagactacggccggtctgaccaaccctcctagccggtctgaccaaccctcctagccggtctgaccgacggcttgtggccggtctgaccgggcctaaaggccggtctgaccagggggcattggagaagagtgggaaaattgagagcaacacaggagcttctatttcgaccaaaaatattaagaatcattatttagctcctagaaaacagccacagccgaagtggataccttctgctttatctcgctctcaaaagaggagggtacaacgtcttcgggccataggtaaaaaagaaaaagaggccgaagatgtggagaacaaaacatgtaataattcagagccgcaaacgacacctaagcgagtgtggagacctaaagaagtaaaagttaaaagatcggtgctttcacggagtagtgatgtattcaatttggtgagagaagaatcatcggtcattaaagataagtctccttcacatgatgctatgggtgttagtgcggtattcatcttgccttcgaaatcgtgcaatcaagaaagccgattttgcttggggggcaagacattaatatgctcatgagggaaccaagaaaagaagaacggcaatggatacaacatcacatcttcgagccgccgttcgttggatgctaaggcaaggtatgggtttatggtgttcatcgttatattatatgcctatgtcatgttagaacattgcttgctatctagcacatgtgtgtttttgcttatcaaattgatattatacatacatgcaaatgccagttctaagtagtagaattggtaggttggcatataatttgtttcaagtatgatttggctcatgactctttgatatttatttaaagccaaatcgtatgtgtttttatggatcaccatataagatatagatttcatatttattgcaccatgaaagttttccttattagtaattcggctaatgtcaatggtcaatgtgatgatttattctagagttgttttctttagaaacattggcattgttaatattttgcatacatgctcaagtcgattacttacatttgtagtttattggaattcatgtgtgtgaggcatatgactttggtgattcattattgataatacttcaattggctaagtgttttgatgccatgatggttattgtttcaaaagccacttgaattagtattcatctagacatgttagttgggtattatatttttttcatatgtctagagagaaagagttttggttcaatagtttgatacaccaagcatctggttataatatgaagaaaggagtatttttgatattagtgaagtcggtgcttgatttttaagtctttggatgaaattggcaaaatcacagaccaggggttgtctgaccggcattgcatggccgatctgaccggtggtgacatgcggtctaaccggctctgcatggtcggtttgaccggacagacagggtggtctgaccggcattgcgtggccggtctgaccgatcccagacagaaggctggggggcacgttacaattgattaaaaggctgaattaattgtgaattcggacatttgtgcccatgagttagaaatagcttggagaattcctttgattagagttttgaaagatcctacacttaaggttgatcggaagattcggcggtaagtgctcaaatattatatcgccaaaaaatagatggagtattacttagataatgatcaactaaagttgctaggagagtagtacatgaagggatttgtgaaattcattaatcggcccgtaagataaattggttgctaggagagtggggtttcattggccgaaaataattgatgattgtttcaaatgttatagagggagtgaagcttgtcaatggatcggcaatgttcaattagcgtctaccgctgtgttgaatcctatcattaaactatggccgttccgaggttgggtttgggatttcattggtcaaatttattcttcgtcatcaaaagggtattggttcgtgctaattgcaatggattacttcactaagtgggccgaagccgtgccgctcgagaatattacttgtacggaggtaattgactttattttgaagcatattgttcatagattcggtattcctcaaacgttaaaggagtttcttttatgtccaaagaagtgagaagttttgccaaatcttatgatattaagttgttgagttcttctctttactacgcttaggctaatggataagccgagtcgagtaataaaacattattgaaattgccgttttgccagttgaggtaaatcttggctctcttcggtatttcaagcaagacgacttgtcggttgaagattacaagaccttgatgaggagcaattttgaagacgtcatcgacaagcgtttgaagattttgaaggacatgaagacacttcaagacggtgtttccagagagcaactaatgggagatagcttgaagaaatacttcttgagcatttggtaagatgcttaggaagtcctatggccggtaattggattatcgccctgagataacatgttctatgcttttaggttcacgtatgttcaccaaaaaggcagggggagcatgtgtttacacctaaatttggcacctatggacgaaatagggaaaaattgccaaagtttggaaagtgtcgggtttccttcacaagggccggtcagaccacaggtatatgggcagtctgaccggctagtagggtcggtctgaccgcaggtatgtgggtggtcagaccgtcagggtctgagtccgagtctgttttcgtcgggtctcgggtttccttgctcgggaaggcatgtttcgtgtttccttttgtttctatcccgagttggacgtggagaagggcctgtagagggcaagaccaacccctatttaagggacaaggccggttcattgtaaaacctccaaatacaatctacttgaatcgttcttttactatgttttctattttaccctagtttaatccatctttgtcggtttgcgccgtaaaccgtccgccgccgctgcgagagtgcgacacctctttataggtttgtcctgaaaaacttccgttttgcccacgagacgggtagttatcctcatatcgatctaaatcggcctagaggctgattttgatctctaaatcggctccgttagccggtttagctggttttctacaaaacccatcttgatttggccgcttggctagattgagatggttggcgactccatatcaccgcaaagcgtttaggtgttgcgatcgtgcttgtcgacttatcacgaaaagttaccaacaacttattgttgctggatcaaacgaaaacttcaactgagccggaggccgaggccccagcattgtctttcacgcctgcactgacttcagctgatggagctcatcaggagccgctcgtcgttgctacgaagaactcaattccgcggattgcacatatgccaatggtgccaacgaggaggctgtcctgtccagagcattttgtcaccacttccgaaggagttcatcagctcagtcgctatagcttggcagactggttcagaaatgagcttgggaatgggatttgggggagctggatatttctggcccttagtttcgtcattcttgggctgaaccgcgagatttggaggcagccgcagatactcaattgatctggaggtttatttgaagaggatcgagcttgtgcgtgagcaagtcaccgccacgctagaagagctcaggctcttcagaatgttgatttgttctctcgtttcataatctaagtactagacagtctatatgtatgtcttcgataatctacaacaatatgtctaagtacgtactactagacttaagtattacaaagttacggttacctattgtctatctacatatatattccaatgattttgtgataatacagtttgtttctggatcttgaatttctaactcgattgggaactatgtcatgcattgctagggctgtcttctaaatagttttccccattcgcaaattattacttcattctgtaataccactgaactgacacttccatccgattaaaatggccattaaacgtaaatgaataatttctatagattagctcatcagcatgatggtaaaacatgcaattgaggggttttggacctctgcctgcagtatgaacaattgccttctctgtactctgttccactccattccaatatcatggtttttaggagaaaggaggaagtcctccatggcttgctgctgcagttccagcgcatgtatgcgtgtcggtgttgtcataacaagttatttattgattactgccaaggcaagccatcagaatatcagcaagaaaattggtccttaccagcctgcagccccattcgcaggtgttcttaagtgtcatcatttttccatttcaccccatctaaaacgaccaaatcaaagcagtcactgatcgatgacccaagtccagaatttatttttcaagtgtaacccatccaacgatcttccctccctgcttcaattaaaaatttggctgctagttgctatttgtaaaatccatagctggcatatactccctccgttttttaatagatgacgccgttgactttttctcacatgtttgaccattcgtcttat

SEQ ID NO: 21296 - DNA, 57726 bp, Oryza sativa
  unsure (1)..(57726): unsure at all n locations
gtcatctattaaaaaacggaggtagtattaccgaactatttggtccgttccttaaaaaaaacctcttaaaattcataaacacatactggccataaattttcatatagtagtattattttccaacatacgtataacatctacacgtgtataaattcaacatgtctatatcctatgtgtacagaaaataaaacattaaatagcgaaattagaacaccaaagaagtagtagcaagaatctcattattaaaaatcttcaaataaattcaaccaactataggtttaattgaaaattaaaaaaaataagagaaactacaagtacatagcaagtaacaccaagaatttcatatgattttgaaaaatatatagacaaatattaatatacatggtaatacacacatggctataaatttacaggcgtgctaatcagcacgctaattttctagttttacatcgaatccgattttcatccttgaacaccaaaaccagatacaactgatccccgaattatcaaaaccggtgtaaacaaggtccctcggtggttttgaaggcggttttggctgacgtggcgcctacgtggctagtttgactaggtctctgtcccacatgtcagccacacaaaaaaaaatctaaaaaaggtgtggcccacatgtcagctaaaaaaataaatatggtaggccccacatgtcatctccctctccccactcggctctccctcttcttcctcgtcacgccgcagcatgccgccgccgtgcatgccggcggagcggcagctgcggcaggccgtgggcgaaggggcccacgaggagcggaggggcggacggagcgaaggagtggcagggcgcggcgcggagcgcctcctgcctcctcccgttcctctgggggctcgccaacctcccgccgctccgagtctccagcagcgcgcccgtcacgccgccgctctcgtcgccgacggcatcgcaaccgcccaagttcaggaagccggactgagacgttgaccccttccggcaccccttcttccaagggcaaagctacacaagctgatgggggtgcacatgaaccccctgtatttctatttttagtgcttgatgtcatgtttttgctacatgtgcacccccctcatctcagttacgtgcaccccccaacgaccggccaaagcgtggcggaatgagcgcacgagcctactggtctgttattttgttttttcggttttactgatcatgtctatcgccaatactacatgcttatattgattggatagaggcaagggcatgcatataacttgctcatcttatttcttcaatttgtctgatttcttcacatcaaaccttaaagtttaaatatagaattcaattttagttattattttaatgtttctagatagtaatttaggatttaaataattatactgttttactaggatttaggaaaatggagtagtattgcagatcgatcctaagtactaatatttcaattagaagagttatggcactagcttcttgacttttaaattttacacacaccaatatatagtactcccacttaactagtgtatgtgtgttagtttgaagcataagagagacagaaatcctttgtttacgcatgctccctaaactgctaccaatgtgtttttctattaaaaaatctataaaatattgctttaaaattcatattaatcaattttcattttgaaataattaatactcagttaattactcacctcgttttacgtatcttctcaatctcttttttcatatcctctcaaacacaccctaatattattcaatggttcaatgtatcttgcaatgttgagtatcatttttatcgttcccccttcactttacattttaatgtaagaatttctaatcatatcttcatcatacacttagccatcatctagtatgatgtttaacaattgatagtttatcattatcttgtatagcatggcttcaaaatttcgtgtgctactgcatatacggttgaggtggtgcaccttcctccaatttgttctagcttagccactaccttcttcgcagtctccgcgccggcaagcccgacccgaggccgccgccttgagcacccggacacgataccggagtgcgacaagtctgacgtctcgacggtggactccggccggtggttcagcttccagatggccaccatggcgctgacgtcccgcacctacaacctcatcaactcggcctggtggattgggaaatttcagggtgaagtcttcgatgcgagtccttcccgtgcacgcaagaaagggcgctgtgctgtgaggagatcctcagctttgagcatccatggggttcctcaaccttgtgggcaactcctttgggtgctcggcttccggcgagcggctcgtctcggcggccagggacgacgacctgcaggaggcgcgcgcgctgctcgagtacaacccgcggctcgcctggtactccactttcggcggccgcaactcgccgctgcactacgccgccgcgcagggtcaccatgaggtgatgccatttgtctgccaaactaagctgaagtatccgtgtttctgtatagatgggtaaaagaactgcaatactgcattcacattttctgttgcttggatgttcagattgtttctctattcctcgaatccgacgtcgagatcaaccttaggaattacagggcccaggtaaaccaagatttctggtacatttagttgtttaagtttcacttgcgaaattcgacgaggggagggtgacgccatgggagggcgagaggaggcggcgtggactggggcgaaggacggcggccgcacaggaggacatgtggggagagggagatgacttgtggggccggatgtaggtagcgacgtcggtgtcggagtggccgtcgaacacggctaagaggctgagctcgttgccgtcctctaggcggtgaaactcggcggcgacctcctcctctggccacctccgccgcccgcaccctgccacagccgctgccgctccgcccgcccctccgctcctcgtgggcccctttgcacgcggcctgccgcagccgccggtatgcttcggccgccgtcgtcgtcgtcggcatgctgcggcgtgatgatcaagaagagggagagccgagtggggagagggagatgacatgtggggcccacgggccccaccatattttttttatagctaacatgtgggccccatcatttttagattttttttttatgtggctgacatgtgggcccatgatttttattatttttccgagatataactggcacgtcatcgccacgtcaatgtcacgtgggacggagacctagtgaaaccatccacgtaggcgccacgtcagctaaaaccgcctagggacctcatttgcaccggttttgacagtttgaggaccggttgtatctggttttggggttcaaggatgaaaatcggattcgttgtaaaattaagagacctcagatgaacttattacttttatatatgggcctaatggttgtgttttgggctctacttgggccttcaggttgtgacaaagaaaaggaagtttaattttactccttttatagaggccggatttagttcgtaattcttaaccgtaaaatcgggtatatatatcgacctgtctaactattaaaacatgttcaaatagactcctggactgtttttagggtgcttttttttttaaaaaaaaaaggaattcccttgccacttttatgtgggctctatgtttgttcttaattcctcatataactaggctgctaagttagacgcatgagccaaaaccgtctttaaaacagctaaggttttttttttcacgattttaatagttgaaggtaacagagttttgagggatatgtgttaatccggaaatatttgagggagttaacggaaaagtagcttgggctttcgtgttggacctctgctttggcgcggctgcttgctgtgcgtatgtgactccgagtgtgacacgatgctctgtgccaaacctgaaaccctgtgtgcgtgccgccggtaccggcgcttactgcacttgattgtgttgcaacttgcaatgatggttttcagatgcgacgacatgaaatcatatgggtgcagtaggtcgttgataaccagcaaaaccaggtttctctcttggcataatccgcaggacagacatgcatatggaggagagacctcgatcgacatatgtggcgcgtgtaaagtcatccatctgcgagttaattgcccacctgcacatgtggatcgttagttcgttggaagaaaaacaaggccacatcacatgcaacagaaaaagaaacacgcacgcacgctggttcttgctgcaatcggcatgtgattctctgtttcctcggtcgaatccgtacgcacaatttgggtgcgttctcggttgatcgatggccagagacatcatgcatgcatcgacgtatagtgtcaattactccattgattcacacggagtacgcaacagctagaggcactagctaaggccaggaagattacgctggccccacacgtgcaaccggtgcagaccgtttgcttccttatcgcctacgcgtccctaccgagcgcgagaaaattgtgattttgctatcgcaaaagaatggtttcgctggaatactatcccttcaaagtgattcattaaaatactattctaaatcaaggggtgttcactgaaatactattttagatctttttggttgctagaaatgattttactctattttaagttttgttctgaccaaaatactcttgtgtccttgtctctattatgttgtgaacagttgtgaaccatggtgcatgtgaactactattatgttgtgaaccattgttatgtgaggtattttgtgaaccacatgctattcaatattatgtctacatgctgtccaaaattgttctattttgtttttacaattttttcatgcccaaattttatgggttaagctagcttcaccattatatctttataacttggagtgagaaaaatcttaatctgtatgcgcgcttgtggctaaactggactacacaccatttttattgtacaaatgtgaaaacaaaatatattgctctagcaaagcatgtgtcaaaattaaccagagaggtgctgtttgacttttaaaccagtgcactagagcttactagagcttttgtattagtgttaatgatcaattagtatatacatatcacgcagcggagtgtgagccgtacataggtttcacaaatatatagcaatatattttgctctagcaaagcatgtgtcaacctgccattatcctgggcgaaaggaggacatagaggcgagggtattttggtccgaagaaaaactaaaagagagtaaaaatattagtactaacaaaaagatccaaaataacatttcagtgaacacctcttagtttaggatagcattttaatgaatcactttgaagggatagtattccaataaaaccattcttttacgatagcaaaatcacaattttctccccgagctcagcaagttgcagcggcaaccactggtgagtggagtggcgctatggctcagtggatagtcgctgatgatgatgctggtgcatgtacactttctgctttcattgtggcagcaactagcagccaaccacgccgccatagatagggaatagtggaatgtacctttcctggagaaaaataggctgaaattgggaagaagtttggagaaaattggtagtttgaaaaaaaagttgggagtttatgtgtgtaggaaagttttggatgtgatgtgatggaaagttgggtgttgagggaactttggtgtgaactaaacatgcctatagtacagtaattcaggaaattgtactccctccgtctcataaaatagtacagcaattcagtaaattatactacctctgtcctatacatatgtccagatttatcatattagaatatgtcacatcgggttctatatttgtgttttttatggaaggaaggagtatgtacactgcaatacatttaaaccctgtttaaagcgtttaaagcaagaaaactaaaacacacaagaataaaaaggtgcaagaaagcaaaatgcatattagctactcctagtagatgggaagcatcagtgcatctatgtgttgcctgtcggtggaagcaaagcgcgcgagccagccgccacggatgcgaatgggagcgcgccccttctggctttcgtgtgcgcgcgtagcattcactcgcagcggccaaagcaccatcatcctcgtcgcgtgcgtcatggtacgtgccgcggtgcgccgtttggttggcgaacgtacgcaagcagattcagcacgacgtagtacgagtaatggaatgtcacggtccgtgacaacatatcgatcctctcgatcgatctgaacggccggccgtcgccatgattattgatcgtgtactccgcccgccgtggtcaccaccgctacctccttcacctaaatccgatcgatcgattgcccccctcatcaccctgggcttagctagctacctagcgttattattgacattattgtgggcaatagaagggaataaaaagtcagtagctgctattagcactatatcctcctgcctatgacagtgtctcgttttcaaaggcaccccaaccccaaatcctgccctcaagtgatgaacgctttctgagtaaacaagatctgcaaagtgtgggcttcatccaataaagtactactagtagtatactagtattacatcgaagtgtgttgactgatacagtaacattaagataacacatatgcagtactgctacttttctcttgcaaactgtactgggtttcacctaatccaggatcactcggactataatactttgtctgttgaaaagcgatcgctagtatctaggattaggaattacgagtagggctgcacttcagtgtgcagttcctccaatcgcatgatgcatccagcatgtaacctacggccatagatgctccagcctccagctgcagtagcaccattgctagcattgttttgctcccggcaactagctggagtgcttttcttctcttcaccacctctacactactcccatcacatggcatcacatgaggtaggccaaatgctttcgggacctttttcacatcacgtagacagaggaatagctagcgatgttgtgggggcatttctttctggggttcaagatgaaaagctgaacaccgtcacagtttcttttgcacatgcatatgcaaatcgccaacgtacccaccaccttcttgatggagctaatttgattcgcggtgtacggtgtacgtcgcgcatgcgtgctcattcgtgcgcagcaaacacacgtttgactacccatggcacaaataggggtgaagtccaatttaccatctcgaaaccaccggagtgtagaaaataacaatccggtttttaagtgatggttttacaaatttgacatccaaatcgttcgtttttttactcatatggttttttcttgaaatgtcttatatatgtggtaactgttctttacatctcttgctagttgctagttgctagttgcctagctagatgtgccgcggtgaaaagtaaacatacaaaattctagtattgaatcgggttttggaatatcccatctctaatcatccaattgtctacatcgacctcaaatgatattgagggcatgtttggatcaagggataaattttagtccctatggatgtttagacactaattagaagtattaaacgtagacaaatgacaaaacttattccataatcctggactaattcgcgagacaaatctattgagcctaattaatctatgattatcctatgtgatgttacagtaaacatgtgctaattatagattaattaggcttaaaaaatttgtctcgcgaattagctctcatttatgcaattagttttattattagactacatttaatacctctaattaatgtccaaacaaccgatatgacatggactaaaatttagtccctaaatccaaacgccacctgagtccatcccatcctatgaccgctcgaactcccaccaccaccgttgcatcgtgccttctatagttatatgggggtcttaacgtcattaccaccccaatgtccgttgctaccgtggccacgtcccaccattgctcccgccgttggttggtttacttggttaccgcgaagtttatcgtggtttaaaactgatccacgcataataaccgcgtgataatcgtacggttttgcaaaccccagctgtcacaaataattttattttgaaacaacacgcacaaaatagtacggcgtttcgtaatgatagagtagaaaaaaattacaaaactatagccctagaaggctatagtcaggaaaaaaaagacaaccacaccacacgtcttcaaccagaaaatcgctagtaaagaagcaggaacatgacatcctaaagaaaaacgaacctctaaacgacgccttcaggaagggtatgacaccaaggatgccaccgtcgcccgtcctagggtttaggatgtggttttcacatagaggaatccataggggggcaaagagagatcactcaacaatgcctcaaggggaaaactgtgcccgcaaacgtcgtcgttgctggcccgaagaggctaggctttcactgtaatcttcctgcacccccgtgccaccaccaatcgcacaccttcgacgcgcagccaccgtgccggtgcctcttcgccagctgcccatgaagtaggagcttggcattcggcacgctccaaatccatccacagatatgttggaaagggatatggtgtgagggaagaatggatcccctctcccacacactagcttgccaacgtggtcatcttgtggtggcaaggcgctgccacaagaggactaacgtctggactaggacctgttgtaggcctgcaatgcccacctcatggtgccactgtcattgccgcctcggtcggactgcccgtgtcaccgtaggcagctcgttcgcatcgctaccgccttgtcctattaccttgtgccgccgccgaaactccggccaatgcgccgtacaccgtgccagctgagtctgccattggccgcagccccgcgcctcgctgccctccacgtcgtcgccgcatcggcctcctactgccgccgggcacaccaagcaccacgtcacatcagcctcggtcggccacggcttccttccatcgccgactgtgtcgagtcagcctcccgcaggacgtcccacataatggacacgctgactttctactccgtgtgctgtcatccattaccgaccgtccactgccgcagctgccaccacccctcccatgtgttgccactgccccgctgtcgtagctgccgacgtcagcctcctgcttccgccgatgtcatcgtcctgtagccgtcggcctcctgcgtcggcccctaggcatcatccgtcgcgcgtagccgctcctgagtcacttctcgtcgccaaccacaccagggacgcctcttcccgttgcccgtcgtgctgcgctggctgctcgaccccgacaagatccaagcggggacgccagatctggccatgggggcaccggatcaggtcagggcagtgccggatccaccgccaccatactagagttcggtggcggcttcccaagccctcgccagaaatgaagcatcgtctggttttggccgcaccgccctgttttccaagtgaactctagcagcagctagaagaagaggagggtgggagtggcggcagtgggcggcaagggttttgccctaagccgcccgtgtgtgggtgatgcggagctctgtattctattccaaattaataagttttgtagaatgattaagatagaatgtagaatatatggacgaaatttataaaataaggttggaggatgccagggtggagacatatgggggatattttgtaacacaagtatgcacaaacatttattaacgataaatataatttgtaagtaaaatttttatatatgtgtttctcgacttaaaagctaatgctaaaaataaaacacaatacaaaacatcaaaataaactttaaaaacatgttttaacattttatttagctgtagcggataagttgaagagcaaaaattgggctgtacgagtgataggttagatatgcttcaacaaccgttggatagttcgctagctacgcgtgctcactgacaaagagctaccccaagttagagtgtagtggcaaccactactagaaaaagtattttcacaggcggacaaaagtaatttttgcaagcagagggttggaccgcttgtagcacaacgatggtaaaaaatcaacgattttcgcagtcggggcaacagcccgcctgcaaaaatccataaaatgcacaaaaaaaatcacggcggcggctcgccgacgccgccacgcacctcgccgccgccgccctcctttggccggatctgggaggggaggggaggggagccgcaccccgcgccgtcgtcgtcgctgccgccaccccacgccgtagtcaccgccgccagcctcccccctccctcctccagccggatctaggaggggggaggggagtcgccgccgccccgacccatcgtcgtcgccgccggcagcctcccccctccctcctccggccggatctgggaggggggaggggagccgccgccgccggcctccccctccctcctccggccagatctggagggagaggaaggggagccgccgccgccgccgccccgcgccgtagtcgccgccactgccagacgccgcgccgccccggacgccgcgccgctgccgaacgccgctgccgcgctggccggcctcccccttcctcctccgccagatctgggaggggagccgcgccgccagccggacgccgcgccgccccgcccagtgaggagaggtgaggggaggggagggagggaggggagccgcgccgccagccgtacgctgtgccgccagccggacgccgcgccatcgtgccgccttccaagccaccccgcgccgtagagccgccgtcgctcccccttcggcggccggggagaggaggagaggtgaggggaggggagaggaggaggcgtgaggggaggggaggggagaggccgtgaggtatggggaggggagaggccggccatgggtgaggaggggagggtgaggtgtggagacttagaaaaaatcaacccctacccaagtctatttatatttaagtctattttcgcaggcgccgcttaagtggtccacctgcgaaaatagattttcgtaggcggaccgaccatttcaccccgatttatatttttgtaagcggttatttggttttaagagtcatatccgcctgtgaaaataaagcccctatgtcgggaaaaataatttttctagtagcgaacaactcagatatgggcgaggaattttgattgagtaccatcaaatcatcattgaaaatcagggggtgtgatagcaatatcttactgattactgctagctggggaccatgctagcacggcatgagaccatacggacaaaataatagtcgaaataaaaacgatgttggacagttggaatccatcttccaaacgtacgtcattgctaattctgacggtgcataataagggtcgtcgtcgttgcaatagtgtcgttttcccggtaaaaacgacccatatggatgcgagtaaacaaaagggcgaaacattgcatgtgcggccgtgcacaccgcagctcacgactttcttccactctttcctggttcgtgtttcacgccctcccaaactggatttgctgtggcaaagagacatactagtagtgcccccccccccccccccccaacgttaacgtttctccaacactggggggtgacgtggttccgacttccattgcttctattagcaagtctataatactatagttaaccataacatatatataataggttaaccatggcagaatccaaaaaacttttttttatcaagaagctcccgtgtcgttctcacgtgggcggctcaggggcgaaaccctagccgccccggcgtcgccaccttcctcaccccctctggctgcctagtcaccaccgaaaaccgtgcagccaaccgggaaggcggcagcggggaaaacgagccggcggtggagctcctcagtgtgggaggcggagcggcgcaagtcgggcgggaggcggcggccggagtggtcggcgggacggatttgcccccctccacccacggccaaatcgagagtgggtgattccgacggcggcacaacccggtgaggctgaggcatggggtgacgcaacggttgtggccagtggaggaggaggccaaacgtcggcagggaaggggcaactgcgacaacggtggcgaacgccggcacggcgcgtgcgaggaggcgcggccggcggtggcggagtccggagcggcacgaggagacacggccgctggccggtgacagtgaaggccaacgtggtgcgaggaggcgtgatcggcagcgtcagcggcaggcatggccaaatgccatcacaacgcaacgagggtgatgtcatgcggagactggccggtggtgcgcgcgggtgcaacggtgcccacacgccaacggaggttagatggcggtagagcaatggtgtgtcaagtgtggataggcaggtggcgggcggccggtgaaaacatagctcagctttggccaggccggcaattaatggtggtgtttcgagtgtcactccccgtcttaagggcgttgtcgtgccgtctcatcccctctagtgcggctgcagggtgaaaacccagtctgggttctctttgagaactcaacggacggtggtggcggtgctttcatcgcttctctccctagagacgtcgtctaggcagctcccttgccgaaacctcccaaacaactagtgcaagctagctctatattcatgtcctattgtgtcggtgtcctagcaagagcctagggggagagcggcaccgcggtgcagcagtgtcctctgcgtcagagttggcacattgaagggcctagggggagagcggtttcattcttctctctcaccctctcttcctcaatcccaaagatgtagatagagtggtttttttttaagggttgggttttggacgatcttggttgtggctcctttgttgacctagccacggccggtcacgcttaacagcggtcgatctagtggtagcattctcccgggtttgtgcgttggtgctgttggtgcgtgagtggtgatatactttttttcgtttttcctggtaatttcttcatactctatcgatacgaaccttgtattatttggtgcgagtcgttaaaaaagattaatcataaggttgctctattttttctctcatttctctttatctcatgtaaatttaatgtaagtattttgaagtaattgtataactagctctcacatgagagctaatactcctcttttttttaactttttttcacataagtttatagttagcttacagagttatagcccactattattctagatcctgatgctactttacaagcagtgtttatagttgctatttatttttataaattgtactgggatatagaattgaacgaaactaccatgttttcatagtgtcgttggaatgatacgataatactactagcagttaaaacctttttttaaaaaaaataatcatgttttattgcggggaaaaactaaattaccttagcccaaaactataattgatattcctatcattatcttcaaaaaatcgatattcctatttattactactaaggaactagtactctctaaagtaaaagagatagagtgagagaatcgtaatatgggtcatcttctgttgttaaaggtttactttggatttgccctaaatcaattattttacttttaatcgagtaattcttgcactattacagtttagattagcctaaacaacttgcacggtccaaactaaaatagcaaaatcacccggtctaaaaataaaaaagatcagtttagggtggtcgtccaaagtaaaaattttgacaataaaaatggcttaaagtgcaattcacttaaaaaatataactataattgatattcctatcattatcttcaaaaaatcgatattcctatttattactactaaggaactagtactctctaaagtaaaagagatagagatagagtgagagaatcgtaatatgggtcatcttctgttgttaaaggtttactttggatttgccctaaatcaattattttacttttaatcgagtaattcttgcactattacagtttagattagcctaaacaacttgcacggtccaaactaaaatagcaaactcacccggtctaaaaataaaaaagatcagtttagggtggtcgtccaaagtaaaaattttgacaataaaaatggcttaaagtgcaattcacttaaaaaaatatttaatatttggaacaagattgggtaaagctttcaaaattttgattttatattaaaatatccatacatacgatttttgaaactaaatgctactgatggttaaagtataaagagtttatcgaatcttatgctaagcactcaaaatttacgaccgaaggaagtactccctccatactcgtaaagaaagtcgtttagaacagcgacacgatcttcaaaacctaactttattcatgatttatattcccaagatttgatttaaatattgtccgagtattttccaggatggcaggacccgtcgagagagatgcaaccgaccttgcacaactgcacgtatatggccgcatcgcattacggagcgcagacagtaaaaaaaaggtcaaattagtatgaccactgcgcgtatacgggttacgagcgtatgaccactgtagctacagggacccaccagtctatgctactatagtactacctggcgttgcatgcgtcctttgcggtgttgactttaccggttgcattggtttccgtttaggcaagccgattcgtcatcgacggagcctcagatatgcgtcatcgatacttggagcccgcgcgggccgacgggatttacaatttttcgttgaggatttcgtgagcgacatgtccgagccgcggcatctacagaagtccacagccgtgtgcctaattgccaatggactacggagtactatatatttacgcgactagtagctggggtagcgacggaagtaagagcatcttcaacagtctctccatctcactcttcaagctaaattttagctattatagtctaaaaatatgctccaacagtctttccaattggatggctaagtcatccggctggccaaaacccctcctccactagcctaatttggccagccagaaaatcactggcctcccacccccctcctttggcccggatggcgcaggcggccaagacctcgacgccgccgccgatgcagcgccgtgcaccaccgctagcaccggcttccgtgcgccgcctgcatctccaggatggtgcggcggagctcctcgaccacgagcgctgggccgccgccgccggcgaggagggggccgtggcggggttgttggggagccggcggcggagagcacgacagcgagtgtcttgaacccatgccagagcgccaccatcgttgtcgaggtcgctagccgctgtcaccttcgtctgcaccatcgccagttgtccccgtggttgccgttgccgtcgtctggatctggcggcggccgacctccgttgcctccgtccccaccggcgcgatgtggattcgggcggcgcagcatagattcgggaggaggatccgccgtccccaccggatttgggcggcgcggcgtggattcgcgcggcctccgccgccttgctattcgccgccgccaccatccccatccactacggtaaccgtcgtcgtttccattcgccactgttgaggaagaggaggaggggggagaaaatctagaggaagaggggaagaaagaggaaggagggataatagaggctgacatatgggtttcaatgtcataggctcgaaatagggagtttagatggtgaggctgttggagtgaacaatgagtttgactgaccaaatcaattggctagctggctatatgggtatttggagagtctattttgggtagtctattggagatgctctaagtgagtaaaaaaaatataagcgagttataaaagttgccacatcatatgaaggagagatgagaagagagagaaagaaacgaactaaagattagtagccagttgtagcatggactccaagatatatatgaattagatattaattatgcagtgcatatctacaactaactattgtataagtgtgctattaggttggttacaaatgatgtttcaatttttagagctatggttggctatattattaaacttgctctaaatgaggcgagagacgacagtggggagaaaggaccgaggatatatgtgcaatcgtgcatggcgtgcggtccttgggttgagatgacgaattggttatttccgttccagcggccatggatcaggagattccggagacgaaattagtgacgttatatcaaacgtttcacacaccaaactcttcaaatagaaataatggcatcttaatacattctggagcggatatttctcctacatggtaatccatacaacaaaaggtatttttaaaatctatggcatccacctagcagtacatatcacctctttcatgggcttgaccttagcggacaacaccggcaaggcatggctcaaccaccaccactctatcttcggtcgaggtgataatgagaagtaggagacaccagcggacgataggttatggcttgggatatatatctggagtggacgagccaaagagaagacaaactcctcaagctgtgcaacagagacaaaacctgcggaggtacgacagctgagaccatggagctgagcagcaactcatggtgctcaccatccatggttgcctctacatcttctcgtgacggagcttggagaacgggaaagccttgagcttagcgtctattcgtcaccatctcgaggtccacgtcagtccacccccacctcgagctgcacgtctatgaatctcttccaccctaccaagctcgagaaaacgatggctgtctgagctatggtgttcgccactgtgttgatagctccagcaatggccggcgtagagagaagagattaggagagcagagtttgagcttcgtcgccggctatcgcctcaagtgccctctgtgaggggagcatgagcgttaagaagggaggataggggagggcattgttgagagatatgacatgtgggcctatgagtttttattttattcttttatcattggattgacacatttgatgccacgtgtactagcttaggtgaatctggccaaacaatatttaggcaatgtttttcttacacctttcccaacctctgctccctcattttttgcgcatacgctttccgaatcgctaaacgagtacgttttctgtaaaaagagttatacaaaaagttatttaaaaaaacatattagtttatttttaaaaaaaagctaatacttaattaatcatgtacttaagtcatttcgttttgtgtgcgcgagggattagttccaacttcataagaagaacacaaccttagggatgcagcgagtgtctatttttttaaaaaaattagagaggataattcactgtcgaaaacttgagatggtagctcagactttttattatggcaattaaaaaagaaacagtaccatattgtagtcgccacgtagataaagcggtaccatctgcacatgaaagccctagcaggctagcacctaaccaattcctctctggaattcttctggttgtgccgatggatcggccaccccaccgaccgacgcccgcacacgcacagacgcctcgtccgtccgtctctcgtctcacctcgtcctccccaccgcattcaaaactcggctccacttcaccacttcaccagtggcagggcacgtaaatacctcggaaccacggtgtcgttatccccgcgtcgcgctccgccatttaaaccccgcgtcccccacctgtcccttttcctccgcgtccatttccatcacgctccactcgcctcgctgcagcaacctccttcgctcgagagagagagagagagagagagagagaggcacagatttttgggttcgtttttgaagtcctcgatccagccggcggaggggcgccggcggggagcggaggccgccgccgctcgatccggtgagccacattcggttcctgagctctctctctttctcagtgtcgtggtttccgcccgggggggggggggggtgcttgcttcggctcgaagcgtgaggggtcgggcgagcgggcgctgtcgcctctggatcttgcccctgtcgcttcggtgcacgcgaatcgtggggggctgggcctggacctgaatctcttggtgtgctgtggattttttttttatttcgattttgatagttcggatttggggtttggatccgggagttgccgtggttctgatttctgaacttccgatcagctcgaaacgggacggtccagtcaatgaggagagtgcttgggttttgacaagccgaggtgaaagatctgaagtgattggcactaaaattctgtttagactaccgtttggttttctgtttctctgatctgtgcgcggaccgcaaaaattggtggatgcataagttccgagtagctgctgagcattgtggattttggttatgctctgcccatgatgtttgataatcgaatctgagtcaagaattttgggggcattattatctgtgttttttggcattagccttttcttctttgggactccgttttgtttttgagggtgagtgacgttcgtaccgttgtttgcagggttttgaagtggacgaggaactgcttttatggtgggaagttgtagtctaggaagtgattgatatttgagcaattagtccgttgtcagggttgtaacttgtaagcaacatggagggggcggttgctagcaatgtggagcttgattctgcagtcttccaagtatcctcagcccagaacaggtgattcttgctaagatattttttggctatagctgtttaatgttcctatctgtttctccaagaattgggctcaacaaatttacatacgatgcattttattcctctcctctataatggactttccgttttcctttctgcgttaggtttgaaatgggaattttgtacatgatgtgctgatgattgctcaagtcttttgtgattcacaatttcctttaatgaaaatatgaacctcaccctgcagctctctcaaatatttttttctacagatacgaggcaattgcttgcagtaaagggaatacagaattgattgcatctggtccttttgatcaattagtcctgcacttggaagatgctaggaagttccaatcgtgttcaacagctggcacttttaagctgtcgttgtctgggaatgcaaaaggatcttcctggttcacaaaatccaccatagcacggtatctgcaatcaacatttttctagtttttatgtttctccttgcagagaccatgacataattggatcccccttacaggttcctgaataccataaattcaccagatgcctcaaaatctgcaaatggaattttacatgaaatctcacaactggaggaaactagaaagtttcatcaatctctctattctaaggtatcacaactcttcccgtaaaatacccatagtttttagtcacgacgacctgaacatttcaacgtagatgccattataatgagcatttatcttttgtaggaacaacgaaatcctatgggtggtgctttatccggtacattgaaagaaatatttggtcatccattgctctgctctgtcttacttgaatgtccttacaacctttaaatgcacatgtgcacctagactcaacatactacaatctatgctagattgcatttaccattttagtaccagtttggcttgatcgttcagacttttactagcaatggtagtattcctagttgagattatcttttgctgacccttagagtagattaattgttctctagttgagattatcaatgattattttgcttgtagttaacagcaatagttgtcagcaaaaaaatctgagaataatccatccttctataagattctgttaatttgttgtcggtacatttgcaatctaaagtaaccatgtatgcctcaaggtcctcaacaagtactcaaaagtgttaatttattgtagtatgttgataaagcataccttcctttaggaagtctcttaacaagggcagaggattttctgttagaagctatttgtttgagtaggggaattttagttgaattctctaattattgtatcaagcttcaatggcccttaaaattttatgctcactttattgcaatatttaatcatctttgcaggaggtgtctttggtaccattggcgtagaacaacaggtgaactgcttttcatttctgcaagatctgaaccagctttatggttttgtattattttaagtcttacatttcattcttaaaatacctttcagggaaatgttggcccaaactcatctgaagcaacaaagtaaacctttttcttctttttttttttgctactttatcttgcccttcttttagctgacgatctatatgattactatgctaggaatgaattgcttcgagctctggatttgaggttgactgtactgaaagaggagatctttgcgttgttgaatagagcagtcgtttccaatatgtcaactagagatgtatctgatttatcctcatttgttcagcacttcggtgcatcagagttcaggtatggtccatgagcattgtgcatgcagggttcaaggccactgttttttctactaaaaataagtgtaaatgccaaaaagtgttacttagtaggtcaaataactatcctatattcatcgataagtccacttatttataattctgtcattatttggaagaaaactgacctacctgatcacttggaaataacgtgcttttttaagactgtatgttacatcctcatcactgaaattatgtattgtttcttttaattcatgtatcaagaattaactgctgtttttcttgtttgttagctggttgatgcggtgcctactgttgatcccagactgccaaccctctgaggtctcccaacagcagtctttccctgccgagaaagatgacaagggagaaaatgcacttcatactcgtaatatcagctctcataccattatccagaggcctattaccaacaatgtttccccagcaaagcttgctcaaattgagcgtgaaagctcaactgaaagtgatgattcttctgagtccagtgctgaagatgaggctgtcgttgaaagaagccggccactcatgaggtctgcttcacctaggagatctgcttctccaatgcgaagggttcaaattggtagatcaggatctcgtaggtcaacagcgattgccatcaagagtctcagctatttcccccctagtcaaagaattcctttggataaagatgatgaaagtggcagttgcaatggtgaaactgaccagccttcaaggaaatctgacaataatgtaagaaggatgagtgtgcaggatgcaataaatctcttcgaaagcaagcagaaggatcagaatccggattcgcaaaataagaaagctggcttgtttgctacaaagtcagtactaagaaggtggagtgcaggaatgggtgattccttgaacaataattcagaagaaaaaaccatagattccacatcccaaagtaaatccaacaatacaggatccgattcagagaaggatggagctgaaacacaggctgagccaggttcagcttcagcttctaacactgttgttacgccttctgttgaaggttttcacactaatatgcaaggtgttgcaatgccagaaacagagacagcggtttcatcccatactgaaatttctgctgagcagacaaagtcagggcaagaggaaaacagtgatcgggcaatggcctctgctgagtggaaccgccagaaggaagctgagcttaatcagatgttaatgaaaatgatgcaagtcatgcctggaaagttttcgagtgctaatgtcaccactactggcatcacttccacaaatgagaagaaaggtggactgcaaggtcagcataaagagaagcgagactcgaaagttcgaaccgataaaggtggaaggcggccagcaaaggaggcaagcactaggcccttgaaggaaacagttgggcagaagaagcagcaattacccccaaaactggcactgcagctgagaaacgcaattctccagttccacaaagggcacggagaaattcatcacctccggtcctaccaaaagaattgaccccaaaagcgcctgccagaaagagctcacccaaaccatcacctgcacctgtgacccgcagttcatggtcaggtggatctttgactaaagcaactactgcacagaaaactaaaagctctcctgggacagtttcagcaccgacagcaactagtcggagaaggactccagtagcaccctcatcttctcaaccaacttcaaaggtggaaagaagtgctcaaccggtgaagaacaaaaaggaaacagttgctgcttcaaagccagcaattaagggaattgaagaaaagaagactaaaacagcaacaaagacaagcaggctagctaaaagtacacctatttcagatgaaaaatcaagtgcagcaactaggccaaacttgtataacaaggttgcaaagaagagcagtgttgtaccgctagaatcaaaaccatcaaagaaagctactgggattagtcaaagtgctggtactgatgctgtgaagagtaagatgccacaacttgatgactcttccaatgacattggaaatattacccaagctgaagataaggagcactctgctgtgacaacccagccaaaaactactaaggtattggaggctgatcttgctcaaccagcacatgatgttgatgaaaatttagaaatttcgctcgataatgacttaaatattgaaaaaacagaaaattcggccccaagtttagctacaacagaaatggactccagtgaacaggttgaacctcacactgaggttcaaccacctcctgaagaggacatgggcatctcatcagctgcctgggtagaggtagagcatgaagaagttactgatgtgggtgaaaatgtagtgcctgaggatgtcacctcaccatcaattgagcccttgccatcttcaagccctagaatccgtcactcattgtcacaaatgctgcaagcagatagcaatgagccggaaattattgagtggggaaatgctgaaaacccacctgcaatagtttttcataaagattctccaaagggattaaagaggcttctaaagtttgcgcgtaaaaataaaggacacagcaacagtaatggttgggcgagcccatctgttgtttctgaaggagaagatgaacttgaagaaccacgaggtggtaatgaaggtgtaaattcgagcaggagaacatttgatggccccaagactaacagcatcttatcaggtacattttctaccatgagagggcattttttctgcagccagtatagctataggagaaatctgaatatagagtacaagctttagtttttgagctgctctgatttcaccatttaacagcgcatgatgacagtaggtagaaatgcatttccaattcccacatgtttatacacacttaagtgaagtaactgaggtcacaacattattgtttcacaagagtaccaagcaccttttttaaaagaacttgtctgcagcgaagatttatgggatgcttctgaaatggaagagcagattatctttcatgcttgctcacattgtgtttatatttatttcctttctatttcaactatgcttattcttccccagctcaatcaaccaccggcagcttcaactcaacgaattcagacaggttacgggataggcctggagctgccccatcaactaaatgttagttcttgcaaacatagtatcgtcatcacttgcattatgattataataaactgcagccatctctaatacatctttgctaccttgtacttccagcgtcaaggtcgttcttctccctatcaaacttccggagcagcagatcaaacgagtcgaagctcagatagcatgccatgttctccaggagatacatggataattggatagtcgatcccttccagtttggaggtcaactgatgtaaaaaaaaagagatggtttgagattgattgattgttcggacggagccagcttgttgtgtttggttctgggttttctgcaatttgatatagtctctgcgtctaatgtcatactcaacctctcacctttcttgtacatcttttcactttttaacagttgctggaactgcaagcttatttggatccggtcgatgttagggaaactggtgctaatgtaaagtgcatagcgtgagcctgaggtgctcacagccgattgcgatgcccgaacttgatctgacgtcgtgtaactgttcaatgagcctgtgtgcaaatgcaatgttgcaacgacaccagcttttagggggaaaatatagcgtggaaatctgaaaaccactttgggataacaaaaactagacgtataagatttgttctttgcataagatcacatggatagaatagtcgtttactagctatttgtaggacatcatcgcctcaccagctgttaaacataaacatagggtgtgtttagatccaggataaaaagttgtggcttgtcatatcggatgtatgtatatttaaagtattaaacataaactaataacaaaacgcatttaaaatattaaacatagactaataataaaacacatttaaagtattaaacataaactaataactaaacaaattacagatttcaactgtgagatgaatttattaagcttaattaattcatcattagtaaatgttttattgtagcactacattgttagatcatagagcaattaggcttaaaaaaatcgtctcgtaatttacacgtaacctgtgtaattagtttttttttcctatatttaatactctatgcatgtatccaacattcaatgtgacaagttgaaaaatttaccggggcccatagaccatcatcaaagactttgcccagtactaaagtgcaagtcctgagaggaacagattgtcaaaaaatacagcatagtagcagcgtttatttaccacacgcatagcatttatttgctgccaggaatcatcctgctacgcaacgcaaccaccagcaaaactggaaagcgaattcattggtttgtctgcagcccttccagaaacggagaagctgtgcatctttctccaagtctcaaaacacgtgggaactacagagagaaacaatctcgtcgtggcgaagaggagcagatatcagtatatcaccagtcactactattcactagtactccgtagtcaaattagtcatcatttgtcgacaacttcgatcagcgtaggctcatagtgatctggggcctcgaagccatgaagattcatgactgttgccgcaacgttggcaaggccggcactggggagatctgaccgaaatcttacccctggttgaagcccagggcctccaatggcgatgggaacctgcagatggtttcagaaagtgaggtcctaaacagcaactgcatcctaatattgttaacacggtgtattgcaaagcaaagcagatctggaagtgagcctactggattcaaagtgtgtgaggtgaggggctggacatttccatccttgtcgcgaagcggtttgccagatttatctcttttcaccatgtcctccgcattgccatggtctgcggtgaccacgaaaatgccacctacttgttctatcgcatcgagaacaatctgaataagagaattccggtccaccatgagtattttcaaacagtgaaaatcatgcatacaagactgaatggtgaattggtggcctatcaattgttaaaagactgaaaagagagagagcactgcagacatgatcaccttaacagcttcatcagctgccttgcacccaacgatagtagcttcaatgtcgcctgtgtgaccaaccatatctccatttgcgatgtttacccttacctaacaaatgaccaaaataacattaggcctattaagtggattagctgctagtaacaattatcacgccctatctatctgaagtctacccgatgcatggcctatgagctctttgttcgttcttctgaaggaatttatttgttaaatacctgatcaaatttgcgactcaggatggcatcccttgtcttcttcgcaatttccacggccttcatttttggctgttcattgaaggggataccaatgtcacttggaatttcttcgtatttttccaggtttgggtggaagtagccagaccggtttccattccagaaaaaagtgacgtgaccaaatttgactgtctcactgaaaattagaatgacaagatatgaagctgcatgctcaagtaccaacactcagagcaaacactttcgacaagataatgaacagtattgtacctgcaagcatatgtgcgtatgccattgcgcgctaagtattcgccagacgttctctctatctctgggggagcaacaagaaaatggctcggaagttttagctcaccgtcgtactgaagcataccggcatagcgaatcttggggaacctgacacgatcaaatttgtcaaaactctcgtattctagtgcctttgcaagcatgaccatccggtctgctctgaaattaaatgtcacaacagcatccccatccattatagggccaatcggtcttcctctttcgtcaactataacaaatggcggtaaatactggtcattggcctttggatcctccctgagcttcttcacagcttcaagggcgttttgaaacttatgtggcgcttcaccgagaacctgtgcatcccaaccacgcttcacaacttgccagtcattctgcagaaccagtgaaaatttcaatcatatttttggcgcagagaaaattgtgccatgacattacaaaaggcaagtattgagcagctagcttcggacaacctcttatgttaagaaatgcagctagcatatgcaacataagtggtaagatataatgagttcccggagtagtaactgaactctgaattcaaatgcttgacacatactccctccgttatcatattataagttgttttgacttttttaaagtcaaatctcttgaaatttgaccaagcttatagaaaaatatagtaatatttatagcactaaattagttattttagatccaacatttttttgtgtaaactattagatccaacattgaatatattttgatagtttctttattttatgttaaaaatattgttatatttctctataaatttggttaaagttaaagaagtttgatttataaaatagtcaaaacgatttataatatgaaacggagaaaatacctcataacggtccatcgtgacatacatcctgccaccaccagatgcaattcttgcatccacacccttatcccgtaatttagcaaggtcattctcaatcaattccacaaacttgacactgctaccgtccaacacatcacggccatctgtaagtatatgaacccgtatccttttcgctccatgctcactggctccttttagaagcagctgcaagagcccaccaaaagaacattaacaagagaaactgagatagttgtactactactcaactacaactgatcgacggatgaagtttgaaatttaattatatcaacctgcagctgatcaatccttgaatgtactcctccatcgctgagcaagccaatgaggtgcaaagtaccgttctcgaaggactgttggatgtacttaaaaccttccccctcgtatatctttccagaggctagcgccatatctaccagttttgcactgcgcattgtcagcaactgatcagtaacttggcatttgagatgtgcatgcaacactcatccatgctaccgtagtttttggaacaatcaggttaaggtgattaaagctggtcatactcacgcatgatagtactcctctgttctaaaatataagactccttgtgattcggaaattcaacattgaaaattttgacattagattcatatttcaaatatttccatctgatattaatttcatagttattgataacaaattatgaaagaaatcaatggtcaaaatatacatatttttacataaacggtcaaagtataatattggagaccctgtaaaagtctaatacatcttatattttaaaacagagagacttgtccaggaagaagagtagtgagataaaattattcataataaaagagttaagattcagcattcaacagctaggtccctgtgcaactgggctgcattactacatactgtcactggagggtgtgaatgtgcacctagagaattagagacattaaccatcttaaatgaacaagccttacttcagaagatatttacagcaggttgaaaagtaaattacgttctacttcatccgtctttcatttttcatctatcgcacatatatcaataaaaaaacaaaaataaactataatactcttactttatcaaatctcaatgcaattattttctacttcatctactcctaatatatttatcccctaattttataaactccgtgatcgctaaataatgaacttattattttagtacaaacggaaagcacgaaaaatgaaattattataggatagagggagtatctagttagcctgaacaacccaacatgcatttttctggtgtatatactactccctccgttccaaatataaggtattttttatggatgcatggaacatatcctaatactatgaatctgaacggactctactatctagattcataatattagaatatgttctatttatctaaaatcgcttatattttagcatcgagggagtatatgcagagtaacagaattgcaggtacatgcagaaaaccagaaatcaagcagagattgctgctatgctactatactagtacagtaaagggcccctttgaatcgcaggattgaaaaaaaacgtaggaataggaaaaacgtaggattttgatagaaatgtaagtggaaaacagaggattgcaaaacgcaggaaaaacacaggaatgaccgtttgattgaaccgcaggaaaaacgcaggaattggatgagagagatagactcaaaggaaagttaccaaaagattgaagctcttgctaaattttctccaaaatctctataagattgtccattccataggaatttcaaaggattggatatgattcaatcctttgtttcaaagggcttcataggaaattctatatttcctatagaattaaaatcctctaaaatttttatatgtttttcctccaattcaaaggggccctaaaactagtattacccctgggcatatatctggcctgctccaagcgcgttgtggccaacctcactgttgcccatgtcgtcgtccgtaggcagccccaccgccgtcccgtgagccttgatcaccctccacctctccggaccaccctgcacgcgccagaaaacacacacacaagtctcgctctcagctgatcatcatgggaagcatcaaacaaacgtcttgttagcgttgttactaccttcttgagggcgtcgagggttggggtgtcggcgacgtggatgcagttgaaggtatccggcgccgcctcgccccagccgtccagcaccaccacgcccaccaccttccccttctccagcctccggtgagccgccagctcccaccgcctcgtctccgccatcgagaagaaaaaaaaaacgttgttcgtctgcctcgacgttgttcctcttctctggtggcgtcccgccgcgagccaagctgaagttaggaagaggaggatgtctggcttctttttatgctgcaactggaagtgtccgggcgcgacgaggcagctggagagatgtccaagtgttaagaggcacttctcgttgtttagttctttcttgtgagcttacgtgacagtgtgacgcggacacatgtcgtgtgaccccgataatcatccatgtatacgttcgtgaacctgcctctataaattttcatcttaagaaagaaagaatcccgccgattggaggcctataatccgtcctatcgggctgagttttcacaacacgaggccgcgtcatgtgcgagagaggcccaaagggcataaagaacccgggccgacgaacccgctgatctgccgacacaaagtgagtcgttcgccgagatggcccacccgtttccatcaagagagccgggccgacacaccgcgccggtcgtagtcgtataggttgtttagttggcatactcacattatcaaaacttgctatactttatttagctaacatgtctaacatgtggccaacaaaattaaagccacactttagccatagtagagtaaacttgccacacttttatgtgccaatgatatgtgggacccacatcacggtgaaggaatcttatcaaaagtgtggcaccaaacaaacgaatgtctaactaagttaaactttggctaatttgagttgtggcatgatgaggcaaattttggtagtgcggggctgcgggcgcacacggagctctcggcgagccgcgcggggagcgccgccaccgaccgctcgggttgccggattcccagccgacaccgacacggctgatctgatcaatcaatctgtggctcgcggatctctcatgaaaccgagggtggcgttccaaaaacaggtggaatcacgacggtgccgtctctccatcctgtttgccaagttccgtgccagccatctgcgttttctgccatgccaccctgacgccacactgcagaactccacatgcaaactgtgtattgggggggggggggggggggtggtctgcgacttgtgtgcatatcgagtgtagtcccggtgtgtgccgctttccgtagttcccacggtatatcgagtgtagtctgcaggcgcactcgccactatagaatatcatcggcatttcgttttctgctctttgcacgttctttacccttccctcgctaacatcaaaagttggacgagccgctttgcgtgctgggcttccaaaagcaacgctcaaactgaacgtgatataaaaaccaactcttcctcctctgacaaagttacgatcataccggtggtctttaaactacatgacgggctgaactaccgtagaactgacaaaggccgtgtttagttccacagctatttttttaaaagtatatgaacacacatttaaaatattaaacgtaaactaataataaaataaattacagattcttataaattgcgagatgaatttattaagcctaattaatccgtcattagcaaatggttactgtagcaccacattatcaaatcataatgtaattaggctcaaaagatacatctcgtaatttacatgtgaactgtgtaattatttttttcatttatatttaatgctctatataggtgtctaaatatttaatgtgacagatttttttaaagtttaaaggagactaaacacaatcaaaagtgacgagagcatgggggtgttccttttttttttataccctccctgtctcgtctcgttggatgttgctggataagccggcctgtagtaacagtcgtgtatctagggaaggatggcttctctcgtcgtctctttccgttcattttccagagcctgacactgccgattctcgcttagaataaacgacctggcacctggcacagtgccatgagttattttcctacaaccggcccaatccaatgaatccatggtctcggtttactcaggcctctagtatgatattagtatctgccatcccatttacgtgtcagcaccgggcaaattagccgatagattaacaagacaactagtagcatgtatcatgagtaagcacgcgctgcggagttgttaatagcagcgcatctcggacttaacagcttaattacggtgagttcacatgcggagcacacgtacaccaagaatggccatcccaggcggccgtttgctgatgataatgtctccccgtcgtatgctgctaataaagtgatcacctaccaccgtacacttcctgacacatgggggagttagttcgtcctttctttgagaggagcagatgaaggagtagctgtttattggccttgttagggggtgtttgggagcccctctcacaaaacaataagtcttattgtgagagcctctctctcccaaacattcccttatttccataactttgattttcaagtctcatgttaaataattatattgcctacttttggtgacatcgttgagtagattgtgcacatgattgtcactattttttcaacaatatatttttaggactatagaaactatacaatgctatggatgcatgttgcaaaacaaatctaacgatatgaattttaacattcaaacttcaaagagagtgatatccctatcagaaaatagagtgatatctcgcaaaaaaaggggagaaaaacagagcaatataggcatgtttactttgatgtcatttttaaccttaccgaattttggtaaagttactaaataagtggctacatttagtttgctgttaaattgtcgaaatttggtaagttttttttggcatcaaaagtgaacagaccctaagtttaccatttagtactattggttaatgtagtgttttcgtcgagccggaaatcccgaagcggttgtggttgccggcctgccgctgctgtccgggccttcggcgtcgtcgaaacggcggggcgcacgtcggttttcgccgtggtgaacgggggaatggggtggggatacgcacgcgggtttgcttggtcccgttcacgcggcgcggtatgggtgtagccgtgtagggggtcagcggtttcgcgtcttttgtatcgtcccctcctcgtcgcgccgagccgaaatcatcagagacaacggctacggtgggatgctgccgcggatcggaggagaaaggcagaaaagctgtggtacgaagggcgcaggtttccgcagaccgcaggcgaaatgaccggtagcatttggagtccactcctaccgaggcgacatggctggctcgtgacatgtttgctccgttggcatggtgtatattccggtttttcattgcttgggatgtttttctttggatgggtggcttatgtttatggcaagtactgtacgcagtactatgaacagtaaactgttttaattaagggccagcttggagctaataaatccataaaatgattaggaaacacggtgccaaaatggggaagaaaacaaatatggttttcaactattaatacatggtgcacagcaatataatcttatactccctccgtttcaaaatgtttaacatcgttgactttttagcacatgtttaaccgttcgtcttattaaaaaaatttgtgaaatatgtaaaactatatgtgtacatgaaagtatgtttaacaatgaatcaaatgatatgaaaagaataattaattacttaaattttttgaataagacgaataagacgaatggtcaaacacgtactaaaaagtcaatggtgtcaaacattttgaaacggagggagtataacctaatgatataaggaaagagatcgactttttaaagacatgtgactttgagtcactaacatatggattcaatttgctatagatttacaaaaatattaattactcaaaattacgtgatgaaatggtggaggatcggtcttaatgctggaaaccattcaagttccatggaattccttagaaatataggaattcctaaccccgcataagtatttctatgccgcattttttcctttgtttaaatgataaattaaataaaaaattgtggccatgtgcaagcactaaatggatacaaacaatctgttcaggttctaaacctttcttgcacaatccgacttccgtcgggaccggcggtagctaatgaagaaagcgacgcaaaacgaaacagaaagcctactccaatcgttgctccgtttcttgtctttctttggatataatctccggtgttaggtccacacacaacaaataaaaaagagcaatgaagccttcaatttgaaggatgtgtgcccaataaggtttgtcctactatatcaatatatatcatccatgcaccattcctattgattcttaacacacgattgggcgcgaaaatgggaatgccaatattatttaaaagcaccgacaaacctaaacttgaaaaaggcctatgaaaaaaacagagatggggaaataacgcaagagggttctttccttgacaagtatgtgggctatatattgtaagtgtactttagaaccttctattcacttcgcatcgatgcatgttgcttggcccttgtttagtttctaattttttcttcaaacttttaactttttcatcacattaaaattttcctacacacataaacttttaaattttttctttaaacttctaattctagtcaaacttttaattttgatatggaactaaacacacccttagtaagggaaaggcatggaattgtctgcagtagttagatctaggggagaggggctaaagtttaggtagagaggcctctctccaaacacccccctagctgaagcatttaaaggtgctactaaatcagtactcctgcatgttctagggctgtttggttggtggcctcagtttgccacaccagatcttaggcgtgccacaatttttcaggctagtgtttggttgcgtgccgcagttgagtcaagccacactttactagcacattggcccacgcgtcatactctcatttgctagccaaagtttgccatagttgtggccaacaaattgttggccacactttgtgtggcttaccacacttatagcaaatcgagctatggtaaagttagcctctattcaaatagccccctagacttgtagtgagtctagccagaatttgttttctctcttcaacagaaaagagagtaaagttagaaaatgaacaggaaagcgggagatccatcatcatcatcatcattcatcacctttccatattttcctgaccactctttcagttttcaggcattcgtgtagccaggaaaaagtagccataaggtcaagattagtgtaatacggagtagtagtattactactagcagggagtaaatattatttcggtagaaaaatgcacatgcgcgtcattgtcattaaatttaaatgagttggtgatactatctactggtagtaatcggaagcggttgatcttttgtggatatgccgttgtgtggtgtgtttgttgtcactttgcacgccctacatttagaatgggaccaaacaaggtttttatcgaggggatcaaataagttagaccaatttaaaaactactccgtaacatgcatcatctggtgatatatcacatttaaagtcaaatatcatcacatttttttaaatataatttgtattttatatttttatttgatcaattcgttttgctttagttattttttctacgtaatgtttttttcttagagataattctgcttgctactttttataattttgcgagtaaatatataattctaaaattatatcattatgaaagcatcccaacaaaatctagacagcttcagatatagtgatcaaactttacaaaggttgacaaaaacatattatagagaatcaagtaaacaaaatgtgtttattaataataagtgttaattggatccatgccatgataaatttatcaatttggtaaaataacattactattcgtgaaacatactaggtgtcactcaatttttctaaaattcaaattgtgccatcaccaccaagttttatatcactttctccccaaccacattccatctggatctgagactaagtaggaatgagcttggcaactaaatggggtgctgattgaagctaacgatgaccttccccagccaagtaaaagttcaacaaatttctgttgctgaaagagaatcaaagttttcctacaaagagttgccatttgttcttctgtcgtaggtggggttgatcacatccactgtgggcttcagctcgctgctcgtcaggtgatggcggtggctgagactgcgcgagaactatgcaaggcggtggctacccttgatgccgacctcatacgccactaggactcgctctctctgtttgcgtgccgtccttgccgtgtcgtacctcttcgtcatcgacctttcttgctctgggggcttaggcgctgctggccttgttgcgcttgtcttacaccgaaatgtgttgggtaagaagacaacaaacttgatggctgtggcacgattcaaattttagaaaatttaagtggcatttagcaggtatcacaaagagtgatggtattttttaaaaaaggaattgataaatttgtaatgacacagatacaataaatcctaataaaaaataattatttgacatatattgagttgtgttaatcttcgattatgaatagtaccgaaatttcattctttatgaccaatgatgatttggttatcgtttcttttattattttgctggcagtaaagatatctatatgtattagcacaatagtatgatcataaaccatgaatcatacctagacattattttaggtacatggaaaatagaaaaataaacaagtatatatatagcatttcctagagaggttactatgctcacaaacgcaaaattaatagagacatcgagcacgagcatactccaggttgttgggggaaaacctccaaaagttcaaaaccacatgcatccacatcgttcgccgcagaagatcccttgtccccgccgctgatctcataatatgcgaaccagttggccggagttaaactaaacagcaaagcaaatcgaaataaatcaaatctccaaagtgaaaaacatacatatctccagagagagagagagagggagggggggggggggggggggttattctctttggcgtatatcacatcgcaccgcaacacacttgttttatgccaaagcaaaaatcctctcccatcttccatctctctttccctaggacgcgcagcgctgtttattcctctccgctccccttgcttctcgcgcacactaaccaatccgagcatctcgcctcgccccgccccgccccgatcgatcgactcgagcgccaccccacgccgccgcccccgcgccattggccccagccgccgggaggcattcgtctgcgctgccccgcggcggtggcggtgacggtggaggtggaggcggtgtggcatgatcgatagaggagtcgggagaggcggcggaggaggagggggaggaagaggcggtggagatcgctaggagtggtggtggtggtgggaggaggaggcgatgaaggcgacgcccccgccggcgaagaggcggaggggcccgcggctggcggtgctggcgctcgtcttctgctcgctgctcgtgccgatcgccttcctcttcaaccgcttccctgccggtgagttctccgcggccgacacgttcgcccccacccctcgcgacgcgacgcggctcgagcccccccggattcgggggaatgcgggtgccgccgcggcctcccccccgatcggatcggcgccgttcccggcggatctgttccgggggctcgctggttccttccttgtcgtttagtgtgcgggatattgggttgttttggtggtattcctgttctcttattggggattgtgttttttgggggtcagttttctgattggtttggatgtttctgatgcagtgtatgtgacggatgagcgcccccaacaggtaacttgttgtttctagaaatgtgcatattgaactagtttttgatagtcttgtgtggatgttttcttacgaaaatgctgtttgtttgggacaatatgtgtcactcattgctattttggtgatttgtgtttggtacaggagattgatttgccttcattcggacgcatggggttggaaaggagcggtggagtaaccgtagtgaagccggaagatggcagtggtgctaacgcagagacaaaggttagtgattttctgtgatctttttgttacgtagtgatagtgattaatccgtacggcattgtgccttgtgctagcttggtggattttgacatagtcatgcaatgtaaaactctgacatgatcatgttgacgaaggttagtagcttggcctttgtattgcattttcacctctatggagaaggacaaaacatgaataaccattaaactaataacattagcattttatttttcataggctggacatgtcgttgtatccctcattcctcctaacgtggtttagattcttggttggttactgggttttaataaaaactacctggtttaggtgcatttgcattcaaatgtatttttgttcttttaaaatttgtatggcatggtagataaaacaactggccataacacaactgagtttacgactggagagcatatcaagacagaccatgtcaaattgaacttatccagtgaaacgggttttttgtcagcttttggagaatttggcgaactagtcataatgccgtagactgcactgcttctatactatttctcttggactgagtatgacaactgagatatggcatgctaacacgatttgagccacaaaatccaactgctacgaactacccccgacatagccaatgagcaaagcaatattgcatatcaatagtacctccctctattctagtctctttgttcatgattatgaactgcgaaggatctggaagatctatgcctgcagaaatatagaattagtaattaatttgcttcttttgttcttaataaatactgcattccataacagctccatatgtattgtaaaatcccttattcctcacacccttttctcttcctttttcaggatacacctgagatgattcacaggggcggtataaactcacatcaccatagtgataatgtcccttccaaagttagtgctaacccaaaaggtattggttataagattagaaatattataaattagactcagttgtatatatgtcaaaactattaaaaaaatacaggaagtgccatttgggcaatttaatgtacaactttgaagaaaagaagcatagattgtttttcaattttgtaggaaaatgtttatttggataatattaaaaaacaatgcagttatacatcattttggggctattgaggatgaagaccagttactattcaatatcccaacacctgcagtttactagttttaatatttacattcatgtatagtgtggcaagatggtgacttctattcataaatggtgttttgtgtgctcaagctgtgtatgagtagtccatctattctattctattttttttgttcccttagtaaactcatattttatttgactgtcttattgactcaataattggcacctgtctgcagtcccccctccaccaaaaattgaaccactgaagccaaaggcaaagtcagtaccagttccagttcaacgtacagaagtatggctcttggctagttgcagttacatctatgaccttaggctaggttgtaatttggttgtcgtttttaatgagaaatgtgctgatacattttgtttgaataaacatttactggtttcaggttattagtggcaataacatgaaacctgccaaagttcaaaatgcggacgatgtggaaaaggctaaggcttgtcagcttgaatttgggagttactgcctctggtccatagagcacaaagaagttatgaaagacaccattgtgaaaagactaaaagatcagctatttgtagctcgctcgtactacccaagcattgccaaactaaaaggaaaggaggcactgactcgtgggttgaagcaaaatattcaagaacatgagagggttctcagtgagtccattgttgatgctgatctaccatcgttgtaagtacctagcatgcatattgtgattgcccccttcaatgctttcagggtccatcttttgagttaaaactgtgaaaactaaaacatcctcttttgtgtgggggtggtaactagatcatctatgtactgcatagattcttctgcaagcaaaagaattgaaaatccatgtcttttatatcttaatccagcactcatgtgtcaaaattttcttttaacatttctatgttttctgagttgtaaatgttgaacttgcaccttggtagcttgacagaaatttcagtctggttctcttagtaattaacacttaaattgtgctttcagtatcaaaagcaagatagagaagatggaccaaacaataggaagagctaaagcatgcactgttgattgtagcaacgtcgacagaaagcttcgccaaatacttcatatgacagaggatgaagctcattttcatatgaagcagagtgcatatctgtacaatcttggtgttcacacgatgcccaaaagtcatcattgccttaacatgaggttgacggtagaatattttaagtccgctccattggattcagatgactctgctgtgcataagtttaatgttccagaccataggcactatgtcatattatctaaaaatgtacttgcagcttctgttgtcatcaactcaactgttagtaattctgaggtatgcaaccaaattttaacacattcaagttggtagaatctgctctacacttgccatttctgattttctttttgtgattttgcaggagaccgaaaatgtagtatttcatatattaactgacgctcaaaatttctatgccatgaagcactggtttggaaggaactcctacagggagtcagctgttcatgtcataaactatgagcatattattttggagaatttgcccgagttcagctcccagcaattatatttacccgaagaatttcgtgttttcatcagtaatcttgaacgacctagtgagaaaaccagaatggaatatttatcagtgttcagtcactcacatttcttcatcccagaaatattaaaagatttaaagaaggtgattgtgttggatgatgatgtggttgttcaacgtgatctctctttcttgtggaatattgatatgggagataaggtcaatggtgctgtcaagttttgtggtctgagaatgggacaactaagaaaccttctgggtaaagcaacatatgatccgcagtcgtgtgcttggatgtctggggtgaatgtgattgatttggagaaatggagggagcataatgtcacagagaattaccttcaactactgaaaaaggtcagtcctctgtttaaaattcaaaaacataatagtgtgcttagtaattctgttccatggggccacaaatttgctaattatatgggatcatgacttgctatggtcgttgaaatgaactgctcaaacttttctctgagaatgtattgttagcttatttagtaatcttattttgttacagttccaacacaatgatgatgaagcttcagtgcgagctgcagctttgccaataagcttgcttgcctttgaacatcttatatatcctctcgatgaaagattgactatatctgggcttggatatgactatgccatcaaagaggaacttgtccggaattctgtatcattgcattataacggtaatatgaagccttggcttgagttaggtataccggactacaggaagtactggaagaggtttcttacacgagatgaacgattcatggatgagtgcaatgtaagtccataatgcacttaaacctgggaaacaaaatatctgacggtagattgctacgtctgctgctgtattatatacctagaggggacgagcacttccattgaggaaaaatggggccaggaaagcagttattagccatcaattttgacagagtagatccagcaccatctgttcattgaattagtgagcttgatggatggtttttctacagttagagaaattagtcttaagctgaaggataatgcagtagacaatgatgatgagtgttagtgaggcttcaggtaaagggagcatcactctcaccttctagagtacgggacagaacgatcgatcggtggtgggctgtggcacctttattcaaattggtaccttgcgcctcatcgatgcaggttaattcttttctttgttgaatttttttgacccccttgttttgtcctgtcaataagggcatacacaggctaaattcaaattctttgttcttagttgcacattgattgttcatcatttttgtgtcggtggaaagtatattttgttgtcagaaaaccatcagttacacaacgagattgacagctgtttggatatcttttgagtgctcaagtccaattctcattctccagtaaattttccaatcttgtattcctttgtattgcattgaaatgggtgtgttatcttgcaaccatcaccgtttcaagttcagctctagaagagagtcatccataaaatcttatctcatcctaatttcaacaaccaatctaattttcggctcaccgaactcgtttgatctacaatatcataaatgtagccgaataaatacgcctgattcagcctctgtagtctgcactgcagttaccactattgtcaaaagcaataccagtgctaccgcggaatcaggcatattcgacagcccactcggactcggccactgcctccgcccacgctggacttacatgccaaaacttttcaccccgaaactaaacagggccttatgttcacgacatgccgcgagttcacggtcattttttttccttttctttgttttcttgagatgacaggaggtccggagctcacaatcttcactggttacttgaggggataagtgcaactactataagcttctacacacttgcctctaaatgtcatgtaagctcatatgatgagctggatgagagatatgaaagaagagagaatgagccatctctcatgtaagaggtaatctctatacaaactataagagagatgataacaaagagaccaatgaattgataggaaacagataaaataaaattaatactccatccgtttcagaatataaacatttttagagttagacattattattaagaaaatagatacaattaaatagggaagggttgtgattggatgagaagtgaaggtatgtaggaacattgaatggtggggagttgtgattggttgaaaagagaatgttggtgtagaagttgttatatttgggacaaattctagagactagaaattgttatattttaggacggagggagtatgatgtggggcaagtgtgctagaggtaatttgttgtatctatattgcctcttaattaatgagttgatgatgtgtactaaattaagggtgactatcacctccactataaaacttgccctaaagaacaccaggatcagggtgcctcgaacactaggagggaatgctatcactatgcagcagcgcgggactccgcggtagcggatggccatggaaccagcaataatcgttgtcaactgtcaggttctttttcacctacttcgagcaccaccgctgcatcttctcatgatgccactgttaccgttctagaccagtggtttagcccctctgctaccaacgttgtttacgccgttcaattcttgttcgcgcgtattggcaacattagtgcacgcatttgttttgagttgttcctagggttggtaaagccggtatgatgtctaatccttcacggtttgacaatttcggttattcgacgtcatcttccacgactgtctcgattaagttaccgttttcgtcttcagtgcgtccctatgaaccttagtccagggtgtcgttccatgtgcccacaaccactcgttggcaccccttgtgccctgtgacttggctaaattgtccatggtaccccgatttcgattacatcatctaaaggctactctaatcacgaccctttttgaaattagctctgtcgcagtccacatttcagctacaccgctatcattgttaagtcatcctactgatgtcttctctagcctaaacgttcgcgatgctttcgcttgaattgtgaagggaaattttaagtatatagtagttgaaagaaacgctaggaagagaattcatttgtggattccattactgctatatatacccgcccctgatcaatatccatcatgctcatgcaacgtacgcaccaccccctccggccctccccatccgagggcatcctcatcaatggccgtgctgactgctgtgactcgaaccactggccgtggacacatcaacgagcgccatggcgggtgggtgccattgcacgctcgttggggccgtgccgacagccgacacatgcacggagatctcacgccttgttggaagcagctgaatcatacagccggctaggctattgcagttttagtttggattcctcgaggagaaatcaccataagactatttgacttgaaagcttcaaacaggtttagttcaaccttaccaccattggttcatgtacttccaaaaaaaaaaaaaaaccattggttcacattcaagagataccagtaactcgggacatttcagtacctagctcaatatcttctgagctgcaaggaggaagagggagttccgtagccttttacaactgactccctgaaataaaaattgtacccaggaagatggctagatctcaaattctccttatttcatagtaccggagataaatttgagttattgctactgaattataatacaagcggacaccaaacagttccccttctctattaggcttttttatgttccttttaaatagttcagctcaatagacttggatcagcactagaatttcagccaatatagatggaaccatttttcttttaccaagtacatgggcagaacagctataatctgaatgcactctacattcagatgagttaactgtcaagattcatgcactctacgacgcttctcttgggggagctccgatccatcagttgcaattactggggaatcaggggactcggttgctgcagttttcaggttggcacctacattggtagaatttttagggtggttgtctcctattctgtttgggtccaaggcagcctcactgtccttgtctacagaattgcttggctcagatggagttgctgtatctccagacgatggatcctgcacactctgtgtgctggatttacattgcttttcaaacatcttctgcagatatttcccttgttcttcaattcgaagctgcaatttcctctgaatctgcaatagagcaatcaaatgtgcttcaggtcatgggaatttaatttgaagtatatgagcatgtcctacccctatattattaagaccagtgcaattgtagcatgccacattcctgcagtcacaattttgttcattgccacaaactagtgtcgaaaggaacatttctgagtctcatatttgtatccccaaaagggtagcaattgttgcatgcctcttttagtttattaaggtgccatttgcccatttggcatgagcctatttcaaccaaatttagagtcagtgcacatgcttttgaattagtacctcgagttgttcatgaaggcgcttctgaacttccatctgaaggcgcagtgcttcagtaagatccatgctcctacataagcaaaacaacataatgcaagggtatctagtactggtgactgggaagaacatggtgcacttactgatccaacagaaaaatgaacatgaaataccaccattccctcaataatgcataatggtaactcctaaacataatttgaagtaaaatggatatatcttctattgtgctatatgagcaaactgtagatttgaaccatactagtaggcgaatccctactcttattttgaaaccatgctagcaagtgaatcacaaatatatatgtgcgaccaactttttctcaaggcaattatttactttagtcggtaatgcaatctgccatccagtcatgcctacgctcttgatctgaactttgatgcatgttgatttgtaaaccacacagtaccctacttattagttagcgccatgtgaagtgtaccaaaagtacaatgaaacaggagaagagacgatggaataataatatccactcacgctttcaggtccaaagacaactcatcggtagttttcccttcttgtgttttacctgcatgatgagttaagaaaaggtcagagttgtcttaacaactcacataaactagaatatggttgcatgcgtgctattttgcaacaagggatcttacactaagtatttaatatttcatcatgaaaatatgcttttacaaataaattcacagcccttgccattatcatgaaaattgtacttaagttattgccatgaagttctaaaaaaaaagttattgccatgaaaaatgagttcccgtatgtaagaatatgtataaataaaatgcaagtcagagaggaacccaattgatataaaccttctgataggtctggcttgtagcgagctgtgcggtacttctgcagtaaaaataagtgcagataaagaaagtcaaaactgaagtctcctttcagcaaatatgacatttagaaagattaaaaaaagaacctgcagatgactcttaacatgatagattgtcaaaccatcaactttcataagcttgagcacaccttttggagtagcttctgaaggttttttttttttaaaaaaaaaaaactattagactatgccagaataggattcgtatatataagagaaaaccacttgagtggtatttacgacacggaggacatactttcactaccaccaagcttatttacagcatggacaaaagattcatgcaattccggggtccatctcatccgttgtttacttgcagaggcattgctgttgttgggaggaggacttgtgacaggacaaatatcgccactatgggatgaagttgactgattgaaagcaggctgtgatgcagcagaattggaaggttgggccatggactgtaacaaaagagatccataaatatttagcattctgaccagggtagaaacataaggagcgctatctatagcatcagggacaaaaaaaatgcgttaaaggtaagatgcagtatacattgcttagaatttccaggagcagcctatgtcaagaacatgaacaattcgttacaggatttttaacacattgaatcaaatatttaatctaccaacagccacaatctcttcaagccaaggaacaagtaatcattgctcttgtacaggtaatcactttaacaaatgacatctcacacaagtttcgagcattcaataaatgaatagataaactaacaaaatgcccttgtgtaataagggaaaaaaataccgccatggttacagaagtatgttgctggaaaggcaaaatttctctaaaattaatcacgatcatataaattagtaaccgggttagagtgtaggcagatggtaccactattaccagtaggatgatgtcaaaatactctcaatagattatagtgttagaaactttcgtcaacatgttaaaataaataggtgtatttctaaacttccagaacacaagaaagggatacaactttactctttatggtattgcagttacatacctttgactgagaatcagtagctgttgcatctagaatatctttccagtcatcattcattatatctgcccaccattcattttgtttagcagcatcagatgtaacagtagaggagccgctctgggtgtgattatcagggacagttatagtatccatgtaatctggcgcgccacaggcaggagctgggaaaaaggttggcacagtgtgtcccccatgggtattattattacataaatactggagcatttcagcattcgacgactgagaaataaagggagcagccataaaatgcccctcatggctagacacagaatcaattgggttagcagcatatcctaacattgctgaatatgatgatctgacaacactggctcttgggtgcgaaatagaagattgagttgcactctggtgcaaaggcatagaatcatttggcagttgccctggcatcagaatattctgggtattatgggatcttgggatatctttcaaagatttcggtagaataggcaaggaggatgacatctctccagaaatacttgttttgcaactgcctcagatcaaacttccctcactgcaattctgcaaatagtgcataagatttgcttctttcccataaaatagtttgaatgcctttctacagatcaaactcgcccaaaatgttagtccatcactctgtacatgattaagaaatgaagagttaaaggggtgagcttattttgaggtcatggaaataatagtataattgtaaggaacatatatagactgtaaataatatttcacacatttaagcatgctggaactaatcatgaataagcagcagtgttgctagtgtcaagcagatgacacaagcagaaaacaaaaacggctaagccatgaaatgtacatctaggtgtaaaccttttgtacactgatgcacaacaacaaattttacacccccaatattttgaccactccaatggtagattacattgcataaacctcatttattagcattacaaaccggatactttcggaaaagttaaaatgtaatacctgcgatgcaggttcgacttctagctacattgcaaaaatgccgcaaattccagttccaaggtattattcagttaacatttttcttgaagctataaagtgatatttttcctgcatagcaaacccacatgcagaactctgtggaacagggcgccataatgatggcctgaatagtggtggcacaactggccccaaccatcttttcctactatcaagcaaataactctttacctaagacttttttgccacacacacacatgaaatgtgtacttctctatcacgcctgcaccgattaactcacagtacggcaaccaatggttaagcactagaatatcctgtttctagggcggaagcaaaccatcacagcactacaccactccacagtactacctaataattctgccgtgaagctcccccggttcgtaccctcacagaatcaaccccccataattccctgtaccaacaccatcatgtccgctcacgagcatgcggtacagcagctcccccccaccaaactcccacgccctacatgtcgcgatcaaaaccctaaaccaaaaaccccctacccccagcttctccccggcgggcacgcgctcgtccgctcctgttccataggctccaaccggggccgatcgatggagacggcgtggactgagactagattggatgggaggagaggaggcgtacctggggctgcggcggcgcgatcggcgcggcggggagcggcttggcttttcggaggcgacgagggaagtggggaggaggggggggggggaatctgattggggcgatcgcttttttttttcccctcggtgtcgcgacgatgaggtgagggtgaggagggagagagagagaggatgcgggaatggaggagagattgatcgagatttcgtttcgttgaggggaggggagggatggggagggggggagagagaacctggtgcgcggcccggtgaggcgcacgcgcgccgcggactccaccatgggaggcttttcttgttcggccgtgtgtgcggccaacttggacggctgggatggtggtccatggggactggggaggggagagagtggcaacgtgtgcgccagaactttgaagaaagaaaagcggaataatgatgcaaattgcgaccaacggattaaaaacatggctgaagaaacttaaacaccccctacttattattaggttaagaacactttaacaactacccaatataaatatattttagagtaaattatattgttagtacacaaacttgttaggtgggtgtaatttagtatataaacttgtaaaatactcgttccagtacacgaacttatctagctagttcgtgcgaacgaggaccaaaataacttggcaatattaattttacgaagttgatattgattaggatgtgacgtgcatacgtgtagtgagtatgcataagacatgtaatatttataaatttagtctctatttcatccttcatcattgaaatgatgaatttcatatgtttttaacccttatatcagtgctcgttttttaatatttttctactatcactaaatcctattctatattttattgaatatgatgtctaatggtaactttctctcatgtatgtgtttacatagtatcctaatcagcccctaaatcaataagattagtcatatagtgtcctttttaacttccaccgcacgcaccatacaagtttgtgcactaaaacaagcattttataagtttgtccactagattgcacccacctgataagttcgtgtaccgacaatgcaaagagtaaattgcatcggcggtacacgaacttgttaggtgggtgcaatctagtacatgaacttgtaaaatgcggtacacgaacttatcttgcgcgtgcgaactaaggtcaaaaggatattacatgactaattttgttgatttaggtgctgatcaggatactacgtaaacatatagataagaaggttgctacttagacatacacctgttcaataaaaagatagaatgagatatagtgattatagagaaagagataaaataccgagcaatgatacattggttagaaacatacggaatttaagataaagtagagaacatatttataaatatagcatgttttatgcatactcactatacgtatgcacgccacatcttaatcaacattagctaggtaaaattaaccttgccaagccattttggacctagttcgcacggattagataagttcatgtaccgaaacaaacattttacaagttcatgtactaaattgcacacatctaacaagtttgtgtaccaccaatgcaatttactccattttatacatattgaatgggtcaccaactactcctagctatcagtacaagtagaatggtttgctaatttctagagagatggatgtgcaaggtgccactgttggaaaacagagtaagatatatgaatgctcaattaccaatcctataagtgaactacaatctattatactataatcttgcgtaattcgagacatagttttaggttcttgcaaatatgctatatgttgcagattagcctttactttccaccggctttttttgacatcttttggggaaatgtatcaagcgaaagtatccaattgttgtagtcatcaaagaggtactctttcctctttgatgcattgataatgtacatttgcttttcccaattcgtcattttaacattgtacaccaataggtaggaagaaggatctatgatccaaaattttgaaagctaatggtacgaacgacagtcactataccattgtaacatcgtgtgtgttctctttaataaaattgattcatttttaatggaaaggatgaatgtgtttgcacatggaggatacaaatgatagtaattgctgcgtgatttaccacatgatcaggagaaaccataattcaggtcatgttgaccagggaaatcaattcccgttcggaaatgaaaatttaataaaatcagggtgaatttgttcaaaggtttgaacatgattccgaatttagggtaaattactatctgaatgaaatttgaccctaagcctctcctgatcagccatggtgttggacggttatgtgtccatcggagtggtgggagtgacgaggaggctggagatgcctggaatgatggaacgaacccttaaagcctagtatttttctgattctgacatcttttttgttgggaaattttgataaaagcactatgactttgtggttttagctgtagggcaccgcactagtgacttttggagggaaaacacccccaaaagttagatgtttactgatgaacaccgcacgtattaaagtaataattttcagttaaaaatgagagagaaatcgtgtgaaatgtcagaaatgcccttgggcacacatgtcagctctcctatctctctctatcccctccttcacttctttctctatcccacatgtcagcgatgtcggcgcgcaggtgaggtccggcggcagcggtgacgggagggcgatggctccggccgctgacaacgcccctccctcctcactccgcgtgggcgacggctccggccaatggcgcgcccggacagcgatgccgatcgccgacggtgcccctccctcttcactctgcgcgctgcagccgtcgtcgtcgtccagccgcgccgcctctcctccacacgttgttgccaccgccgaacctcgcctgctgtctggccaacaccacttgccggcgccggcgctcctccgcacgccgctggtcgcgtccgctctgccctcaccctcgccctcgcctgtccaccgttgttgctaacatgtgggatagagagagaagagattagagggagaagtgtaggagaggatagagagagaagagagataggagagtgggcccaaggacatttctaacatttcacacgatttctcctccttttcaactggaaattattactttaatgcgtgcggtgtctatcaacaaatattcaacttttgatagtgttttcctccaaaagtcacttcgtgcgatgttctatagttaaaaccgcgaaatcacggtgtgctgtagcaaaatttgctcttttttttttctgatgacctactctcatgtcatctctctctgtgaaaaaactagaattgattgcccttttgatctttcgccactttggtagcatccaatatccattgatacagctaatctaatacaagtaagtagtaacagccagcagggaccagaggagaatatgttctttcgtggtgcttctaacaatatattagaaaaatcaccatacaaaatcactcttaaagagtgtaaatgtaccaatcacataacataaaatttcttcgcatctctacatattcgataatccacttgctgaagaggaagaaaaagatcgaccaaaacagaatcccaatccggttatcttctacttcggttcgatcttggattggaaggaataccctccgctgtagtcgaacgagtcggtgctcatgtccttgtccttcttcgggagaggatcgttgtaaggatggcgtggggcacccttggtgacgtcgaactccgtcgcggacgtcgacgccgacgtggaggcgctgctcagcccctcgctctgcagcatcatctcgatctccttgacgacgtcgctcatcgacggccgcgcgccggccacctcctcgacgcaccggagcgccagctggacgaacttgctgaatgcggccaggtggttggtgttcatgatcctggcgtctatcatgtccttgatcccgcagaactcggcgtcgccggcgtcgaacgcccgcttcacctcccggacgatgtacttccctttctcgatcggctgcttggcgatgatcagctcgagcatcaccaccccgaagctgtacacgtcgctcttctcggtcagctgctgggacatgtagtactcgggatccaggtagccctgcaagtatggaagaaggagaacaacaaatcagacgagccgacggcgaagggtgcagcatatcggtcggcgtggtgcgcgcgtttaccagtgttcctttgacttgggtgctgacgtggcccctctcggtgtcggacactagcttggagaggccgaagtcggcgaccttggccgtgaggtgctcgtccatgaggatgttgctggacttgacgtccctgtggatgatgggcgggtcggcgagctcgtggaggtaggccagcccacgcgccgcgccgagcgctacccgcagccgcttcttccagtcaaggtgcagcccgctcttccctgcaaagaaaaaaatccaacaagttcagggcgcgtgccgtgcaagaacgcgcggcgcgtcaggaacgcacggacaaatgtggtttgtggttttaccggagaggctgtcgcggagggtgccggcggacatgaactcgtagacgagcatctgctcgccctgctcgaagcagaatccgacgaggccgacgaggttcttgtggtggacgcgggagagcagctcgatctccgtcttgaactcgtgcccgccctgcatcgacccctgctgcgccctcttgatggcgatgaacgtccccgtcggcagcatccccctgtacaccttgccgtaccctccgtacccgagctcgttcgcctccgcgaagttgttggtgctccgcttcagctcctcgtacgagaaccacctcgcccccttcagccgcggcgccccgcccctctcctcgctccgtttccacgacgcgaacggcccgcccagctcctccctcgccttctgcgcgcgccgccgctgcacgagcgcgtacaccgccgcgcccacgagcgccaccaccagcacgccgcatccggccgcgatcccgatgatggcacccttgctcctcgacgacgaccgctcctctgcacaccaacaggtcagtttgaatggtaacgagctgaacaatgtctgaatcaaattgatccatgggagtcatggactgacctgggaaggggtagggcgaggcgatgaagtagtaagggccaaactccttgggcggcttgaaggtctggttgctgaggtcgaagccgatgcgcatgacctcggagcggttgaagtaggcggagccggaggggaaaagcttgacctggacctgcatgtaggcgtcggcgttgaagaaggggtcctggaggaagacggagcccggggtgaggtccagcttggtccacagccggctctccagctcctggaacgccgtgccgttggtcacgtccccgaagaacggcgccctgaagtacatcaccccctggtacgggtacgcgcacgcgcagctctgcgggctcatgctctcccccaccgcgttgcacgtccccgagaagcacttgacaaggctcgtcgagtacggcgccgccgcggcgcgctgcgtcacgttgcagtactgcgtgttcggcagccggtcgcacaccgggttcccggccagcctgatcgatgtacagggagttaggcaaggagaggcagcagcgaaggccacggcatcattcggagatggttggttcaatggactcacgaaagggtgccgttgtagctggcggtgaccgtgacggaggagagctggttgtccttgaggctgacgatgctcagctcgctgctgatgtacttgcccatgtcgagggtgccgttgaacgcgttgccgtcgaggatcctgcagcgaatggtgagcgtcacaagttgttgaggccattttgtcaggcggattactgcacagtgaggctggtttgttcagtgagcttacacttgctgcaactgtgggccgctgaacagcctcatcggcaccgtgccgtaaagcctcccggattgtatgatccttgatgaacagcatcacagagatgatcaggtcaggttttttggttatgccacatgtgagagcatgttctgaagctggaggcactggagaaggagaacacttacagagctgagagctgtggcagcctccaaaaccattgtgggctaggagaagggtcgaacgtgttgttgctcagatccctgtggtaaaattggaggagatttcaagtcaaacatgattgatggtatgtttaagttagaagaagaaattttgtggaggagtgccagtatcttacacataattgagttgggtcatctgagatagatcaggcaatgggccggtaagctggttgttggctaaattgctgaaatatgacaatagcttgtttagtgtgaatattccatctcacatatacaggtgcactggaactgtcaatggtatctatgcaattcttgaacaacttacagctcatttactttagtgaggttattcagattctctggaactggccctgagagcgaattcctatcaagccggctgttcaaacaacaaacagagcagatgaatgttttatgtaatccgacataacaaaaactgtttacgtagtttcatgtgaagcttttgtttgtggatggacacttacacaacttcaagtgtagtaacaagcccaagagagtctgggatattaccagtgaatttgtttccatcaaaaagcctgcatcaaaactcctaacgtgttagttcacctttttagctgaattgccaactgaatcaaagaagcaggaggtcaggaacttacaaatggatcagtgtcatctcaggactgaagagggcatctgggattggaccggacaattggttcttgttgaagtggctgcagagagaaccagaaacatatggtcagtgctacatttcatttagtatggcctcttgaggaataggaatgaacaaacttcttaggacctacaagtgtttggttttgaaaagcttgtctaaacccattccaccatttgtcgagattggtaagggacctgacaattgattgtcggcgatgtcgaaccaatagaggttggaaagattgcccatagaagctggtatttttccagagaactgatttgagttcaatgccctgaaagacagattatgtcagtcttcttctccagacactaagttgcagaagtctcccaattgtatgtctactaattcaccagtgagtaattctcacatgtaagacaattttggcagactccctagctcatccgggatgttgccatggaaactgcaaccggccagaatcctacaaaataggcagcacatgagcatactaacttcttagatggcagaaacctgaaagagaaatactttcagaacttacaaggtggtaagctgcttcaagtttccgatgtttggagtgagcacgccgccaagatccttattaaatgacatgtccctgcatacatgcagttctctcatgattcaccgttgcaggtcggaacaacatgaggtttcagaaaaaaagatcaatcttgaacagtgtgctctgctgctacatacagggattgaagctcggtcagttgccctatgtcagcagctagaactcccttgatgcccatggtagaaattttactgaaacagtcgggtagcagtgggtaaacgtaaaccttgtagttggaaacatgcagagttatagaacagagcagtagagcacttacatggagatcactctgttgttgctgcataccactccatcccatggcgaatcgctgcatgggtcgtcagactgcccccacgttggcggcgcgttctgccactgatccatcaacgcgcggagaacagatgctacaaccaaatccacggttcatttcattcttcaagatatcacacaataagatcataaatacagagcagcacgagcttcataaacaaggttatcccactccttcaagattggacaatcatggagacacgcctctggtgttcccttccaatcatcgaagaatatacagaacatttgttctttccctcctcaaaatcaataaatccaatcgttcaagactgagaaaacaaaacgatcttaacactagctgattaaatggttgggtcatatggtactcactgtcctggctatccgtcacggcatggcttgctcggacgcacaccgagagcagcagcacgacgccgagaaccacccgtctcatcctcgcacagcctccgggcaccggtgccgccatgcatgcagacgacacgatgagctgcgtgcgagctgctgctgctaccagaggtgcggttttaggtcgccccggccactcaggaaaaggctatagctgtagctatagctcgggagagagagacagagacaaagaacgcgcaaggcaactaccagcaccacaaccgcatcagcatgatgcgcctcatgatgggatgtgcattcaagaagccaacatgacatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21297 - DNA, 7609 bp, Oryza sativa
  unsure (1)..(7609): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtatgtaagaagaacaatgtgacctatatcagaacaatggtctttttgttaattaaaattgtaataagcgtgtgcttggttactggtggaatgttttttttccctttgtatctataacatgttttgaacaggtatcattggttttttttgtgtgtttggggggtggggggggggggggttatggagtacggtcatgagttatggacaaagtgtgagataacagcatcctattactgcttctaaatgaacacatgtcaatatggccttgtttagataaaaaaaaattggcaaaaaacatcacatcaaacgtttggacacatacatgggacattaaatgtggaaaaaaaattaattgtacagtttgcatgtaaattacgagacgttgtcacgatatgatttgacaatgtgatgctataataaacattagctaataacggattaattaggcttaataaattcgttttgcagtttacatgcggaatctgtaatttgttttgttattagtctacgtttaatacctcaaatatgcgtcggtatacttcaaaaactttacacccaaagaatcaaacacaccctaagctttaatagtatatagttagtggtactgatgtcttgggataatgaaaattatgattatgttggattacgaaatgttatgattatatatgactaatagagagagaccttcaaggccctcgagtcttttctgtaatcattgacaacaccaagttgtttgcttggtggctgtttctgcagaatggaaatcatgtgcacactattgatgcacatggtggtggttcagaaattatataggacctggaagactgcatttttcccgtgataaaatttacaacatagacagcaatgtgcatcatgaagaaaattataccccaaccacagccgtccacaatcttccaaaacaaaaccactgcttatctggtattaccagaaagtacagcaactctgcaactattgtagctaactgtactcacagcaccccaagtattacataggcattgttaaaaatttagattacatttgggcacttgcatggaagaaatcttacattgctcatatggattgccgatcatctctatgctgttccattgctagactttggaggtagaaagggctcccaccatccatactcatacttggggtatggagctgtccatttctcaggcttgtcaaatttcaagtcgaccgggttagaagccaatgcctcctcaagcgtttctgcttcaaattgttctgctaagaccctgtctagcctcaacttcataaaactgataacaaaagaataaaatgagtaaccttgaggattgccatgctacttaaattgaaagtagttaatcatggtatcggcaattacaagatcattaaaagtgtagatgctggctatttcagtgattgtttggtcctcttcctatctggaattttggatggttagaagcacaactggtctggtcatggcgattcacaccatgtcgtacatcatgacatccagaaaataatgtgatgcatagtcactgagtcacatgctcagagccaaaattctgtgtattatcatgttgtccagtttcgtagtccaataagattgtccctttccctctattactttttcactagctttctcatcaaatcagtgtgttcaggatgcgaacgactcattaccaatgtccacaactcgaaatcctacccagttagtatggtgcgtggaaaaaaatcagagaaaattcctctgtgccctgactagttttcgctcaatcatttctatgcctctgaatttttcctattttcctacatgctcccgagtttcattttaatcccatatatacctattccattagttgaccgctagatttctttttccaaaacgacaatattacccctcgtacttgtgtgctagcttattgagaaaaaaaatacaattctcaatgggaaaaaggttcattattttttttaaaaaaaacaaatggggtataattctttgaccacaaattttaaaactgaaatttatcatttttaaatcattttcaattcaaatgtaagccaaacaaaaatagttttggtttcaagttcttgatgaaattttgtatgaattttatcagtattttgaagtttgctaaaaatttgaatctttcatatttagggtcaaataattccatcacttttgattttatcatatataagaattttccacatcgagaattgtgttttttctcaataagctagcacataattatgagagaagggcagtatagtcatttcagggaaaaaaatataacggtcagttcatggccaaataacggaatgggtatgtagggtatcaaaatgaaaactcaagaccatgtaagggatgtggcaaaatttatagaagggattgagcgaaaaaacagaggcacgtaaggaattttctcaaaaaattaagatgacacttgtagatcattatcatgagccatgacaaagaaagacagatccaagcatcatagcaaataagatggaggatcacgtaaaattccaaaggactgttgacttgagcaaaactcaaaaggtacactcagtgtcttcgtttacataaggtgtattcatccattctgaaatgtttgacattaataaactaaccagcatcatacacaaataaacagagggagtagttctgagtttttccagtcatatcaacactacaatatacctatgcctcacaatacttcacaaggactacaaaaaacttttgtacttttgcatttgaaacaggatcttgaccaaatgttagaaatgtgcccggtgaaacacatcaaacttggaaaatggacgttacaattgtacagaacattacgggctcaaatctgactagttgctcttataagaaaaatattctactatatgtctatatccctccgcttgcatttgcaagagacacaatttactgttttgtgggatatatttatagctgcagaatgtgtttacagtcgcaggatgcatatttcgtgggaagcattttacaatcgcgagtgcaagtccgatggacaaggcactactagcatctttggctgtaattagtgctatataagaaaactactgcttatttgcaatagtttggcatttcttatccctgaatttgaagttttttcaacaaaaaaaaaagaagaatgcttgcatattaaccaaactaggcattttggcatcgtccttattttgtcaccagctcagaacatgtactgaagcaaatgtatgtcggcgtaggatcagcaataccgtaaagctctatttaaatccacatttgatgagtggtaagagaaatgaaaaactgttgatgttgtcatcatgttggttcggtgcttttgcagtttgtactttgttctctgctgatcataagtccataacacactacacacaggtaataccgtactgacactgcgactctttatgataggcgttttaatttctgtactagacatgttttgtgttgtactagtaattagcttattattagcatcggttgcggctgcaattgaaacgatcgatggagggagggggcactgcacttacgtgatccagttgccgtcggtggagacgagcgcgacggcggggcgcttgaggcgcttggtgatgttggggaacctgtcgaggaacttgggctccaccaccagccagaagtcctgctccttctcccgctccccgtagagccgcagcttctccttcagctgctcctggaagtgctcctcctcgtccagcatgaacttggcgttcgccaccaggaagtggtacttcttcggcttcgcctcctgcgcgcgcccaatccaccacaattctccgtctcaaccgggacgggaaaattatcaaaattagggcgggaggcgaggggcggtttggtttacctgatcgggaggctcgggggagccctgctggtcggagtcgacggccacggcgcggagcgacaggcgccgccgcctcggctggcacgagacggcgggcgggagcgcgaacccggcgccgacgcggggcagcgcggcgcgggacggcgcgagggtcgcgaaggggcggagggacagcgtcgcgggagccaccattgccccactcgcctcggctgccgaactcggggacggagccgaactgaagtgctgaagctggtcgtgtcagctcggagagggggcttgaggtcggaggacgacgatggacggtgagctttagccttatctctggacacgaggggtgggcgcctttaatactactgtgccgtgccattactggttaaatggctccatgacagcacacgggttttcgcactgtgccgttttgaggcccatagattttttttttgggcacacgtggaccctactttgggttttatataggaataagttcatctgaggtccctcaatctctatatacgatttcaggtctaatcccaggcctctcactgagccacgtggcatcacgcttgcgctccatccaaattctcagcaggagaacatgccacgcattcaaaatgtcccatagccgtccgatgacatacgaacggtgagaaaaaggtccagcggacctaaatataaaatgcaagttttaagaagggtttttaaacaaaatggacaatgccatctagaagagcctggagtagaggaaaaaaatcccagaaccaaaaaaaaagaaggggctgtctatataggaatcgaatgatttctgaagctccaatcatacagattttatctaccataggatgcacatccaacaactcagaaaaagtgatacaaatagatattacacttaaaaacagatatattatttgattatttgaacgccatttttttaaagcctaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtctatatccagatccataaaagcccattagtaaaaagcaggcccaagatacaaaattagaagcaaaacacaaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctataggaaagaagaaatcaaagacaacttctgaacagaaagttgagatccatacaaaggaaacacagaatctggagaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatataattcaaaagaatacatgaaattgctgaatatgtcaaatgaaacaaggttaacaatccactttgctggataaatacaacaactcagaactgaaaatttcatatgtttgctctgtagatctgaactatgtaatgttaaaagtaaaactacactgcattcagtactacaaaactgcattctggatgatagtattactgtgtactattgatgaataccaaactaactttataaaaaaacatgacagattgattagtcttccaaccttactgaatttcactctgaagatatcacagtcatacagttatacagaaatataacaactaggccatatagcatatcctgaattgtcatacattcaattttatcagcataatcaccatattaaactaatgacaaattcaaatctcaatgtcaaccacttgtctcatccaactcaatattacataaaagttcaatatctcatacagcacaaacaaaagagccaattcatatgaactcacatcttaacatgttactgtaaaaaagtaataaaattacatacaagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagataacaaaatgaagatttcagataatagatcattattgatttgttcaatgtctcaaaatagaatataatgaaactagttacagtgaacttgtattacaaatatatagagtgaacactacaatttcaattgaaaatacatgtaactacaaagaaacaatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaagtgccatcagatattataagaaaaagtgccatcagatagtttgttccataagtaaattttaactggaattacagtagcattacactctaattgaaatacttatttactgtaaccgaaggtcgacgccgcttcttcctcgacgccgtcgccgttcgttgatcttccgccgccgttttggtcgccggtgagttcgccgcgtcgccctctacgtcctggtgccctccgttcgcgccgccgcgccatcgttcgccggcgagcttgtgctcccgagccgccgccggtggtgacgtcaccgctgacgtcatcgtcgtcgtctctcgtggtccggccgtggatcggtcgatctcggccgtccgttttggataagatcgatctcggccgtccgttcccgtgaaccgtcgccgtgcgcccggtccaccgcgaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaatttgagatctacatgttaaaaatatccacatgtactgttcatgcttgtttttgtgctgttttggtgattttgctcttttctgcttagatt

SEQ ID NO: 21298 - DNA, 17111 bp, Oryza sativa
tgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttttccgctgcttagatctttattgattgagaggaactatctacctctataatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttctatgcccaaattcctcatgatcgtcacgaagagaagtgccgagtcaaagtcaccttgaacagtaatagtgaagatattccctcagtgatgttcgaagccggaggaagaaactacatccatacatgtcaggaggtggcaaggatcgccataggagagctccttgatcgctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactgtgttagcagcccaagatcgtgaagaccggaatcgtggtaagatttgcaagcttgaggacaaagtggatcgtttggagaaggaactagccgcattgaagggagaagcaccaccgcagaaggccaggattcgtcttaccgcaaggaagagagctctatttgtccctcgctaccaattggtgccaaaggtccgtgtggtggagaaagaagttaccccagccctagcggatcctccggtcgtcaatgtaagtgatgatgaaggagatgaatcaaagcgcacccattccaagattgagtggggagcaactcaagatgatgaagacgagccgaacgagccttcaatcaactccgatgcccggaagacctagaatgccttgtcaaaccgttgtcttagatcgttgtgttagtttgcttgtttaagtttggttgtgtgtgtctcgcatgtgatttacatcagtggtgggatgtaagtgcgtgcgtttgtttgctttcgagtgttaggtagttggtaagtttagtggtgtgagagtcttcagttttgtaataatgaaactcacttaagatcaataaaagttaaattaattctcggtcctaagtagttttccccggtttctcttcttatgctcctgcccatgccagatggtgctcactcgcagcaatgggaatggccccaacaacaacaataacaacaacaacaacaatggagagaatcccacacttgcctaagtcctggctcaacagacacaacttatgaacatgatgatgcagcaactccagaaccagcagaaccagggaaataaccatgcacctccccagaacaagttagcagaatttcttcgtgtgaggccgcctattttctctagtaccactaatcctgttgaagctggtgattggttgcacgccatagaaaagaagttggatttgcttcagtgcactgatcaggagaaggtctcatttgcatcacaccagctgcatggccctgcctctgaatggtgggatcactcccgccttaataggattactgctgaacctatcacttggcttgagttcaccgctgctttccggaagacgcatataccatcgggagtggtgtctctcaagaagaaggaattcaggtcgctcacccagggatctcgctctgttaccgagtatctgcacgagttcaatcgtctggctcgttatgctctggaagatgtacgcactgatgaagagcgccaggagaagttcttggaaggacttaatgatgagctttcttatccactcatgactggggattatcctgatttccagaagttagtagataaggctattcgccaggaggacaagtacaatcgcatggaacagaagaaacgccggattgctcaattcaagacacaacaggggaataatcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctccaacacagcaacagcctgccaagagggagcaaggcagcaagcccgtagtgtgtttcaactgtggagacccaggacattatgctgacaagtgtccgaagccccgacgcgtgaaggctgtccctgcccagagcaactctaccgcaccagcgccaaaggcccgtgtcaatcatgttgctgctacagaagctcaaggtgctccagatgtgattttgggtacgttccttgttaacttagtccctgcaacagtgctttttgattctggtgctacacattcattcttatctatgagttttgcgggaaatcatgtgatggaagtagaagatcttagacgtcctttgatggttaataccccaagtaatcaagcactctctttgcaacgtagcccctctgtcagaatagaaattctcagatcattatttctggccaatcttatcctgttagaatccaaagaccttgatgtcatcctagggatggactggttagccagatataagggtgtgatagactgtgctaacaggaaagtaactctcaccagtgatgatggtcgagttgtaacaattcatgcattgtcttctgagtctttaaggtcaagactgaaccaaataactttggaagagattcctatagtccgggagtatcctgatgtgttcccagacgatttacctggtatgcctcctaaaagagatatagagttcagaatagatttggtaccaggaacaactccgatccataagagaccttatagaatggcagccaatgagttggcagaagtcaaaaggcaagtagacgatttgcttcagaaaggatacatcagaccgagttcatctccatggggagctccagtaatttttgtggaaaagaaagaccatacccagaggatgtgtgtggactatcgtgcactaaatgatatgactatcaagaataagtatccgctgcccagaattgatgatttattcgatcagcttaaaggtgccaccgttttctccaagatagatcttcgatcagggtatcatcagttgagaatcaaagaggaagatatacctaagacagcttttaccactaggtatggattgtttgaatgtactgttatgtcttttggacttaccaatgcccccgctttcttcatgaacttgatgaataaggtgtttatggaatacctagacaagttcgtggtggtctttattgatgacattcttatctactcccgaaccaaagaagagcatatagaacatcttcgccttgcactagaaaagctacgagaacatcaactgtatgctaagtttagtaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcgggatattatcggaggtttatagaaaatttttccaagattgctaagcccatgacacgattgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaactggggttaggttgtgttctgatgcaagatgggaaggtggttgcctatgcatctcgtcagttacgtccgcatgagaagaactaccctactcatgatcttgaattagctgcagtagttcatgcgttgaaaatttggcatcattatcttttcggtactcgtacagaggtgtataccgatcacaagagtttaaagtatatctttactcagccggatttgaacatgagacaacggagatggttggaattaattaaggattatgacatgggaattcattatcacccgggaaaggctaatgttgtagcagacgctcttagcagaaaggatgacagttaccattggaattatgcgaggaatttgaaagattaaatttgggaattgtcagtagaggtttcgttgcagccttagaagcgaagcccactctaattgatcaagttagagaagcccaaattaatgatcctgatattcaagaaattaagaagaatatgagaagaggaaaagctatcggtttcttggaagatgagcaaggaactgtatggttgggtgagagaatctgcgtccccgacaacaaagatttaaaagatgcaattctgaaagaagcccatgatactttatactccattcaccctggtagtaccaaaatataccaggatctcaaggaaagattttggtgggcaagtatgaagcgtgaaattgcagaatacgtagcagtatgtgatgtttgtcagcgaatcaaggcagaacatcagaaacccgccggtttgttgcagcctttgaagattcctgaatggaaatgggaggaaatcggtatggatttcatcactggtttacccagaacgtcatcaggtcatgactctatttgggtgatagtcgacagacttaccaaagtggctcatttcatcccagtaaagacaacatattctggaagtcggttggcggaattgtatatggcaaggattgtgtgtttgcatggcgtccctaagaaaatagtgtctgatcaaggcagtcagtttacttcaaaattttggaagaagcttcaggaagagatgggttctaagctgaactttagtactgcttatcatccgcagacagacggacaaaccgaaagggtgaatcagattttggaagatatgttgagagcttgtgctttagacttcggtggaagttgggataagaatctaccttatgcggaattttcgtacaacaacagttatcaagctagtcttcagatggctccttacgaagcactgtatggtcggaagtgccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcggagagatctaagttttgacgcaggagattatgtgtaccttcatgtcacgcctcttcgaggggttcatcgttttcataccaaaggaaaattggcaccgcgttttgtgggaccttataagattgtcagtagaagaggagaggttgcttatcagttggaattacctcaatttggcaggcgtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccaggaatcgagttatccgtttttgtaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacatcctaaaaattcaaaatatataaattgttgtttaaatggaattttttagaaatgattttaaaaatctttgaagagaagatctaattttaattaataaattccaacataaaatggggccagataaaatttcattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaatcctctctctctctctcctcggcccaagccggcccagtccgcagccgcgcgcgcgccctcgctgtagctgacaggtgggtcccgcctgtcggagtcgtcgtcttcgtcgcgccgccgccgcccgaaaccctagcgccgcgccgccgccgtttccttccaaattcggccgatcctttcctttcccggtgaaatcaattgaggggaaatgtttcccgagatctcctctaccttttctcttttggaatcatcggctaaatcggcttggaaagtgttttattcgaggtcgaatcggatcggtctctttcctccgaaccccgaagtttccatagcgtcgccggtcatcgtgggccttcgccgccgcctcctagcccctttaaaaggacccccggagtcgccgctacccgtcgccaccctcgccttcgcctctcgttgccgatagagccctagccccgtgtagcctcgcgccgccgttgtcgccgccgctccagccgtgctccgccgtcgctccagtcgtcgccgtcgctcggggaggtcgccatcgtggtcgccgtcgcgtcgccgtcctcgtccgccccttcgccgtcgctgaagaccgccggagcatcgtcgccgtcgtcaagccgaaggtcgacgccgcttcttcctcgacgccgtcgccgtccgttgatcttccgccgccgttttggtcgctggtgagttcgccgcgtcgccctctacgtcctggtgccctccgttcgcgccgccgcgccatcgttcgccggcgagcttgtgctcccgagccgccgcaggtggtgacgtcaccgctgacgtcatcgtcgtcgtctctcgtggtccggccgtggatcggtcgatctcggccgtccgttttggataagatcgatctcggccgtccgttcccgtgaaccgtcgccgtgcgcccggtccaccgcgaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaatttgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggtcagcaaggcaagtcacacagatcccaaacaaccctttgagcatgttgatcccgtttaaagctatcgtttctattcaactattgcatttattttcgaatgtcattgggtggaattaacctattgtttgttatagccctttttgttcttgattactttattccttgataccttgggttgttataacttgactagttgggctatatatatattggttcaactagatgtattagatataattgcttagccctgcttagaaacattagcacactattgggataacttaagatttactattatttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttaccttttgtatagcatggttcattgcggagcaccagactgagaagtgacggagataagcccacgggggtcgctggggagtccatgccttgtttataagggggtgattatgatccaggaaaggtgcgctgtagtggattgtgttgtgcaaggggtattgtcacagctcctttccgaggtaccgtggtggtattgaggcacatggtgacatgatgtggggctgtgtcttgtgggtacattggtacacctctgatcagagtaaaactattcgaatagccgtgcccgcggttatgggcgggtctaacaatgtctttcgtgattagtctcacacctctcatcataataaaagatgctataactggtaataatttgattagctcctggtttggaatggtatattcctagtttggagatagaactgtgcagctgggatggttgttcagaatggttgggcctatacaacagggtatgttgtatagcgttggattaatattgtttaattattacttaactgttttattaaattctcaaatgtttgctaaatgctgcttttgcaaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttttccgctgcttagatctttattgattgagaggaactatctacctctgtaatgacattttattcgcttattaattagagtaataattgtactctattatcaatttgttattgtgtgcctcggctgattcctggacgagagttcacacacatgtaagcgtttggaattttggatagaaattccgggcgtgacagtaacgttcagatgtaatagacaaggcaaaccaacttctcaatccaaaccagtaagcgcagaggaaacagtggtttcggaaagaaatacaaatgaaaatgatgcaacagattgcaagtgtgctctggttatttcagagaggaatgagatttggaatatttcaagggtacaattagaccacaatcatcaactaagtccaagagatgaagtgagatttctcaaatcacacaaacacatgactacagaagaaaaaatgctcataaggaccttgaaggaatgtaatataccaacaaggcacatgattgtgattttatctgttctaagaggaggattgacttctttgccttatacgaagaaagatataagcaatgtgagaaccacaattaacaaggagacaagcagcaatgatatgatgaaaactttagaatttttcagaaggaaaaaagaaaaagatccacatttcttttatgagtttgatttggatgagagcaagaaagtgaaaaatctgttttggacagacgggagatcgagggagtggtatgagaaatatggtgatgttgtgagttttgacacaacatatttcaccaacagatacaacctcccgtttgctccctttgttggaatttctggacatggaaacacaattgtttttggttgtgcatttttgcatgatgagacttcagaaacatttaaatggctgttcagaacttttttgaaagctatgtcacaaaaagaaccaaaaacaatcattactgatcaggatggagcaatgagatcagcaattgctcaagtatttcaaaatgcaaagcacataaattgcttctttcatattgtaaagaaagctttcaatctatttggaaatttgttcaaagcaaaagaagggttgtatgatgagtatgaagacatcataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtataatcgcaaaatcttcatcaagtttcaagttgagttgaaaagaacaactagatttcaaataaatgaagtagagaagttcaaaacttatgaagttttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgggggaaaaggcaatggaaatatacctttagcacagagctcaatcctgagattcaacattttgtcaaggaaaagtgcagaaatagcatcaaatggatcgaaaagcaatgaaactttccagtttgcagtggaagagatggacaaaattgctaaacaattggaattaatgtgttcaaataaagatgctgagcaggagatcaatgattcagatccaaatgcagaagacaatttgaactcacatgaaaaaggcaatcaacaatctgaggaaaatacagaagaaatattgttggatccagatattgcaaaatccaaaggcaggccagctcaaagatataagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattccagaacatgtactctggtgtcacaccccaatctgataccgccgtacaacggcacctgacaggagcgtgtcgtagggaaaacggcgtgaaccgtttcctacgaaaccgcgatctcggtaccagtcccaggacatagtgctggtacccacggtgacaaatatgaatcatagcaatccttaaaataaatagaggacttatttaccttaacttaggttgcagctcagaacaatccgagaatgcaaccgacgacacggacgaggaaacaccaacaacagcagcagcagcggaaccaacgaactaacacccaacaccacaggcgacggctgggaaccaggacgaaaccctaatcttctcttcactttatcttctcttcagggcggaggaactatatatatatatatttatatagagcaagggtgagtactttcgtactcagcaagtcacgggaacttaggtgtttgatgcaagcttggaggagaggcaaggttgttttacaaatcttttatttgaaggcattttgaaatcactaagtgatttatttctttctaagtttgggccgaagagagacttgcgtctcgattcgactttaagagatgcttttcaacaactcaattggtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccatgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataatcataggccattttaggcgttcacaaatcaaactccaaccacctcgatcggtaattcagcaagcttctcgttcttgcattaccaggaacccggtttggctccaaccgtcgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcatttttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaaacagggtagtacaacctacggaaattagtgcgattactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaactgaaaacctaaacaaaagaccaaaagaaagaccctatttagactaattagtagtgccattaaatagatctcaattttatgggaatattggaagttgaacggagtcaatcagagttgcgaattgggtgatatgaattttggaagtttaattggagtttctggaataggagaaatggtttatggaatttatagaaataatattctcaaaaatattattgatagtcactgtcacgcgggaccaaaggaaatggtttgtggaattttgggaataaggaattgatttatgggacaaaggaaggaaaaaaaaaggatttattaaatccctgaaaaagaaaagggtggagggatgtaatttagacttctttgggaggctcgggtacggcccaagggataagcacggcgcggccgagccattgggccgggcgcgggcgcgaggaggcggcccaacagagggggcgcgggggagagagagacggcccggtggaccgattccaccgcgcggggtcccgggtggggcccgcttgtcggtggcacggcccacggtgggatgggcgcacgcgaggtgcggcgcacgggtttcgggtgcgcatggcttaggagcggtgcaccggttggacggatggcggcgggcccacatgcagccgcacggctttccgtggaccgcgcgcacgggagggaagacggagggaggggacggctgaccggcttggcccggtcaaagccgaggtggcgccgacttggcgcctacgtggcagccacgcgggccggcgggaggaggaagaaggggaggccgagatggacggcggacggcggccgtgttcaccggagcaagcgcgacggatttggtcttcggggagcacaccggagtgacgagggcgtcgagaaggagcgagccaacggctcggattcgccggagggagttcgacggtggtggaattcgacagtggcggccggtggcgagagaaaggggaaatcaccgaggggcgacgaggactcaattaaaggcggcggaagcatctccggtgttcaaggaactcatttccggggtcggatgggtctgagcggcgccgtggaggtccggcgacgagaggcggcctccgggggtgggcggcaatggcggtggggccacgccgggtggcggcggtccttggggcggcgtctacgcgcgttcggcagggctaccgagctaccacgcaagctagcggggacgagggagagcgaggaaggggaacgggaggaggcactaccgagccgggcgggcagtgatgggcggtcgacggcgcggggcgagctctccggccttgggccggggaaggggaagaagaagggtggccggagtcctcttcggctcctcgcgcacacgccggcttcaccagcacgcgcgacggcgaagggaggcgaggtcggcagctgcaaggcggcaacaaaggcacggcggcggtggaagagagatgccgagagagaatgagatagggaggctcggcccgggctttatagatggaaaagaggcggtttgggagggggaaccgacattggcggtcaaggagagcgagctggcggtcatcgacgcgtgcagccaaggcggcgacaggtgatgacgccggcggtgtcgggcaaaaggaaaaaggtgggggaacagggagctctgctggtgttcacgggcggcagcggcggtttcgtgggcagtgcgaaggcggcgacggtgtggatgcgttgggcggcgaaggcggtggatcgagcgtcggaaaatcgaaccgcgggagcgggaggattagcgcgggctggcgcggtcaaggtgggggtggcgagccggcgctggcgtctgcgtctctgcctccgagcgctagcggccaaggagtggaggcatggcgtcgttgcttgggagggaaaaagagaagggaggacggtggaaagggggggctttaccatgccggtttgggaaaaaggaggtgggagagggagaggagagcgcgtgaggcagagagacgcgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcggtttttgggcggcgacggcgggaatcggcgccaggaggggagagagcagagagagagcgaagacgggagagagaaagaatcgagagagcgagagagctctctctcggctcgcatgcgtgcaacgcacgtgcgagggggggtaagatgatgggctgggaggggagatgggctgggggagggaaatcggtccatccaaaaatacagggaggtaaagtagacttttacagagaaaactgatttggacagaattggagagattttagggtttggactcaaattcaaatttgatattcgaactcgagggtttagggatgtatcaagggggattcaaggagaagtcatggaaaggattcaaaaggaatacttgggtatttgttttcgggaacatagggtggagtcaaggaaaggattcgaggcgggatctgaatagttctggattcgtagaagtatttggcgaggatttagaggaaggatttgaatttcagaacttgatttcagagactcgaatcggaagagaaatttgaggtggaggattttgatttcgatgagagggatcaacgggatttgaaatgagatcttggcacgacttagactcgcacacaaagaacgaaaattttcgaaattaggattttgctgaattagttttttaacgcctcacgaaaagcggagcgttacatctggtttgtacttaaatgtttgtttcttatatcaactacattttatgaactactttgcattttatctaccacatgagtttatgtacagttgtagccctgcaaaagttgccaactgtcatatttgaacaaacaaaatttattccagaatcaatttccctacaaataaaaagagatataaaaatataaggactaaataaaaaacaaaattgtgaaaaaaataatgattctaaaaaaaatttacctgagcaaagtcaatcactagtttctttgttcctgtaccgagaacagaattgtctggatggaagaaaagacggttgacatattgaatcctaatgttttgaatgtctttttgagagaaatggtttgtcagctgaactcttgcaccccatagttccatgtattttagagtaaaaactccacaatcaaaactaggaaaaagaaaaaggacataagtaaccacagttacttatcataaaatataaaaaaaacaaaaaaaattaaaaaaagctaatgcagttatggtcatactatttactctataaatttactaatgaaatctattgcagttctagtccatgttgtactaagaaacaggctcttatcccatctagtaattctgaatgaaacaattgacaaacaggaactaaattttttgaatgataatcataacaaacaaactaaaattgtgcattaacagcaaaacaaacaggttatgcaacaattagaaaa

SEQ ID NO: 21299 - DNA, 2699 bp, Oryza sativa
  unsure (1)..(2699): unsure at all n locations
tcctgcgnccccaaaacgttcttcatgtaatgagtcaagaaagacaaacatttcatctttcagatgaacaatgaaaacaaaccagtggcgcttgtagaaaattggaaagaagagctgaaataattaaataaaacaaattataaatgtaaaaggaaatatgaaattaaatatgacaagtaatttacaaattcacaaaccatttcacatgattgaataggtctagcttttgatgcaccatcaaagcatttcctaactgatgagaaatcagttcttgatggatgctttagaagatcatcctatagcacaagtgtattcaataatttaaatattaaacatatagtaaaaattggttttcaattataaatataataaaacaaaaaataagaaacttactccaatagaagagaagaaataatgttttttggattttgaggggtgagataaatgaaacaaatatcggcagaacacagagacaacaaaattagaaacttcatgtccaaaattaaatgatcctccaaaagaactgaatttgcagtgaacaccatcaatttcaactgcatgtcgtctacattcagaatacaaataaattcaaattacaaatcatacattgaaaatgaagattatcagaaaaaaaaagtacaaaatagtacttactcttgatatctgcttgttgatagagtgcagacagcattataaatttgtctttcatattgtgagactgtgaagtttgatctttgaggagtataaggatctgtgcaatactttgtgggattgattacccttctaagatcatgatgaattggttttgttccagaagtacttggattgaaattcttcatgttgcataacaaaactctttctggactagcaaaggttttgaagttttgtttctgagaatccaacagaattctattcattttattgtacatcatgttggttttgtttccaatatcagcacatttcttagagaatttcttttcaccaataaaaacatcaggtgaatcctgaaatttaacaaataaattaaatagtacagttagaagcatattaaaaaaagaagatcaaaataactagaaataaaaaataataattattagcttataaccagaacagaaaaatgataaataaaagtaaggtacagggcatgaaatatttgaaatatcaatatgaaataacagttcagtaaataaactaatgatgttcaacagcaaacttacaaacttgagattataaactgaataaaaagaaatgaataagcagtgagaagaaaaaccttttggaataaaaattgaaagaatgtatgttattaactagaactgaaatacattgtaacctacaagaattacagcaaaactatggagaacaagaatgcaaaaatggaataagaaaaaattttaaacaccatttaatttcaaaaagggaacatcaatgaaaataaactacgagattattcatacctttatgatgtgacaaactttttcattttctttgttttcattgagagaagcattaggagaagttgaattttcaagtgtcaccatgtacatcttatcctaaaatttcaaaatttaacaaatgaaagtttagtttgtatatacagaagaaataaagaaagaaattaatgtcagaattaccggactgtctgaacagattattgggctttcaacagcagcagcaaaagtttgagacaactttcttggagtgatctgcaagatttgtataaatcaatataatgttctaaaaaagtattccttatgaaatttgaagttacttcacaagtaccttatttcttaaaacaggatttggggagtatgaatcaggaataacttgatatgaatctacaagatgagcaggtgtaatttcttttttgaaatcatcattttcatgatggaggtcatcatcagaatcctagattttaaaagacggttgatcatgaaaaacttgattgtttcgagctacagcaataacataagaattagaaacaaaaaatatggcaacaaaaagtaagaggaccatagtacagtgcactaaaatcacatgacaaaagaaatgaaatattacaataactcaatttttttgatgctagaacaattaaagatatacaagtaaaaacaaatgagattccgttaaaaaaaatttaccagtcaaggcagaatttttctctgtttcatctggtggattaataggaacatgaccttcaatgttaaataggcacaaacatcaataattcatatttaattttttaaaaaaacagattaacaaatttagaaaaaaaaataacctgttttgttcatctttgtcattatttcatcaatgttgatatgtttaatctgcacagataaaaaatgacagttaaaaactatcaacaattacagttctatatattcagattataatgattgaaataaaaatgaaaaaaaaacctcttctgaagaattcaaaatggtagacttattcacaggattaaattcttcatttggaattggcaacttatcatcatctagtactattttactgtttccctacaaaaaaataaaaggacaaaaaaatgcttaatgattcacatgactattagaataaaaaaaattgaaatgagaacagaaaccaatgtacctttggagatgagcgtgaaattgttatttttttgcacagcttgattaacatcatcattattttcttcaactggttcatgaactggt

SEQ ID NO: 21300 - DNA, 932 bp, Oryza sativa
ctggtctttttccatacactccttcagatattttatcaaatttggaatagtccttaatcatagatcttttccaaactttaattattggtgtatcaagtaatactttttgtgaaccaaagttgagaaaatccaggtaattaacctatgaaacattgaatatagaaattaaatgaatagtcatttagtacaaaatataaattagtataaatggagggaaaaaaatttaccgctaaatggaataaacaaccaccaaaagttttcgatttctcaatcttgctaatgtgttccatcaaccagtcaaaaactaacttgcaccagtccaaactttcaattaagtccatgtcttcaaaggcacttaggtattttgtacttggaatcaaagaagagtttggacaaaggaagcaattcaaggaaacaatcataaagcagatgagaatttgatcatcgggaagttcttcatttttaattaacttttctccaaagaacttgacagaaggaatagaagttttcccaaaaatctgaagaatcttttgtttgccataatcaaattttgaatggattgtactaccaccaacagggaggcctagcacaacatggacagattgcttgttcaatggaataagtttttggcccaaaactatatcagaacagttcacatctacttgttttgtaatccagagagcaaaagaattgggaacaaaacacttgtcaaatagcagcatgctttgaaaacaataattttcaatgactgttttgtgatgtggacttaaagaatcaagaacttttgagaaatatttgactgagaatctagagaatgcatcagacttcaaatcagtgtcaacatttttgtcctgacaaaaagaaaataaaacaatttaatcaataaataaaaaccaaacatacatagatataaagggcattgcaaaaaacta

SEQ ID NO: 21301 - DNA, 676 bp, Oryza sativa
ataagctgtctcaaagtcggcgacttcaaagcagacattatctgtatgaaagttttccccagtgccaaaggtaaccggcatagtgatttggccgagtggtgtagatgaaaacacaaggaagactccgtgaaagggtgcattcctcagccgtaactcgatcctcgagatctgcatttcgtcgagagtcttggcgaagaggatattgagcgctcttccgccatcaataagggttctcttgagcttacgttgcgaactactgggtctagtactgggggtaccgccccgggtggaccactcggttgggatgatccgagcgatcgaatcgattgcaacctcagaccattgtaggaattgtggtacttctggctggactgcgttgatctcccggtcggtcagcttctgcttcctcttggactcgtaggcaagtggccctccgaagatgtggttgagctccttccttgaatcctgcaaagtgccttgagctggctcggtgtcgtccttcttctatgttgacgtgtcagtttccccttaagtcggcttcttgaattgagcgacgtactgcttggcaaactgcttgtagacgaaacaatctttggcagcgtgcttggagttcgggtgaagtgaacatggcgcattcatgatcttgtcttaggtgttgacacgaattcgctgatgc

SEQ ID NO: 21302 - DNA, 710 bp, Oryza sativa
gaagcccccaacttgagtgcgaagcgcgagaattagaccaactagctcggcttcctaactgatgatgcgccgaggtggtgggttaccgactgccactataatcgtccggaagtgttgccgcgatcatggccttcatcctgttgagagttggcgtcacgtagtctggggcctcaggcaggatggtgtcgatgagggtgattgccccgactgcattctgctgaggtgtgagaaacacgttggtgtcatctacaacagtctgaccaatgagttgtcgagtgcgacgtccacattgagccaaatctctccgccttcccttttctctctccgtctttgttcttcttcctctcttgtacggcgctcctgatccagacgctcacgttccaatatctgccactcctgctcctagcgttcttgttctaaccttgtccgttcttcgtctgccagtcgtgtgccctctgctcgtctgtctcattgttggtcataaagacgccgaagtacagcgaagtgtagtcatcgttgaggtcaccgtagtagtcgtcgtagtagtcattgtagcaagcgaagttatcgaagtcgaagtcattgttgtagttgacgatttctggtttcgcttgagatccgatgttaggggagctaagatagctggcaatttcgtccgtcgagcaagagctgagtggttggaggatgactccgacctccctggagctaga

SEQ ID NO: 21303 - DNA, 2316 bp, Oryza sativa
gtactataaggtatcatgaggtaccaaattttatactgaatttttggtacctcatagtacctcctcaaggaccgtagatttgctccttcacggcaataaagaactcggacggggtcctgcactccctcgaaagacgagacgcaaattcctttgggtaggaggtgaggaaatttcagggggaaaaaaatgcagagttagctgggacaaggtctgtagacccaaagatttgggtggactaggggtgtttgatctcgatcgtttcgctagggctctgagaattatatggctgtggtacgagtggaccgatccagacaaccatggagtggcaccacggtcccctgtgaccaagaggatagagatctctttgcagcagcaacgaccatcactttgggggacggtaatatggcgagatttcggcactcacattggttggaagataagacccgaaacaaattggcgccggccatcttcgcagcctccaagcgcaagaatatatcagtgcacaacagtccatctatgccaatttgtctaactgtggacaatgatccagtgcatggctcctctcaacgcgcaacgggataccatcacttggaagtttatggctaatggagtctactcaagtaatttggcttatagaatgcaattcatgggggcagcatgaacaatcttcaaccaatcaataaggaaatgttgggagccgccaaagtgcaaagtcttctcatggctcgtaatcaaaaatagagtttcgacggtagacaggctgtagaagaggggatggacgaaccaccactttttcccactctgctgtgcctcgctagaatcggctctttatcttctcgccaaccgtaggatttcaaagagaatctggagcacactacagagttggacaaaaatcgatctccgcataaacaaatggaaagcctacgccaatgaagaagattggtggtacaaagtttcaaacacgccatacgtcatgcggaaagcgttaaagttggtgatcatcctcgtgacttgggagctctggtgcgagcgtaatgccagaatttttcggcgcctagccacaacgccagccatgatcgtggccaaaatcaaggaggaggcgagaacctggatcatgacgagagctgttaggcttacagagaccattccctgtggagagtagtgtcctacctcgatttcgccctataaatattactccatccattctttttcgtttgacgtttaatttgttagctcaaaattgtactagccaacgtcaaacatttgtacaaggaggtagtacttagcttgttatgactttactcttatctatcaatataaaatgacaaagcttttgcctcttaaaagaaaatgtcaccctctctctttgcaattgaaacaagttaacattaaataacaattattgcagagataaaaaacgaagaagttttgtccctggccgaaagactgaccctcgtgaactctttgggtcctctcgtcaatcttaacatagcacctaaggccatgttccaattggctagccaattgagccaattggtcagagaaaataaaatggatggaattgaataagaaggcaacggacgtaaacggcagacaatatccacgtatacgacgaagacactggctattgtatatgaatggatgtggagggatacaaacaccgtagatcgaactggaattccttgttttcaaccctggcagatcagtgatgaattgtctgtatctccatggtttggcatataagcaaatggagatttgctccggtccaacaaaaagtatctcgaggtacaaatatctcgcgataccaaattgtttccaattgttggatctaacaatgccattctgcccagctggatttaaggatcggaaacgatttaataccatgaggatcgtacctcgatatattttttgctggatcgaagtaaatctcccgcaaatgggcatagaagcttcgggggcaaacatttggtatcaattttttcttttaaaatcacaagggggtcaattagatggaggacagctaaaccacagttgttgctagatggaagaatgtgcattataaacaacaagacgaattgtgttatagttatcatcactggtggagaaaccgtctttggtcggtcgcccgaaatccacaataatcttagttccactaaaaaccgggactaaaaatgatcttaagtcccggttggtggctacagcgggcatatttgatctttagtcccggttggtgttaccaaccgggactaaaaatgatctttagtcccggttctaaatctgtcaggccttgtcaggccccccgagatctttagtcct

SEQ ID NO: 21304 - DNA, 6630 bp, Oryza sativa
tctcctctcaaccctctcctccccctcattctctcccccctcccctcccctccggctcccctccggcggcgggaggcggccaggcggcggcggtggcctccccttcgtcggatccgggaggggaggcggccgggtggcggtggcagagggcggcggccgtcgcatgcggagggccgccccaagcagcggcggcggaggctagcgcggcggcggcggcggaggccagcgcggagggctggccgcaaggcggcgggcggtggtggccgggcgcaaggcggtgggtggcggccgggcggcggtgacccgcgcggcagtcaggcgcaaggcggccggcggcccacggccgggcggcggcgactgcgaatttttttgaatgatttgtatattttggtggagcattttgttggttgatttagggatgattttgtgattaatttgtggattgtgattgatttgtggattgtggatgtggatgtattggggatgtattttgttatgcttgatgtatttttttttttgagattttgtgatgtatttgagtatttgagatgatcgattgtggatttggaggcaatttgaggatgattgatttgggattttggggatgggatggggtgaaatcaatatatattaaaaacaatgaagaaaagaaaataataaagagcaaccggatctagtctttttagtcccggttggtaagatagataatctttagtcccggttggtaacaccaaccgggactaaaaatggatttttactcccggtttttttacccgggactaaagataacgatctttagtcccggattcgtagtcccggttggaaaaccaggactacatgggggttacgaaccgggagtaaaaaccccttatccaccagtgcatactagctagtacatagatacaatgtaatcacacgatgcaagtagagagaaaattaaaaggtagcccgttcacattggcagatacctatttatgtgtggatgcatttttattgaattattttttactctattctaaatataattttctgaactaaaattactcgaaatcacgcagttttaaatctatgagaaaatatagtgtcgcactaatagagttgtttctacgaaactatatatcatttgtgttgtatttgtttattttttagaatatttaggatatcttatttttggagtttctaactttaagtaacatctttttcttatatactgtatacatatgtctttctatattttaggatatattggttggtgatattttctattaaaaatatgcttaatagcactacttcatctaacgaaagataaacttatatttacttatatttcctccatcccataaatctgagtattcaaattttataaaaaaaaacagggattttagagcactacctatcccatccaactatctcttatttatttttttacccaatcatactccaaccaccttcccactctcaacagacctttaatttaataaggggtgttatagtattttcccttcctccttaattttaggatccttaaattaatattttttaaacggtcaagctattgccgacgttttatatttagaagaagacgcatgtcccattttaagaagtaaatgagaccaaatcttacagtgcctagttaatttgggaaaactaagcgaaaaccacaattacaacaccacaccaacagctaacctaacctaaggtaccacgatggagcccgacacaagactctggccaagcttaacatataggtgacacaatagcccacacatgttatcgttgccaagcttgccacccaagcgacacagcagtttcgacttcactacgatgctaccccaactccaaaaggagcaaacataaacgatatcgatgaaggacatcagcctaagctaccaaggaaccagttcctgcacgcagctagcatcaacaatcctataaaaagattggagtgtgtcaccgttgccaagttttgtcgcacccctacaacgaagcagctccgactctacccagcagtacacaaataagaatgatgaacacccgccgtagagcaaggaacagaaccaaggcagcgaaggcctcgtcaaacaccctaggcttgtaggggatcagaggcattgcaggagtccaccaatgctatcgttgcacgcggaaggttcttgctgctacgagaggtcaatgccagaacgacgcctccaagaagggaaacgacacctaatggcgtcgtcgtagtcatgctggcccatggcctagcaaggcttttaccaatgagtcccaatcaaaaccccacacaaccatcatgcacaacaaccatcgttggaccaccaccgctagcacccgagtgaccaagcgcgagtcacgctagcgtcctcctcatgtagaccaccactggccatgtccatgcgtcgctctggtcaaagccacgctcatgcttcgccggccgccacctcgcacaccaccggctgctgcctcaccctcctgtttcgcacccgtcctacacgcggtgcggccgcgctcaaggacaatgacgaagctgggccgacactaggccagggcagagagagagagagaaagagagagggagagagagagagagaccggatctggccaaagggacactggccgcacaccgcctgcacggccccttccccgccgcctgtgccatccatcaccgctccagcctaccctgcggcaccgtcctcccattgcttatgtcatcgccgatgctgtcgcgccgtcatcgactagttccatgccggggccagacctggagccagatctggcgcgactgtgtcggatccgcgtcctccaccaccaccgccatgaagccatcaccgtcaatgccgccgccggccacccgtcgcatgcgtcctcctcgacgccacccgccgtccagccgcagcctctcccctctcgtcgcagcccctcaccggatctggccgtgtgacccggccgcgagccgccgccttgctcccaagcgtcggccttctctgcccactgccgaagtgtcgccgtcgacctctaacttgagatccgcccgtctagatctggagaggtgggagctgcgagccccgccgccgtagtcctgatgagcctccagctttgccggcacctcgctcgagcagtggcgaggcgaggggcgaaataaagtgagtgcgacgtgatagctaactatacgatcgagtcaacgctacaagatccattacacccaaatactacacataaacaaggtgatgtcacgatcccaaacatgtaaacatgtagttacatgtaaacatgtagtttcgccaacaccaaattcttaggttccgttcaagctagcagaatagcgagaattttatgtgaaatgagaaaaactattagcatataattaattaagtattaattaaagtacatatttatttgactttttgaagaaacatatgtatttttttacacaaaacatacaatttaacagtttggaaaatatggtcacagagaacgaaaaggtagctccttcgaaaacgcagaaaaggatgtagccttagtgcttatgtcgatttttatgattctccaccgttatcggttgcgtgcaaagcacaaacatttttacagtttatagaaacaccaataaatatataattttattaaagtactccctccgttttacaatgcacatttatatttatgacagaatgacttgcattgtaaaacggatgaagtatttttaagagtaatctgtatacgtacgtacgtacatacatatttctaactcaaatatattttagtcgttattaatagtgaaagtttacaaatagaccttgtccacaacgtatattatcaaccggaagggagcaagtaggctagataattaatgtggatggatgatggtagtagtcgtccttgctgagattcttccttgcagcatgagtgcatatatgtggctggcatggcagctcgctagtacttgctcaggctccgggcttgctcgacggcctacacacaaagtcaggttaagctatatatgcaagatactactactatggattgcgtagtacttcctcggtcctaaaaaatgaaagccaacctattattagacatgacacatctcgatacaatgaatatggacatactaatctatgtccagattcattgtcacatcctaatactagattggtttttttagacagagagagtacatgctatatccatttcagaatacttgtttttctagattatttagcatgcattaaggttcaaagaaaagaactatagtactcttaataaataatgtatagttagatatgggatggtggttgagagtagaatatataggaagaaatttgaattgaaaatggtatcttttaatgctagaaagacaggtaccgtgggacacggaggaattacctggcacacgctctgatacatggcttggttgatggctccgagcgacaggtcatggaagcatgccacgccgtggcggagccctgcggcggcttccgcgtcgtctagcacgcgcagcaggtcgcgtttcacgttggaccagtaagcgaggtgctcgtcgacaaagtccaactccacgcactgcgggcacctcaagctaatttcctctgaacagcttggagggacgaccacatgagctggtacgacttgtttagaagaaagtaccggaggctgaatcggagctagatcttcagaaggcaggaccaccggacgtggattctgaccagatttcggataatcagctggtttttcatcaggacgtggagaatattgtttgataggagtgggagccggatgagccggagctggatttggatcagctgaagaaggtgtagtcttggtactggtaggcgtgctgggctcaccctcaacgatcttctcctccagtggctttttcacctcctccactattgtcttcatcgccggcgtcgcgaactcggccggccaccaccttgttgggcgagcccatggtgttggcgcgctgcatctcctggctcgacacccacgagttgacataggctggcccttctcctttctcaacgtggtccgcaatctctttcacctgttcgtcgatgcgtcgcctcgtgcccacatccaggtctgtccaggcatcggagcgccttatctcgtccatgttccgctgcagcagctgcacggccaccttggtattcttcacgcccttgtgatcatcttctctacgctgctggaacgtcttgggtaccatgtccagcagcttgaacaccaccacctgctccacgacctgtggtgctggccggaggtcggcctggtcgacgacctctggcggcctccggatggccagtttgtgttccttaatgcggactgtcttcccgtccaccgagttggcgtcgccgtcggctgtgagaatctcctgctggttattgacggtggtggccgacaccttgggcaccttcaggtggacgatgaacttcttcacctcgtcgacgtagagtaccgggatgaggatcttgccggaggttccgccgccgatgacttgactctcatagcccccagaatcgatgctcttgatgagcaccggctgctgctgctgctgcttatcactgcttttgggcttgagatcgacgcggatttcggcggcgacgaccgtgcggaggcctcctaggcagcgggcgaaggcctctgtgatgttgtcgaggttcttgcagacgaaggagtagaggccgtaggagagcgcggagatctgtctcagtggcacggggtcgtgggacgcgctgaagccgaacgtgtgcaccgcgtacttgcggagcatggcgccaacttcggagtggtcgacgtcggtgctcttcgccaccttctcccaattgatcctcgagtattggaactgatccactccgtcggacaggaggaggatgaatcccacgcgcttcttcttctcctccttgccgcgaccatccaggatctgcgtgcatgcaggcaacgacacattgtatatggctgtgtttacaattttacatccagagatgaaaagttttggcatatcacatcatatatatggacacatacacatttaaattattaaacgtagtctaataacaaaacaaattacaaattctgtctataaattgcgagatgaatttattaagactaattaatccatcattagcaaatgtttactgtagcaccacattgttaaattatggcgtaattaggcttaaaagattcgtcttgtattttacacctttttttatatttaatactccatgtgtccaaacattcaatgtggcaggatgaaaagtttttatgtgggaactaaacaggcctatactagtcagtactcagcaagctagctatgagtagtagtcgctactacagattcagacatccacaatccttcacgagtaactcatctttaaaggattgagaaatagccgattaaaatatggctacggagaatgctaagtttccttcaacaaatagtttccttttataaattgctatgagtcgatgtcgccattatctttctctcttttccatgtaagcaaacttaccctcttaacaactctaagaaatctctatttttttagtagtagctatatttatggcgctatattttttaccaaaaaatagtcaccatatatttacattgtaaattcatataaattacatatgtaaggg

SEQ ID NO: 21305 - DNA, 3271 bp, Oryza sativa
attcctgcagcccgtgtattaaaaatgtaagtcctaaaattacatatgtaaatcatatggaagtgatgggtaagttagacaaaatgagttagttgctcgcatggtaagcgtcttggtttgtaatgctcagggcatgagtataattctgctcgtctcttggatctctgattctttttgttttatgtattgcacgaatcttaacatataccgtatggattatgaatcgacatattctttccacaaaatatggagccatttttttagcagctccgttttttttatcattgtgcatatcctctaatacggtttttttttaagaactagggcacaaagcccccctttccattaatggaacggcataattgtcttacagattctaaactagaaacagaaagcccagaaagagggttcccacaaaaagaccagcaaaacaactggttgagggagaatatcctctaatacggttagaataatatatatgatcaagctaatattcggaattgtcttttttcctcttcttaatcccatcggccataagtggttagatctatattcttcttccctcatcttgctctccaactctattcttaacccatacccagtaatataggccggtatagtccttccctcatctttattttcaatcctattcttatcaacccatacccaattatataggcaagtatagtccatcctaatcatatagacccgttgcaattaatgtgtgggcatgttactggtgtatagaaagataaagatatactgtagaaatgaaaattgttttaattaaggtcttctgacctatagggtggtaagagcaaacaattgaattttcatttgtttcaccaataaaaaatcggaattgctaaatatttgttgacagatttttgatggctaaatctttcactttctaaaccgttggatgtgtcctagattcatgttaacagtttaatacgcatcaagatatgtgcttttaggaagaaaaacaaaatcatatttagggatcgatcctgtaacctcataggatgaagacgtgactgccccattgggctactatatttttatgatccagtttgaacttatatcttacttatactataattacatgcgagttacatgcaagttatatatgtaattatagtgcaaatatagtgtaattatgaaaattacatacgtaattatagtataaatatagtttaattatgaaaattacattgtaattatgttacagttacatttgacagatttttagactaatttttagtcgaatgttgtatagatagtcccataaaaaatattattttttaatttcggatcaataaatcgatcacagcaaaaaggaaatcaccaaggtccataattaccctatctaaatttaagcatatgcatccatacaagaaattaatgctccggtacggttaaagatgcaaactttataccggccatttgaactgctcgtgaattcgaatatttttgtttggttatatcataaatactacaagacgggcaaccatctggacgggataactaaagaggaattttataggacttgaaaaaaaattttggtaccttgaggtaccaaattttatattagaaaatgtggtacctctaaatataattctcaagaatagtaaaattaccctaattaaaaatatctagcgctctacagatttactctattctctctacctctctctctctgactaccatccccatgagcacggaggtaacaatgatggctggccgtgtgggtggttcatccggcgcagccattgccggtggtgtgttgggcgtggaaggagccaccgtcacaggcgccgctggtggtgatggtggaggtgtgggtggagtagaggaggagagtgtggagttgtttgtgtggcaggtgcccaagcacatgatggaacacagagctgcttgccattttctataggaggtggccatcgtcgataaggtcaccgtcatcaaggacaaggcttctcaaggtgcggatcctacatccagatctgggcttgtgaccctgtgctcttgcattgtttgttttggagtttgattatggggtgttctacatgttctatgggtgtttctacatccatagcaactttttcctggaattgattttttttagctctctcttgatgatcatatgatttgttgttcttattgcaatgatattttagttgtatcatgatactttggtacatataggtcttgaatctagtacctataggtatcaatctagtagcgaaatattatggctggtacatagaggtatatatcgtacttggtacctataaaataccagacctagtatacaggtatcatgttcgataccaataggtattacacatggtaccacagacgtatatagtgatggcatcattgacgtgttatctagaatatcagacatagtacttaggtatcatgttctgtactaataggtattacacatggtaccacggacgtatatagtgatggcatcattgacgtgttatctaggatatcagacatggtacttaggtatcatgttcggtactaataggtaccacatatgcatggtaccgaactgtacgtatatagtgacattaacattggtgttgatacgacattatcaagtatctagtccggacgggataccgttctgtagcagtccgttatttgaattcgctaccaataaaagttctacaaaaactagtagtacggaaagaaactgaaatgcatcaaaacgaatttgtactttaaaatatcaaattctgggtgttaaaataaaattaagtactgtccggtttcaaaatacctgaaagttgttataagcacttgaattctttatattctgaatgttcatgtcctaatatcaaattttctatgggattttatcataaaattaatttaaatttcttatatgtacaaatatgcgaagttcagaaattcttttgtatattgttaatcgaatttaaaaaatatagcaagtgatgttgttggattaattgcttgaatttttttacgatgagcatatgctaagcttgtttacaccgtctagttagtactacaggttaatccaatggatcgagtagtcttacctcatcggaggatatactccctccgtcccatgatacaagagattttaacgttttgcttatactgtttgttcacttgtcttattcaaaaattttgtgcaaatattaaaaacgaaaagttgtgtttaaaatactttagataataaagtaagtcataaaaataaataataattccaaattttctttgaataaga

SEQ ID NO: 21306 - DNA, 2565 bp, Oryza sativa
tccggcgccaccaccttgggcgcctccaccgtcaccagcacctcgaagtcgtccttccgttggtcccgtgcgatcgccgcccggatcggggtggtgctcactcgcacctcttgccggtcaatagccgccttcgacgttgcctgcactagctagctagctcatcattaatctgatcagcgttgggaagacgaaaagtagtgtactacagtattagatagctatatatgttatctagctgtgtactgtatttgccatcaattcgatgaacattcaaccagaatccactcttgatcgatttgaaagaattattacaattttttcccgaaattaagtttttttaataagtccccaatttaatttcgttgcaacctacagatactgcagatcagccaaccaatgtacatgtatagatatatagctccttacttgcagcaagcacaacacagagaataatggccaacaacaaattaaaaacaactaacaacaactaatttaatcaaagatatagaacagccatatagatcgatcagatcataacctccatcttcgtcttcccagcgctggacgatgccatggctcaggtcgatccagaataccgtacaatcttaatcactctccctagctagctctcaattggattagcgcgttgagtgcagatcgagagctggtatgatcagcttaagctaaatgagaatacggagttgtagacaggaacaaatagatatgtatatatgttgtgtgtttggagccgagcgaacgcccgtgaggccgtgatcatacgacaattactaaaaggcacatccttgataaacaatgacgcgaccctcatcagtcttaatcttatcaatggaaattaattaatattgtagactagctcgtgaccggcaatgcaaattaccaagcgcttaatgtggaaatgggataagggcagggttttcaatttcgaaattaaatattatacttgggggttaccgaaattttggaaattttgagccaaaattatttgaaaatttgactgtatttgaataaaatttgaccaaattcaaaaacattgcaaaaaaccaaaaattttgggcgagatttgagcatgctggtggggggctgaaatttcagaaatttcgaaccgaaatttcaaaccctatataatggcgaggcgcccatgttttcttccgcatcgggcacccgttgggaagtgttttgacattcgatcaggacaccagacatgagaagtgacacaaatgtgagaagaaatttagagggaaacatatactatgtacataagtttttcatgcacaccaactaacaaataacaaatgccactaaaaattttagaaaaaattggacatatactttaaatagtattgcatctatatgtgaaatctgatatttaaattcatttttagtcataacaaaagagacaaaattttgacatatttttactcttaaaactgccagattgttcacttttttattacattgttttgcgatagtgctgtaatatttcttggtccatcgtttctttagctgcaattctgcaaatgcaacgcaattgaagcatcatgaaccactcaaattaaacaacacgcacagagaaaacgcacatgcagtgttagggtaaacaatcagtttaaatgtttgaaaaattctgggtaggatagctttcgttgggttcaatgcttacctgcgtagcaggagaaggtggaggacatgatcagaagaagcatcaaaaccgccgcgatggagtaggacatcctcttggtagctgccattaggagattaatgaagaaacaggctccgatcgagctgttattgtacagtatacagtaagtatgtatatatatatatatatatatatgtatgtatatatatatatatatatatatatatgtatgtatatatatatgtatgtatatatatgtatgtatatatatgtgtatgtatatacatatatgtatacatatatatatatatatatatgtatatatatatatatatgtatatatatatatgtgcgcctgctctgtttcgcaatgcgctcattgttgtgcacctttgctcatgtttttagatgagttcttgcatttatgccttcagaaatctctagtgtacaattaattgcttttccatgtgtaaggctgtgtttagattcaaagtttggatccaaacttcagtcatttttcatcacatcaacctgtcatacacacacaatttttcaatcacattatctttaatttcaaccaaaatccaaactttgtgttaaactaaacacagcctaaggtttctttgctgtcatttcaaatgttccagcattaaatgccccttatatctttgtacagttaattgttgtcatttttgttttggatatacacgtatttatatatgacaatagatctcttcagatgtgcaaaattttgaacagaaaaaagtttaattgggccgacaagcgttggcttgtcctgttaggcctgcaagcattatgtatgcatgatcggttcatgactactcgcccatgaaaggagtatgcatgcttccccaatgtttcggtataaatagatcagtgaatat

SEQ ID NO: 21307 - DNA, 3456 bp, Oryza sativa
cccctatatatattctaaaacaaagcagtttcattaagaacaatccaacttaattcctttattaatttccctttaatatagcatttatatctgttcatgcatcactgcaaaatctaagaacaacctcagacattattttccattcaaaataaccgtatgaagtttcttgattatgttaactcttaattaaacctcagacattattttccattcaaaataaccgtatgaagtttcttatttacgttaactcttaattattccacccagctgtaccaatttaattgggccagagcagtatcacaaatatgtgggcggccaaatttagttgagctgagaaacgctggctgatcttgtcatgtctctatttctaatctatggattatttgggccgcaagggaatacggttgtcaaagcatgtttgcacgtgtaacgtcgcgcttttagccagacgttagaaactaattcggcaaaatcataatttcaaaaatttggttctttgtgtgcgagtctaagtcgtgccgtggatctcaattcaaatcccgttgttccctctcatcgccatcaaaatccccctcctcaaaatgtcaattctgattcaactcccaatgtcaaacaccgaaattcaatcccgtccttgaactccttgccaatatttctcttggttctgagaataccaaatccccgtttggaattccttcgtcaactcctccctctcatccaaatcccaaatcccgaagtccaaatatcaaatttgaaattcaaacctaaactccaatactctccaaattcaatctttgtcaaagtctatttcgcctcccttgtcaatgggctgttcctctctcccggcccatcccctcctctcggcccagctctctcctgcgcgtgcaccggacgtgctcggagcgagcgagagagcgccgtcttctctttcccctctgtctcgctcgttctctctcctctctcaccggcgccgatttcccgccaccgccatccgaacctccaccgccttcgtcactccggcaccaaatcccccgcccgtcgccattcaatttttggccgcgccagccgctccttgcacgcgcgccatgccgcctggtcgccgccgcgtcagccctgacgccgcccatgccctgttgccgcgtcgtcggttgtattcttgggctgttctgagctgcaacctaagttaaggtaaataagtcctctatttattttaaggattgcgatgaatcataattgtcaccgtgggtaccagcgctatgtcctgggactggtactgagatcatggtttcgtaggaagcggttcgcactgtttttcctacgacacgctcctgtcaggtaccgttgtacagcggtatcagattgggtgtgacagcacgatcacacaattttgtagcagaatgcatgatatgatgatctatacatgcttgattaaataaccggttcactcctaacacacaaatgggatgaagggaagaatgcatgcttctcccaaaatctcagtataaatacgttaaggaatgtagagtagctattgtatgtcacaattaccttatatgtaagattattaaataaggactaacccaagcagtcacgtgtgcggtcgggagtgagatattggggtagaacaaaattaaatggccatgtctatccttaattattgatttgatcatacttataacttagaacaaacataattgttgtgaaataatcaatatcttttagaaataattatccatacactcgcatgtattctattcctgatggatctatcacatttaacactagaaaatttatttaattctatagaagatatgatcaatgatgccatgtcagttaccatcttcatctggtcttatgtttgtgtaccacaattattaattatacttatttgtgttacaaagcacttaatttgaatatgaaatcaactacatgcacacattttacttgggctagaatggtgtcatgacacatatgtgggcgccaaaatttagttgggctgagaagcgctgacaggtcttgttacacttctagtagttctctaagtattgggctgcaagggatcggaacatcactgtaaatgcatgtatgcatgatcacacaattttgtagccgaatgcatgatcccatgatctaatcatgcatgcatgatcaccagcatcagtgacggcaacgcccatggatgtgcttgctgcctctgcaaattaagctctgctgcctcctaacatccaaatttagttgggccggaaaagtgataacacaagtgttgaaggctccctcttaacatcgaagcgttggttgattgatatgcagttctacacatgttaggctagaatgggattggttgcatcctgacctgatggccgatacactactcctaaagaagcagatcgttcttcttttgacctttatcgatagatattagcttagctagcatattatatctctccatataaatacgtaagtatataatcatagaaagctctacatgacaccaaaatagtgtaaattggttttaattaaacatgtgtctgccccgcaaaaaaaaattaaacatgtgtctgagtaatattgttttgaggtgaaatattagagtgaaacatattaggatacccatgtctgggttttgtagttggttattattggtatttgttacagttaccaataaatccaagtgtatgaataccgctgcaacactccacctaacagtatttcaaggatatcgaataatagatgtgtatatctacaaacatgattctaccatacaaatggtaggcttaaactagaggggattcctatgaattaattaactaagcttaaactaaataaaaatctatcaattggtgtccagttcatccctggtctaccaagagatctatgtaagtaaacgtggggatagaagggatgatggacatggttgtcacacctgctgtctatcatactttccgtggagagtcacgtagatattaatttaagtgcctacctcactataaatttggcgtctatgtggcaccttctgtctgccgtacttactttccgttgagagccacgtagctattaatttaactgcctacctcactataaatttggcgtctatgtgacattgttcatcgtgctatatgtctatgagagaatatgattagaaaaataaataaaagaactcaacagaacccacatgttatgattagcttaaataaaaataatattgtagaacctagtaggccagcggcagagggtaatcgatcacttgagcaccgccgtgggatgttgcttccccattatcgcaccactagcctactgaccgcatcgctgaaactgtcctctgtgccgagctcgagacggtaagagctcgagccttagccaacgcaggggaggacgcggcgacaatgatggggacgatggtggatgaccaccgttgtcatcgcacgagccgatgatggagcaggactagccaccttt

SEQ ID NO: 21308 - DNA, 659 bp, Oryza sativa
  unsure (1)..(659): unsure at all n locations
aagtcattattatatgatgaaaacttacatggccaagaagattaataaattcaccatatcgatgaaaacttgatgtctttttcccactgacaatctcaagaattagcacaccgaaactgaatacgtcggatttgattgaaaaaaggccctcagaagcatactcaggagccatataaccactgaaaagatgcacatacaaaacattgaagtgaggtaacagtattggcagttttgtgtacagctaatgaattttataataaaatcttactatgttccaacgatcctttttgtattcccttcattatcattcacgctaaatatttttgcaagcccaaaatctgcaattttagggttcatttcacggtccaagagaatattgcctgctttgagatctctgtgtatgacacgcaaccgagaatgcttatgcaaatacagaagtccttgtgctatcccatctattatcgctaggcgtttatgccaatctatcaaagctcttcttgtttcatctgcaaatcaattcaacatagatataacaaagaatatacatttcgcagttagagttagtgaaccaaatcttttatttgcggtacggtacagcaagaagtaataccaaaaatgaagaaatcnnnnnnnnnnnnnnnnnnnnnnnnnnnnnnnnn

SEQ ID NO: 21309 - DNA, 1038 bp, Oryza sativa
taaagtcgaaaaattaatgacaaaaccttcgaaaaattattgttgtctgtagtaaattaagtggataatatataataagcacgtgaatgatttaaaattgttaaaaattctaataatcatatataattagcatatgcatattaaattgttaaaaattctaattaacctatgtaaataccacatgcatgatttaaaattaataaaaattctaataagcatatattattagcatatgcatgatattaaattgttaaaaattctaattaacatatgtaaatcccacatgcatgatttaaaacttttaaaaattctaataatcatatttatttagcatatgcatgatattaaattgttaaaaattctaattaacatatgtaaatcccacatgcatgatttaaaacttttaaaaattctaataattatatatacctagcatatgcatgatttaaatttgttaatcatcatatataactagcatattcaatacatccaaaatagtttacaacaattacggcaatacatcggcggtgacgattgtccgcacgtactttctcctcactattgttccttccttgtgatcgctacgtgagtaaggggtgtcttcatttgataggaggatgctagggtcaatcgtcaccgtgaaagggggttgcccatcaaactgatcgtaatcctcgtcagtcttgtcctctactccgacaatttttcttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctcctcgatggcaccgtaatatgtgccagttgtaccatcgtgtcccatggcatcgatacgaacatcactgttct

SEQ ID NO: 21310 - DNA, 5936 bp, Oryza sativa
taatccaaagatcacaaattcacaatctggccatgccagttttattttggcttactgatctcagccaccatgcttaacgtcctcttctctggctgtgttccaaatgccgtgcattggcgtgcatgtgcacaccatgatccgcccccagcatttagtatatttgacaggcttaattacttcctgatcaacaaaacagaatcaacatgagtaacagtataatcaccgtagagcataacttttcaaataaaaaaaaaagaaatggaggagcacacatggactttacattgaacatgtatggatgcttataaatgcttgtttggaatgtgcttgatcttttgccagttttcataaccaattgtttggcacgaactcgtgagcacgtcgctgcagcgataaagtcgaaacgtcttaagagacaggggtagcactggaagcagcaagatttgagggcaaagaaatagctctagtttctcgagtgacttgagacgctccatgttatctggtaaggagtcccagctgcaacaccaaatcacgagcgaacgaagatcagtgaacagctcgctttgttgaggaatagatcccaatgggctgcatctgttgagtttcagttggttcaggagcttggggccattgttcaggttcagcagctgacccacaagcctcccatctgtaatcttttgtgcttgtacatcagtacattaaaaaaacatagattaagcttaggttcatgctgtcacaagtgcggaaaaaaaaagacaaaccatgtgacttcaagctcccgctcaagtgctcatcatttcatcaagtgatgtatatatatagcatatatgaagcactctaggaaaaaaaaggagatttggagggagaggtgtccctccatgcatttttaaagaagaaattccatgtgacttcatgctcctgctcaagtgctcatggtttcatcaagtggtgggtcctgtcaagattcaatcaactactattagatatgtggtatccataaccctgatatatatatatatatacatatatacatatatatacatatatacatatatatatatatatatatatatatatatatatatatatatatatatatatatatatatatatatatatatatatatatatatatatatagacacggtcgcgctacacggcacgacacataggcgctgtgcgccaggaaaactccatggtgcgacacacagcgacaaaccccccaccaccgaggcatccaaaccacccgtgtagttaaaatataacttagatagagttgagtggtggggggcgatgacatcgttgaggagttaatattatgcattaattcagttggtttgagttaaaatttaacttaaacacagttgggtggtgcgatacgatgacatggttttggagttaaaaatttagttgttgttgaattttgaacgatatgtgattgaacctggtcactgctgagttaaaaattaactcgtgacaccccatgaccgagacaaccaacccgtctcgcggagttaaaatttaaccgagatacagttgtgtggtagggtgcgatgatatcgttgtagagttgacatttttctttaattcagaggattgttcgcattgttttgtaatttgttgttatcaaaaaatacatcccaacacgtataagttttcacgtattcattacaaaaccgtattttacacgggatgcagctgaataaggttaaaaacattggagggcgggctaagtaaaaaattaacttggtatccttactaagtaaaaaattaacttggtatgacaataaaagttttactcaacatatacatcctcacaatttatgagcaaaagttaaaattttgtttacacttgctccggacatcgacggcggcgtgtcgtggaggtggcaccactggtcttgcctatccatcggagtccgagctcgccaccacggaggtcgccgccgtgcgcatggaggcggcgtggaggccggatccatcaccgcctcgcctcccgccccagtcgcccgtcacagccgcgccggctatgccccaccgcggctggatccgcgcgcgtggggtgtggagcagcggccagatgcgccgcatcctcgcctcccgctcgccgtcgcccatcacagcctcgcccgcagccatgccgcgccggatctgctgacaccgcgccagccgcagctcggtggtggaggtggagccgccgcgtctccccgtgcaggatcagtgccggatccgccgtcgcaccgcatcctcgcctcccgctcatcgttgcccgtcaccgcctcgcccgcagccgtgccgtgccggatccgccgacgctacgctagcctcccagtgccagatcagcggcggattcgcccgaccgcggccggatccacatgcgtggggcacggagcggtggccggatacgccgcctcctcacctccctcacgccatcgcccgtcgccgccacgcctgtagccgtgccatgccatgctggatccgccgatgccgtgcccgccgtcgctcggcagtggaggtggagccgccgcgtctccctcccgccgacgtcgcgccctcagtcgcctctctcatgtctggaaaaataggatcagtatgtggttggttgcagggtgggggaacaacacatgtatatatatgctaaaagttgggaatatcaacttaaaattttagtcagattatgggtgtggaggagtggcgcatgtgtggggcgtcgtgagttaaattttaactgtggattatggttgcacagcgggtggggctgggtggcgtgccatggattaaacggcacctgatatagtgaccagacccacccactgcccaccaccccactcccctcctaactccacccactttgatttgcgagttaaatttttactactacatagcccaccatatatattcacgttgagtcagttaaattttaactgtgtgattcagcaactataatgaacatgacttagcatattgagttatttattaactaaaggaaacttttttttgctcatgccttaatttttttttgttattattattattattattattattattattattattattattattattattattattattattattattattaatattattattattattattattattattctgtttcataatgtttttgcaaaatttaaacgtctacgtattaaacggcacctgacatagtgaccagacccacccactgcccaccacctgtggcagcctgattttcgtttaaggatttataaatcatttaataaattattaatagaatttatattaaatgttcattaatttacaagtgaagttaaatgtgggaaataaaatttcctaaatataaagcatggatggatttaatttttattaaattctccatgattagttatactctctggaattttctcagatttttcagagctcaattcctaattttaataatacaaagaacagtttagcaattatttaaataataaatttatcattaaatgatctggatattattatattaaatactttgagtgtccaagtatgttcaagatttttcttggaattatttgagcattggaagtatttttaacaattgaaagatcatctcattggttaatttatttggaaaagtaaataaaagtcctcctcatcagcttgggccgaatccagcccattgcctccccttctctctcccttcctctcagcccacatagaagtctgtttttcctccctgtggctacagtgctccttcttctacctctagacagagccgagccagccgtgctcgtgcacagtgccgccgcctcctcccaccaatccgacctccccgttgctcctctttccaaattagttgcgggaatggaatcccctcaatctcctcttccttttccccaagaaatccccaaaattttctatggaaattctttccaatttcgcagatcaaatccttccttttaccggcgaaaaccctagactttcccgattttttttctcgtcgatttgggcccggacccgagctcccgtgcctatataaaggaccccctagtcgtcctctcctcatcccctcaagtcccgtccgccgccgtcgccggaaacgctctccccgcgagctccctctctctccacctccggccgccactccagccgccattcgccgtcgccccggccgtcgccggtcagcgccgcctcctccctcggctccgcaacgtcgagccctaccccggccgctgttgttttgcgccaaatccaatcggaggtagcccgtcgtcgtgaaccggagcgccgccgtcgccgccgtgtctccagccgccccgcgccgtcgctgtggtcgccgctgctgctcgccgttgcctccgtcaggttcgcaagaaggagctgcaccccgtccgccccttcgtcgccaccaaaatccaccggagctccatcgtcgccgtcaacccgaagttcgccgtcgcgttttgatctccggcgaagccctgctgctcctcccgtcatcgccaagcttcgccgctgcctccattggattcgcagctgcgaagtgaagcccggccacccctccgttgtcgccgcacatcgccggaaagtcgtcgcctccgtggccagtacctcgccgcccttcaaagctcgtcgccggccatcttccgttgccgttcgtcgtcgcataagtggtggctagggtcactttgatctcctctttctcccggtgccctccgtttgcattatttcgtcggcaaccgccgctcctatgtcgttcaccggtgtactttatccctagggtcttaattcaatctaatccattgtctgtctagcatcgtcgtcgtctccatgtgttgccgccggttcaccgtcgtcatctatctccgatcgctttggttcggtgagacttctatccgtgtcccctcgggttaggtttcaatccctcggtcatgtcgccgccgctgttgctctaaccctagcgcagccgctgccgcgtcacttgccggctgccctgtgcaccgtcactaccggttgtgccgttgttgcttgttgccgccgttgtgctagccgcctagccaaaccaagtcgccctagtgccgccatgtcgcagctgtgtgccgctttaacctagccgccgctttagccgttgctcggtagccaagttgtctagccgtaggtgtatccctaaattcctaccggtctatcgtttgtcgtaccggggctttaccgtgaatcgtttctagccgaccggtttagttgcagccgttgttgaatcgttcgctcgttcgttcgaataaggtgttccccgtgcttcgttcgttcgtccgtgttgagtcgtcctttagttcagagccgccggttccgttcgccggtttcggttgatcatttgggtgatcccgtgtcacgtagaattgactcgttgagttggtatcccgtgaggcctgcttgccagatcaatctaagccatccgatcttggtcgactcggtcaagattaatctcagccatataaatcctttcctctctttccaatggcatattggttctttttatcatatgtcatctaccaatataatctaatcttttccggaggttgctttaatcttttctctcaattataaatcatttgtaaattgtttaattaatttggaatagtcttttctttaataggtttaattggaatttaatcttgtaaaatttgtaattaattcatatgaaatcggaatgaggtcgttcaagtctctaaattcatctaaaatcatgatctacatgtttgtttactttatatgtactgtttatttggagtttcttagtctttttcctcgttttgcatgttagcttgtcgtttccgtcgtttcgaaggttcgtgagtgcgtcggaagtattcaagaagattaattgaagaccctttattgcaaggcaagtcacagatcccaaacataattcctttgagcatgttgatcctacatttaaa

SEQ ID NO: 21311 - DNA, 6219 bp, Oryza sativa
gcaccagactgagaagtggcggagataagcccacgggggtcgctggggagtccatgccttgtttataagggggtgattatgatccaggaacggtgcgttgtggtggattgtgttgtgcgaggggtactgtcacagctcctttccgaggtaccgtggtggtattgaggcacatggtgacatgtcgtggggctgtgtcttgtgggtacagtggtacacctttggccagagtaaaactattcgaatagccgtgcccgcggttatgggcgggtcaaacaatgtctttcgtgattagtcccacactattcattaataataatgtggtaattgatgctaattaatttagctcctggtttggaatggtatattcttggtttggagatagatctgtgcagccgggtatggttgttcaggatggttgggcctgtgcagcatgggtatgttgtacagtgttgattaatattgatgattaattgctctactgttttacaattctcaaatgtttgctaaatgctgcttttgcaaataagccctatactatgccattctttagtatccttgtgcacttgcatatttgctgtgtggcttgctgagtatgtcatatgctcaccttgcaataatcaatcaaacctcagttgaagacaagttgcgaaggagaagatatttggcttataccccagttgagctgcctgtgggagtggagccggagcttcgctagaccgtaattccgctacagttttcttttcttttgtaagtatgtaacgttattattttgatggatttgtatattaaattgtcagtttgtgtacctcggctgattcctggacgagggttttatgcacaaattagttcagaaattactagtgaatttctgggcgtgacaccaccccactcccctcccgactccacccactttgattcacgagttaaatttttactactatatagcgcaccatatatattcatgtttagtcagttaaattttaactatgtgtgattcatcaactataataaacgtgacctagcatattgagttatttactatgataaacgtttagtattttcttgttattattatttttcttctgtttcattatgtttttgaaaaattaaatgtctatgattttttaatttttttgtaaatcaaatgttcttttttcgactgacattgaacaagttagttaatttttaactatatgtgatgtgaaaaatatttgaccattaactgatcaaaagtgatgtgaaaaatattttactcgagagtgatttttttactccctttacaaattagggcagagatagaagtaatttctttactcattgtttagagatgaatgctcagagtcgcgctatttgcttcctggcgccactgtatagaggaagagacgtacctccaaatagtttttaagaagaaattgtgagtgtgttagggattgaacacagaaccttacggttaaaaccacacatctcttgccactgcactatcaagtgcatctctatgaagcactctagaggaaaatgttacattcaagcatgcacatgattaatctactgaaataatcgtgatgttaacaagttaaaatactatagctagatggaaggcacgggacaaggtactgacctcctctttcactggtggagaaatcgtttgtagtcccggttcgtaaccccctttagtcccggttgtccaaccgaaactacgaatccgggactaaagatagcgatctttagtcccgggtgaaataaccgggattaaagatcgatcagccacgtggccggctgatccatctttagtcccggttggtgttaccaacctgaactaaagatctatgtaccatttttttatttgcatggccctgtttgctgcatggttgattatatatatatatatatatatacacacacacacacacacacaaaatacatatatatgcattgtaatatatatattatgcatgtatatagaatacatacatatatatatatatacatatgtgtatatatatatatatatgtatatatatatacatatatatatatatatatacacatatatatgtacacacatatatgtatatactgcagctgcttaggcctgacaagcggtttaccgagttcaaacttgtatgccacttccaccttcgggattggtgcgcctccaaccaactgagccatggttagaccggtgtccgaaatgaaatccgttatgccaaagtgttcgccggtcaccaacggctcgaacacttggtgtggttgttctccaagctgaggaactggtttggacttcttgtaataggctttcctaagtgttcggtcataatccgatagctttaaggcctccttgtttgtggtggacattcccttgaagaaattcttcacactcgggtcaatagctatcttcttttcagactccgaggcttgagttgcctcttcacttctcctgccacataagcgtcaagctcctcttgactgcaaccgtatggcggctccttgtttttggtggtgtcaactttggccttcttcgttgcccttgtgctggcaggaggtggagcttggcgagaccttgtcttgggaggtgcaggcggacacggtggaggtggaggaggcagaggagccggaggagatggtgcaggaggaggtggcggaggagccggaggagatggtgcaggaggacgtggcggaggaaccggaggagatggtgcaggaggagacggcagagccggaggagatggtgcacgagacgccgcttgtcgcctagggaggatgatgtaccgcttgcgccatagtataatggcgtggcttgtgtctcgtagatgcgtctcaccgtctcctcctgggtagtccaactcgaggtcctcgtacacggcttccaccagctcaacttcgaccatcgagtatcctgctggaatcggcctacagtggtaagtccctgaaatgtctgttgggatggccattcctgacaccaccttcacatgacgagaggttatctattagtaatcaacctaagcagcaacttgcggaacgtacgagtcaaaaatcatatattacatcgagcataccttgattgataagttcttgaagggaatatgcagctcacatggtgtccgttgcgtgatctcatcaacggggcaggtggtttcgtcctgggtttgcatggcgtccatgctatgtgatcctacctgccctgttgaggcgcagctgctacgattgcctgatgggctgaccattggaggaggtatgtacggctggggatcgtgtgaccgatgtgctgccatgcgttcatccaccttccgggccacctcctcttgcatgctgagctcttagctcgataccctgtactcaagatctgcaatcttcgcctcggtatctctcttgctcctcatccgactcctgtacgtgtggatgtcctccttgaatcccatcttccagggaatcacgcctttccctcgtgttcgtcttggatgctcgggagtctgtagggcgagtgacagctcgtccttctctctgtcgggtcggaatgtgccctgagaagaggcttccactgcgtccgttagtcgattcgcagcctcgcgtatctgatcgctaaagaccaaggagccatcaattgggttgagcgttccaccatgagcatagtaccagaacttcgatcgatcaggccatttagcggtggccggtttgatacccctctcaagcaagcttgcctccatctcctcccacttcggcatcgcgacgctatagccgcctgacctcaagtggtgatggtacttcttcttggcggtattttctttgtttcttttcatcatcgcctgcccttgttgacctgtcttgtaagcaatgtactcatcccagtgatcccttagcttcgggaatacgtcgaagttcggtgtctgccccttcaggatgtatttctggtacagatctcccttgaaggtctggaactcttctgccattttcttaagagtccactgtttcactatgttctccgtacccgcagggagcgtgaacgtctcgagcattgtggtccatagcatctctttctctgattccgggacaaagctgtcattatccccgcgtgcccttgttctgcgccagtacaccttgctgacaggcacgttatccctcacaacccaaccgatgtggcgtacaaaattcttcgctgcttttgccggggcactaggtcggccgtctgcgtccacctcagttatgatgtgctgaccctctatcttcttcgcggcaccttgttgtccgcgtgccctcttctgtccagcggagggatgacttccactagcgtcctcgtcgttcccctccgcatccctctccacgttcccctcctcgttcccctcttcatccctctccatgttctcctcctcattcaagtactagtttggatcctcgttcccctttttttcgttccagtactggctgcttccctctacgattgtttcgtacagtatctgttcctcatcgcgatcagctatctgttcatagaagaaatatttgctaagcgtaatattaacactctactaatcttgtattaaaactcaaataatcatatatgctatgtctaagtgtcgtgtatttgtacatctctaataatcttatatcaaatttctaacaatcaaatatgtttcgaatattacatctctaataatcttatattaaatctctaacactcacatatgctaagtctaattaagttttgtatattaaacctctaataatcttatattaaatctctaactatctctaacactcaaatattctaagtctaataatctaataatctctaatactcacatatgctaactctaataatctaataatcttatattagaaatctaacaatcttatattatatatttaacaatcacatctttacatcacttgtctgcgtgaattcctttgagggctagctaccacttcggcttgagggacgacgacgacgacgtcttctctgcaacatgcaaaaaaatgtattagtctaaacgcaaaggaacatataatgtatttcacgttttcaagtatatataatcatatatatatgctaagttcaacaatagtttaatttatctcgttcgtacatgtttcgctcgcgttcgttctcacacttttagttcaagtgcattcacgttcgttcacatttcaatcatgttcgttcacgtttcattcacgttcgttcgcgttcgttcactaacactctcgttcgttcacgtttcagccacgttcgttcgcgttcattcgcgttcgttcacgtttcgttcgcgttcgttcacgtttcgttcatgttcgttcgcgttcgttcacgtttcaatcacgttcgttcgcgttcgttcacgtcgttcacgtcgttcgcgttcgttcacgtttcgttcgcattcgttcgccacggctgccacggccacatcctccacgtgagcgcatcctccacggtcacatcctcgtacacgttcgggcagccgtggcgacagcgtgtcgcggtggcggtggggcgtcgcggcggcgtggtggcggcggggcgtcgcggcggcgtcgcgcggtgtggtggcacggtggcgtggcgagctcgaggcgggggcggcggcgtggacgcggcgtggcggcgcggcggcgtggcgagctcgaggcgggggcgtcggtgctgtggctatggcagccgcgtggacgcggcggcgtcgtcggtggcggctgcgtggaagtcggggttggcatcggcggcaggcggaggaggggtcggcatcggcgcgtctacgtcggcggcggcgtcggcaacgagctaggcggtggcggtttggagagagagagagatcgagatcgagatcaaaagagagggaggcagcggcggctctcacccgagagatgcggcggcggcggcgtcggcggcggaggcggcgaggaccgcgagacgatggcgagagacgacggcggtgtcggtacggggatgcctaggcagtggcggcgaaggagctagaagccgatcggaggaaaaacgtctaagtgttggtagagaagacgagggcgcactgggaatatatatacccccagatctttactcccggttggtgagagttatctttactcccggttcgtaacaacaaccgggagtaaagatcttatctttaccaacaaccgggagtaaagatgatctttactcccagttggtgttacgaaccgggagtaaagatatctttactcccggttgttctcaccagggctgcaggaatt

SEQ ID NO: 21312 - DNA, 3667 bp, Oryza sativa
aactgatcgtaatcctcgtcagtcttgtcctctactccgacaatttttcttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctcctcgatggcaccgtaatatgtgccagttgtaccatcgtgtcccatggcatcgatacgaacatcactgttctggttcgtgctctttatgtcttgggctcgtgtgtagaatgtgtacccattgatctcatatccctggaatgtcgcgatcgagccagatggacccctcgccaggaaggccagttgctggttaatcgtctcgttacccatgagatgttgtcgcagccatgcggggaaagtatcaatgtgatgtcgtgtaatccatgcatcggacttaccgatgtttctggcgcgaactagagccaagtgctcctcgatgtaaggagccaccaatgaagattgttgtaaaacagtgaaatgggctttacggaataaattgttgtctaccgtcattattgctttccttccgagagtcccctttctccatagtctcccttcatggtgtgattcaggtaccctgattgggcgaaggtcttcaataaattctacgcagaattcaatgacctcctctgttccataccccttggcgatgcttgcctctggacgagtacggttacgaacatacttcttcagaacgcccatgtacctctcgaaaggaaacatgttgtgtaggaacacaggcccgagaataccgatctctttcactaggtgacaaagcagatgcatcattatattgaaaaatgaaggtggaaatatcaactcatagctgacaagacattgcaccacatcattctgaagggcttctaacctatccggatcgatgaccttctgcgaaattgcgttcatgaaagaacatagctttgttattgttgcccggacattgtctgggaggataccccttattataattggtagaagctgtgtcatcaacacgtgacagtcatgagactttaggtttgtgaacttcttctccttcgtgcttattattcgctttatattcgtggagtatccagatggtaccttgatgctctccaagcattgaaacatactttccttctctgccttgctaagagtgtagctggctggacttaagtaatggctgcctttctcctttggttccgggtgaaggtcgctgcgctgttccatatgcttcagatcattacgtgcttccagtgtatctttcgactttccatatatacctaggaagccaagaaggtttacgcaaaggttcttagtgaggtgcatcacgtcgatcgcgtggcggacgtccaagaattcccaatagggtaactcccaaaatatggagttttttttccacatcgccgcgtgaccatcttcgcagtctataggctggctgccaggcccctttccaaacactactttaagatctttcaccatagcaaacactgttttcccgctgtgatgtttaggcttcgtacggtggtccgccttatgttcaaagtgcttgcctttcttccgtactaggtggtttgcagcaagaaatcgacgatgacccgtgtacacaaccttcctacagtgcttaagatacgtactttctgtttcatccatacagtcagtgcaagccttgtaacccttgtttgactgcccggataggttgtaagtgcaggccaatcgttgatggttacgaacagcagcgctcataggtaaacccctcttgtttgtcctcgtcccacacggggacaccttccttcttccacaacagtttaagatcttcgaccagtggtcttaggaacacatcgatgtcgttaccaggttgcttggggccttgaataataatcggcatcattatgtacttcctcttcatgcatagccaaagggggaggttgtagatacacatcgtaacgggccaagtgctatggccactggtcatctctccaaaaggattcatgccatccgtacttaaaccaaaccatatgtttcgtgcgtgctttccaagtctttaaattttctgtcgatgtttcgccactacgaaccatctgcggggtgtctcagcatcccgtcctattgacgttcttcagcgtgccaacgcatcattctagcattccccttgttcctaaacaaacgccttagccgtggtattatagggaaataccacatcaccttagcaggaattctcttcttcgttagctgcccgtcaacctcacctagatcatctcgtctaatcttgtattatagtgctttacaaacagggcatgcttctaggttctcgtactcctcaccgcgatataggatacaatcattaggacatgcgtgaatcttctgaacttctagtcctagagggcagactatcttcttagcctcgtacgttgtctcgggcaatttgtttccctccggaagaatgttcttgacgagtttcaataaatcgccaaatgccttgtcactaacaccattttttgccttccattgcaagaactccagagtggtatccaactttttgtgcccctactcgcaacctgagtacaacgatgttctgtggtcctctaacatcttgtccaatttatgggccctcttttcactttcgcagtcctccttggtatcctgcaacatctgaccaagatcatccgcaatgtcgttataatcagcatctctatcctcctcgcccgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattgcatggacaacaaataaaacccttctgcttgttagcttcggccactctcaaaaaataatgcacgccatcaataaactctttggaccgccggtcagcgtacatccattgccgatccatctacatgaaatgaaaaaaaaatcgtacacaaatattcattcgtacaataatgacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaggattaactttcactatattttcctactcaactattttataaaaccttttttagcaaataaacaaaatttctatatattctttcttttcccacacaaattttctctctcatcaacttacaacaaaattttggagacaaaaaaagtgtgcaaaacatagctccaaatgtaatatgaccaaaaaaaattggaggatgaagttgctaaccttttaggcacctccgatttgtatataatcaccaaagtaaattcactataaattttgg

SEQ ID NO: 21313 - DNA, 15129 bp, Oryza sativa
ttggtccaccaaaaatcaagttcaaatttgacctacacattgagataaaaatacaaatttagaagtgaacacatacgctgaatttgtcttttcatatctcgacatatgagttgattttggacttaagattttgtggagttgtataagtatgttccatgagtgttgacaatttttttagaatttttcataaccatttagatgatttttaatcaaacaaggggacattccttgagggatcaaaatagtttaccaatcgaatatagaatgatagttataaggttagaataaccactaaaatttatccacaaaattcttttctgcattatatcttggttgagcccaacattttgcattgcacactcaatatatattgtaacatactcaaaatttcatgaaaattttttgcgaaatgttttaagtcatgctcttctcaattcttacgttgagcaaccttgctttcttttaatatcttttaatttggatccaaattttatttgcaaagttaaatgctctcttctaaattttataaaatccttattttattccttattttgtttatttcaaattttacaaaacccttccatttattttaatctataactttggctctagattatatttccttcgaatccattcccgaacatctccacatctacaaataccctttcgattcccactcaactatcttcaaagtacatgaaataataatttccaaccatccctagagtacataaaacaataattttcaatttcctcagagttaatactttccctttgatctctacccaaatatctctagagtacataaaatatcaactttcaatctccctctgagtcaacatagttttagagcttattatactaccaccaaatccgttcctataaaaattcctataattccccacctacatttatctccaaatccaaatttatcctccaacaaatactctccctttggaatcctccatatctaaattacctattcaaaatttccaagtctacaaattagtttgggccaatgtttctctaatcggcccaactttctgttatatcccattaaccctttttatccttagggctaaaccagtataatttcctttttgctggaatttattgtggatcaaacccttgatctatacctatctttagaaatccttatgtttctccttcatacaacaccttccacaaactcctctagatgttccactatccaaattcttatataaatcaaaccgccaatttgattcccaaggtttgattctcctcggcagaagaataatattaatacaaatattaaatgattgctcttgtgttaagaacactatttccaatcgcttccttagaaagtccaatttcctttagcccacaaatgtttcactcagaaatccgtaccacataatcttgggctaaagtccaatttattcccttccttttatttttgccaccatcccaaaaattcatccaaagtcagaaattaaatcatttgtgaactatttcaattttaaattataaaatattagagaaaatcttttgtgacaagttttatatttggttcttattgaattctataaacttggagcatctttattttatcctttcaaatttataccttaaaataaatatctttagttttattttaaaaagatttcaaactccttttgtattctaaaaatttctatatttaaatttttgtcaaaattctaaaagtcctcaaacttctcccttagtttctatttcctagaaatcctattcaaattcgttgtcaaagttcaaaaagtctccaaacaaatactcttcattttcattcccttcaaaattatacttaaattctttgttcaaagtttaaaaagtccacatccatccatcctttagttttttatcttcattgaattccaatcaaaaccctccacacaaaattatttaaacttcctattcaatttgagataaaaccctctcatttggcccattcctttttctttttccttctacttccttctccccctcgggctgtcggcctagccaaagccaagccagcccaactgagccgcctccgctctctctcactgtgggcgtgccgccgccatcaccacgccaccgcgggcgccactgtcacgcccagaaattcacgaaccagaatttccaagttgaaagtgcattaaacccctgtctaggaccagccagggtacacaaacgacaattgctgacatacagatccacgtcttacaaaaatataaaagattacaaatgcagcggaaaaggaaaaagcgagctaaacttggaagcttgacttcagcagcggggcgactccactccacaggcaatccttgacggcagcgacgaaaccaacttcaataagacatcaccaactaggaagatcttcagctctggtgtgggggaaaagagagcaagactgagtactacccactgtactcagcaagtcataccggaagagaaggtatgatgcaggatataaccaaaagaggctaaaggttcttttgcataaagctagcatttaaaaacagtagttgaaaacagtaaaacaattgcagtagattaagcaatattacccaatcactgtccaacgctacaccacgttgcaataggcccaacccaccacctgaactacaccagttcattaagctaaactaggggtgagactaatcacggtgaatctggttgatcacccataaccacgggcacggctattcgaatagttttactctggccagaggtgcacaactgtacccacaagacacgattccacacatgtcaccatgccccgagtaccaccatagcactgcaaaggaggaaatcgtgacaagacccttcgcataacccgcccctaaccatccacaccacgctaaggtttcacccccacccctcaaaaggcagtgggtagtcccctcgtgcgccgcggtgaatccggcagctggacaaccggacacctcgaccgacccaactccatcactcccaccctcgccaccggtgcctaggaaagggtcgagctatacttcagatcaagcagttacccactcccgcttgtggcaagcacggtaagtctcccagggtttcccgtgaaccggtccttaattgccatgggtgcgaccagcaaaaccatgcacccacagcccaccatttagtgtattttaattaactaacaccattgcggtggcaccaatccaaagctatgctcatagtcaaagtctatgtaataatgtgatccccatttgtgtactagttgaactaggcatggctaagcattttcctaaaccaacatctagtcattttgatacccaagttatcaatggcataaggtaaacaataaatggctgagtaataggacccatcccacatgacattgtaaaagaatgcaacatttaatagaaatacgggatatttgtaaattgggtacaatatgatcaattgtaatgcatgacttgccttgctcttgcactgatgagacctcagcaacgtcttcgaggaaccgcagatcgacgaaacggccgaaatctacgcgacaaacaaagcacacaagcaaaacatgctataagactactgaaacagaaaacaaaaccatttttaatggattcattgcatttttcttgatttactgagacttgaatggacttaaacggagctcggatgaattagttatgatttttagaagattctctgtgtttttactataaaaagaaatgccttaattatttattgtgcaatatattctcagggctgacgtcatcaggggggcaccgacaggtgggccccatgggtcagcgactcaagggagagggaggcgctggctggtgggccccacttggcagcggcacaaggcggccggtctaccgtggaccgggaccacgcgggtggtccaccgccggtccacgggaccgacggtccagattggccgggtggccgatcggacggcgcgggcggggctaggcatggctcggctcggcataaagccggccggccggccatggggagcggcggcggcgtgcgaccgccggcgacggcaagcggcggcggatggcgcataggctggcggcggcggccgaaggcgatggcgagcgcagagagcggcggcacgtgcgggacagagggaaggagggaggagaggagctcctcactggcgagcacggcggccggaacggaaggcaaaggcggcgacgatgaccctgtgagcggaggggcggatgggcggcggcgatacctaaaggaggggaggagaggagctacgagtagggaaaatgaccacagcggatgccattgacgaccggaggcggaggggagggacaaactcaccagcgtgcgaggagaaggggactccagtgggtttttgcggcaatcgagtggcggctgaagtgcgggcggactcggtgagcacgacggcggcgatggcgcggcgcggcggtggctctagcggcggcggcgcgcggcaggaggtgggcggcgggcggcggagctcgggtgcacggcgcggcggtggtaggaggcacgggagagcgcggcgagagcgaaaaacgagagagggggacgcggggagcgatttataggtgaagggggaggcggacgtggccaaggaggtggccgaaatcaccggtgacgtgggggcggagagagagagaatggggggtgggattcgaaatcgaatcccgcccattctcgggtgcgcgtgagtgcgggaggagcgggggaggggcggcgacgtgggagcggcgcggagtcggggcgcgaggtggagcagagaaggcaggcagcgtggggaggtgggggcgccggcggttggagctcagctccaaccggctggaggtaggggaaggactgacaggtggaccccacctgtcagcgcctgagagtgagagggtggccgggttgacttcgagaggggaagaggaaatgggccggcccggtaaggagggagagggcgcgggaagaaaaagagagaaaggaggaaaaagaaaagaagaaaaaggaaaaagaggaaattgatttccttggatttaaaatattgcactttcatgattttaattggttaaaattatttatagggctttgaaaattccactaaaaatgctgttaatgtattgtgacatgtggaacccaaggaaaatcccaccatgccatttacaattattgaatgcatttattaattagggaattagctcatggttatttaaacaatttctttgggcaatttattcaacaaatttttaaagcaagaaaaagggggaaacttcagggcgtgacagccaccatcgcctcgccccaaaccacacgccgcccaactgctaccacatcgccctgccgcgccgctcctttcaccagccgttgccacgccgctacgcgccgccgccactgccaaacctaggggcaccccgtgccaccccaacagccgccaccgccgccatggccatcctgtggccgccgcggctatgccgccaccgctgctgtattgctgctgttgcccattgctctgccgctgccacccattgttcaagccatcgccaaccactgagctatgccacgcgccgctgtgagccaacgccgaccactgagccgccattgccgcccatttgaaaatcgacacgcgccgccgcctctctcccaaagccgcgccgtgctgtcatcggcttctctccctccgccgccttcgccgcctataaaagccggtgagagccccttattttccccatcaaaaatcttgagagatctgtttagctctagtgcaggaacaaatcttgcttctgggtgaaagggcatgctagttggtttgatcctgcaaccaacaagaaacaaacacagaaacaaagttaaatccataaacgatagccgatcggccgcatgccgatgacgtatcatttgtaagctagccgatgtaacgtgaattagatcggcaatgatatataaagcaagaaaaagggtaaatctagtcgatcggctgtagatattagcagtttataatctatagatcgaaatatgtttaaaccaagtgattggaatagatcgtatagctttccgagacagtataaatcacttatgtctaaaagtacttcaatataaagattatacgtgcttatagcatagccgatgtcgtagatctaacatatatcggctaatactccgataccactttatactaagatatcaatatagattaaataattaaataggaattaatcaagtgttaaagtaaattaacagattaataacaagcttaatatattttcttttaatatattaataacaagcttcttttcttcaagggcctcggctatgtgctgccaattcgaagtagggccacaactggatccacaaaagagatacttttctagccacactaacagataggctgtgtgctctcgggggttaacagatccctggcccatattagcagaaatgaaccctgaccatcctcctatactcttagtcttgaaatcaaatttgttcttggagttcaggttcatgtggttagccgatgaggtaatgtccaagccagttatcattgtgatgtcaagcagagtaggggtcatcggcccttggttgaacataaaagcattaagggtgttggaccagaaataggctgcagaagctatcaagggttcatctttagccgaatttgctatggttagggctaaagcctggccgattcccagctcatcccagtggctctgcttgctagccgatatgcgcttgtaccatgcgggccagcttttctctagagaaggccaagacttgaaggtgtttttccagtggcctaggctaggattggctatcctgtaggggatcctattgatttcagcactaataaactctgcccggtgagagttaccaatcggaccgagaaagtactgatgctcgcgggacaagctagggatcacaatcagatttgcaagatgctacaaaagaagagcaaagggaagagaaggcaaactgagaccaagagaaaccgatctattgcataaaagaagggatttagccgataagggcttacctctgcgtactcagccgatggagcggtggatggaccggcggaagacgacattgccgcgggtggaagttgaccggagagggagtcgccttgagatcgtctttttgcgccgaggggattgccggagagaaagaagacagaaatcgcttgagcggttgagggcaaagtaacggtgtgaattttctcggggaggtcggttagtatttaaagccgtgtggtaacggttggaaaaatggcaatgtgcgattttcttggagatatgatatggcaaatccgaaacattaccaaatattccggacttggggggcatgtgttaacgaccaaatttggtaatccaagtatctgagataaggataaaatcgaagcagaatctaagagataaactgtttcgaaaacagagtaagaatcggctgaagtctgaatcggctgcggtcaagattggcagagttcgagtcgaacaaggttagccgattgagccgaattttggcaatacgactcggtatacatcattgggttgaatcaaagtgcttcatatggattgctgcacacgatttgagtcctggaaaggcaattgtatctattagttaggatattttatgtaatttccttatgatttgagtcggtaagagtccgccttagggacttgttcgtatcctaagttgtaatagggctcgaagtcgtgtccgatagggacatatcatgtatctcaggtataaaagtaagcccgaacccttgtaaacaattaacgcttagttcaatcaaattcggcgcatcgccaccctttcgttttgttctattttcgacgagttcttgctttcgagttgggctgcatcggcttcgatctctgacaagaggtaaaacttgttatggcggcttgtgttctcgggattagtgcttccatatttatgacactctaatattgtttgttgagttatcatatatcctatatagtttctggcaatattgttatttaaccttcaatcggctaacatctatgactggaaggcagccgatcaagttaaatatcaactttgacttagattatatagggtatctaccactctatgaatcaaccaacagcttgactttctagatattgtgattctcctcatacttatagctgcatcagttaagtttgaccttataagtcgtgattagaattttaatctctagcctgctttcggttgccgattagggtttcatcgggggtttcagccgatcttatctgatttagttgttttgtttacttcatgtttacttaacatgctaaatctgccctttatatcaagatctcactgttattaaatatattaggcttattattaatctgttaatctactttaacacttgattaattcttgttcaatatatttggtctataatgatatcttagtataaagttgtattggagtattagccgacacgtgttaggtctacaacatcggctatgctatgagcacgtataatctttatattaaagtacttttagacataagtgattcatgttgtctcagcacttggtccgatccatactagtcacttggtttaaatgtatctcgatctatagattatatattgctaatatctacagccgatcgactagatctaactttccttttgctttatttatcattgccgatataattcacgttatattggctaacctacaaatgatacgtcatcggcatgtggctgatcggctattgtggatttaactttgtatctgtgtttgtttcttgttggttgcaggatcaaaccaactggcacgccctgaacccgaaagagagattttaggtcctgcactgaagttaagcagatcttccaggccagtgtgtgtttttcgcatcaacacgcttttggcacgcccggtgggacacgagtgtgacaatctttcatcatggtggacgtcaagcctactgatgatgatggcaagaggactgaagttgattccacaaacaagattccgataaccatcgacatgctgacaccagagcaaaggggttaatatgatgcatggttgagcaagctacagaacacatactttgattcttttgctctgactcgacaaggaacagtgatccagaagcataaggtagaaatcccacccccttcaaacagtgaagcttctggttctggtacttctggacgcaacaaggaagaaggcaaagaaggacttaaacaagaagatgccaacctcgagttcaagaatttccaagacagtgttgactatgcggttaatcatgctctcatcaatcagtcaggaatcttagctaatgtgatgagcaatgtgatggagaagatgatggattgcaagtttgaagaaaggggagccagaggtccagcgttcttccctggtgacaagtttcctaattacaggaccttggttacagatgactgcctgtttctgggattacttcaggatagccgattgcatcaacatcggcttaacctaatccaataggggaaacttcggctctgctgaacccgttgggaccaaatcaacctcagattaacttgacggggacaaattcggctcaacctaacccgatggtgccagcatcggctcagccgaattcaactgtgatttcatcagctcacaaacaaccagagttcagacctcgtatcctgatgagaccacaacctcagcacgttggtcacaacattcctcaagttaatcaagagcaaatatcgtctatgttcgatgtcactcagccaattcagcagcagattcaacagcctgttcaacagccgatttagaacataccgatcaggccttagactccaattcagcaaactcagttgatcggtgctcagttcatgtctgattgtcacgcccagaaattcactagtaatttccgaactcatttgtgcataaaatcctcgtccaggaatcagccgaggtacacaaactgacaatttaatatacagattcatcaataactaaagcgaataaatacttacataagaggcacttagtcctcaccatgaagaaagctgcagcggaaaaataaaacctaacgagcttcagctccactcccacaggcagctcaactggggtataagccaaacgtcttcttcttctgaatcctttttcttcaactgaggtttgatgattattgcaaggtgagcatatgacatactcagcaagccacacagcaaatatgcaagtgcacaaggataccaaagaatggcataatatagggcttatttgcaaaagcagcatttagcaaacatttgagaattgtaaaacagtagagcaattaatcatcaatattaatcaacactatacaacatacccatgccgcacaggcccaaccatcctgaacaaccatacccgtctgtacagatctatctccaaaccaggaatgtaccattccaaaccaggagctaatcaaattattaccagttatatcatctttcattatggtgagaagtgtgagactaatcacgaaagacattgttagacccgcccataaccgcgggcacggctattcgaatagttttactctggccagaggtgtaccactgtacccacaagacacagccccacaacatgtcaccatgcgcctcgatatcaccacggtacctcggaaaggagctgtgacagtacccctcgcacaacacaatccaccacagtgcaccgttcctggatcataatcacccccttataaacaaggcatggactccccagcgacccccgtgggcttatctctgccacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccacctttatcaagttttagttgacatattaattaattaaccaatcacgattaaccatcgtgagcttccattaaatatccataagtgatagtgaagtatgatttatcccattagtgagctattttttctaagcatggctaagaatctattataagcatctagctgaaccaaaccaatatataagcttctagctaatcaaattctaacccataggtaaataaagtcatcttcggccataattaaatgggaaaggctcaccacccggtgacattcgaaaataaatgcacaattgaaataaatagagaatttaaatgtaggatcaacatgctcaaaggaattgtgtttgggatttgtgtgacttgccttgcaaacaagcatcttcaattcgtcttcaggaacttctccaacgaacgaacgatcctccaaaacaacggaaaactaaacctagaacgcaaaacaaagtaaaacactaataaaaaacaaatgaatagtacaattaaagttcataaataggtagagcttgaatttagatgaatcatgagacttgaacgacctcattctgagttcgtatgaattagatatgaattttacaagatttaattctaattaaacctattaaagaaaagactattccaaattgattaaacaatttacaaatgatttatagctgagacagaagattaaaacattttccggaaaaatattagatcatatttggtagatgacatatattaaaaaggaataatatgtcattgaaatgagatgacaaatttatattaattttggatggccaagatggcgctgatgccagcgatgacatggctgccacgcaggatcgacgaccgcaagcacgggaacggcagttaccagcgaaccacggtacaatgatgcaaacggagggcaccgggagagagaggagatcaaggcgacccttaccaccacttacgcaacgacagacgacgagggacatggcaggcgacgaactccaaaaggcggcgaccttgggttgacgatggcaacggctttccggcaacgagaggcagcaaccgaggggcggacggtcttcacctcgctcctgcgatcccgagggtggcgacggtgaacgaaggcggcgatggacggcgacgaacggcgcggctgaagatggaacagattggcttcacagtgacgacggtgctccgatggcttgcgtcttcgcggaggtggctgccgggcttgctgttgtcgctgcaatgccaacggaggagacggcggggttcggcgaccacggagtcgacggcaaagcttcgccgaagatcaaaccgaggcagcgaactcggccttcacggtgacagcggcttccggcgggatttggcgcaaaggaacgggtggccgaggtggatctcttcactgcgaagccgagggaagcgacggcgcagatcggggacgaccggggaggcagcacagcgcggctggagcggcggccggcaaaggagagagaagccgaacgtggggaggcggctagggctatggaaaaactcgggaaaaagagggaaacggaagaggaggtcttgggactgctatttatagccggaagagggagagatcggctcaggaacggatggaattggcgacggattagttagggttcgccggaaaataggaactcaaaaccacgtcgaatccacgcgatataccacgggattcaaggggatttcttggggataagatagaggagatcgaggggaatccgtttttgcaaccaattttggaaacggagcacgggatgcaccggatcgaacggagaaggcggcgctgcaacacacgtcacgggaggagcggccggctggaggaggaaggcgagtccgacaggtgggcccggctcggaagagagaaaggaggaggagggtgctaatgcagacttcggccaagggagaggcacgggctgcggaagggagaagggagagagaggagtgggccggattcagcccagactgaggaagaggatttaattaactttttaatttaaataattgctgaaatgatctttcagttattaaaaatacttccaatgctcaaataattctgggaaaaatccagaaaatacttgggcatacaaagtatttaataaaattttatctagctcaagtttaagttcaaatttttcatagattttattcacacactttctttagttattaaatgatttctaaaaattcctttttcacaacgatttataatttagcgattttcagggtgtgacactgatccaattcaacaaccccacatggtgcatcagactccaccaccttatgatgggggtaacatgtttcaaccatactcacctcaaggacagtatcggctagcaccttcaccacagccgtagtttgtgcctcaattcaatcagtatgatctagcacagcagcagttccagggtgcacctgagcagcaacagcagaagccctgggccgatatgatagcctatattatgagggagtagtttggtttcaagcctaaagattctggtaatttgtatcggaaaccatatcttgagtagtttgataggattccattaccacactgatacaaggtgctagatttttccaaattttctacttatgaacatatcagccgatttctagctcagctgggagaggcatcggctaatgatgcttttagatttaggatgttccctttgtctttgtctagatcggcctttacttggttctctaatcttccatacaattctatcagtaattgagccgatttggaaaagcaattccatagctacttttacagtggcgttcatgagatgaagctgacagatctgattccagtcaagtagaagcatgatgaatctattcaagactatattcagagattcagagatatgaggaacagatgctatagtttgtccttttcagattctcaattagccgatctggctttccagggtttattgcatccgatcagagaaaatttttcggctcaggacttcgaaagcttggctcatctggcccagaaagttggagtgcatgaacaacggttttaggaagctaagaagattgtcaaaaagatgaatagtgtttattcttacaattatgcttctgattccgattatgaagatgagtccgaagtagcagcagccgaatggatcagaaacaaaaaggttactacatgtctgtgggtgaagccatcttccaaggaggagaaatatgattttgatatcaccaaggcagataaaatctttgatatgctacttcgggagaaacaaattcaattgcctgcaaatcatgttattccatcggctgaggaactaggcaaaaggaaatactgcaaatggcataatactggatctcatactactaatgagtgcaagctgttctgacaacagatctagttggctatacaagatggtaagatcaagtttgataactccaagaggctgatgaaaattgagcgtaatccttttcaagtaaacatggttcatacaactgggaagacagccgataagaaggattatcggtccaagcaactcaattctgcaaggattatcaacaaatatcagaagagacatgatcggcatgaagagaaattttatgaagatgatgatagctttgacccccactggagttgtgaattcttcaggttttgctggaatgaggggatgaggctaccatctatcgaagattgccctagttgtagtaatcataaaagggggcatgttgcaagctcaagccgatcacgtcccagggagaatcggctacctcagaagaaacttcctgttcaccagatattgggccctattcatgaagactactttcaggatgaatcggctcaggaacgggagcaagttgagaacaagcaatggtgtccttcaggccctttcaccaagaaccagaagaggagagttcagagtgaggaatagggagcagtttgaggaggtgagcaagaaatcaaccatcagctgaataagaggagacgtgttagccgatgaagcaaagaggttagctaaaggaaaatctgttgtttcttcgtcggttaacatggcttttgtgttgcctgccaagttcggtgttgatcatgccgatatggaggaagaagatgtggtagaggaatcctcggctaagttggttctgtcacctgagcaagctatctttgagaagccagatggagcagaaaatcggcacctcaggccattgtacgtcaaaggatttgtcaatggtaagccgatttccaagatgttggttgatggtggagctgcggttaatttgatgccatat

SEQ ID NO: 21314 - DNA, 1985 bp, Oryza sativa
tgaaagaatatagagattgctttgcttgggaatatttcgagatgccaggacttagccgattgattgttcaacatcggctaccaatcaaaccaggatatcggctgtataaacaacctcctagaagatgtaaggccgatatgtttgaggctattaaggccgaaattaaacgtttgtatgatgctggttttattcagccatgccgatatgctgagtgggtttctaatatagtgtcacgtcccaaaacgactctaaaatacatcctctaaattatgcctagaataattaaaatccgtgtgaaagcctccaaaaaaattaaaatgtgcaaagttaaaagtcaaataaggcttggaggatttttgtatatttcctaaaagcctaaaatgcgtaaataaattttagtggaattttcagagcacaaataataattattaagaataaacaaagttaaaatggttttataaaaagaaaaaccctaaaggtcccctttccctccctccccctcttgggccggctcggcccatctccctccccctctctctcctctccccgcggcccactcggcctctccccgcgcgcgcgccgctgacgggcgggcccgcccgccaccctcgctgatgggtggggcccacccgtcatccccttcctcccgccgcttccgccgcctcgcccgcgccctagcgccgccgccgccgccgaatccggcgcatgccatcgtccccgcgtgcaatcaatagggggaattattccccgtgattccctctccctttccacccatttttcctctctctctcgtgttcaaacggacggacttgcccccgcaaatctcgccggcgccattgatggcggccgacctcccgcgccggtttccttccttccccggccgccctctcttgccccggctctatttataccctccccgcacctcctccgtccgtttccgcctctcgccgcccttcctcctcgccggaatcgagctcgcgccgtcgctctctctctccgccgtcaccgccgagctccggtccgccgccgtcgtcgccccgaaccacctcccacctcggcgccgcctccttcggcttcgccgcatcctcgccgacctcatctacccctccgttcgctcgccgaccaccggaacgccgtcgaccccgtcgacccgagctgcgccgccgccttcctccgctccggccgcctttttcgtcgtcgccgtcgacctagggtgagctgtggaccaccgcctcttttcccccttcccttcccctctctcggccgccgctccgccgtgcctatggccgccgccggcgaccatagaggcgcgggcgccgcctcctgccggctgcgccggcttggccgccctcgggcgcgccgagtggctgccgcgtggggcccggccgtcagccgcccgcgccctcgggtgcggctgacgcgtgggacccacggcgccggccggtgtgagcccgggtgcacccggtccaccgtggaccgtgaggctgccgcgtgggccccactcccgtggacccggtccgcgcgtcccctcccctcggctgacgcaataaacccttttaaaattaaaatttaaatgaagaaattcgcaaatattcatttaaagaggatataacttcaaatgaccatagcttggccatttgaactcggaattggaccgttcaagtctctaatttttccttaagaagtcaagaacccatttttgtgctttgttcctgcttgttatatggagtttatcagagtaaaagccttttcttttccgttggtcatgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattg

SEQ ID NO: 21315 - DNA, 11807 bp, Oryza sativa
caatgtacccaagttagtgttttaaattcttaaaacctgcttaacaactaaaatgtggaatggttagcttgggttggcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattataacccccttgtactcccttgtatttatcctgcacttgtgggtgtgtcttgttgagtacggtggttgtactcagttttgctcaatttttcccaaacccagaagtggagttcctggaagatgaaggctttggtgtctagctcgtggatgccgtcaagcgcctgtgatcgtcgccctagtcttccgctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacatccaatgacttgattttctaggtattgttcttctttttatacttataactgcatcagttaattttgatcttataagtcgtgattaaaatatcaatctctagcctgtttattggttgccgattagggttccatcggggtttcaaccgatcttacctgatttgattattttgtttactttatgtttacttaatatgctaaatctgccctttatgttaagatctcactgtaactaaatatattaaacttgttattaatacgttaatctaccttaacacttgattaatccttatttaatatatttggtctatattgatatcttaatataaagtagtatcagggtattagccgatacatgttatatctacaacatcggctatgctatgaacatatataatctttatattgaagtacttttatacataagtgatttatactgtctcggcaagctgtccgatctatcccaatcacttagtttaaacatatttcgatgtatagattatatattgttaatatctacagccgatcgactagatctaactttctttatgttttatataccattgccgatctaattcacgttatatcggctagtctacaaacgatacgtcatcggcaagtggtcgatcggctatcgtttatgcatttaactatgtttccttgtttgtttcttgttagttgcaggatcaaaccaactggcacgccctttgacccaaaagcaagattcggacctacactagactcaagcaaatctcttaggccagtgtgtgtttttcgcatcaacatggagccaccgtcctcctctaccgtgcctttctccctcccctatctgtgtcacaagaaagaagaagagaagaagaagaaatagaggaggaagaaggagcatctgatagtgggtcccacataaacagtatcttttatttgattttatttcaatttcaaactttagacacccatatctcttcaaccacaaacccaatcccagaaattctttgatctaaattcatctaattccaaactctttattttgataccaaattacctattttaaacattttatttaaatttctttatttatttaaataccttttatttatttacattctgaatttaaaattgttttaaataaccttgttaaattattatattttattcaaatacctttttaatttattttatttatcttaaatacctttaaatttaaatctcttgttttatttaaaaaccccttttaaattaaattttcctataatttatttaaatacattttcgtcatttaaatatctttatgatttaaaataccatttcaaaattctttattaccctttttgaatattcaaatttctttaattaaaaacctttttgaattcaaattcctttgatttatttaaataccctttttatttctaaaccatacctataccatcccatagccactaaacagccgccgtgagaactttacgctttccatggagacattcacgtggtctcaaaccccgatgtcaaaccgttggtcgtaaaacccggcataagctaatcccaaggtcaaagtattgctcctcgcaccccacgccttaacgcgtacagtggttggagcctcactactccatcaacctccatagcacgccgcacactagctttcgggctctgtgcgaacctagcagctttgctacaactcacagctgtaaagtaacactattccgccccacaaaccggcacaaacttcccaactctctagccgttgtgttgtttgactgtagcatcaactagacgagccaatatttagccgtgatgctccccaaccttagcatcggctaaccaactccaaatatctagccgttgtgctgccctactctagcaccgactagaaaccaaatccaccaaataaaccccacctatccaaattaccttttcttcaattttatttgattcccaacctatagaaaccatcacctctcttttgttttcaaattaaaatatattttgaaccattcctttttccttcgccttgctccaattttatttatttctcggtttatcgtttctttgtagcatttttcttataggctttatttgctatctttttggtattcatacgttagactgtacagcaagatctatcgacatccaaggagctgacgtggactcagatagctacgttgaagccgcaggaaacctcggggcacaaggcaagacataactaaaattttgatcatatagaaaactaattataatcttcatatttaatttgatgcataataccttactcttttaacatctcatgggtagatgttaaacgatttcaagcattattgcatgaggttatagaaagatgcattggttatcattttatgtggtttactatttcaaacatctttaaaaacataagaatccggttataatgggcatttatgagttgaggtcgtgaatgttgaggattgtgaatgttgaatgtttatgaatgatgaagtttgttggtatggaagtttggatgttgagataattttggtggtttaaccggattataattacccccttataccatggaaattacatagtttgtgtccatccacacgatcaagtaattggacttagcctagtatattgtcccactatatgaaagactgttggttggctcactaggagcaggttttggggtgaacgtgcgtaaggagtttgggctgcatgcttcacaacagtgggtcccatgaaagtatgatgataaagtaaccttgcttaggcctagcaagagttcaactactatgatgggccaaaaccccactgtgcactaactagtagtaagtgggaccttcgaacggctctgttattctcagcctctagctagctgtgggcatcgtgtgggtaaagctagatagtatctacagaggtgaaattaaatcattcgaatgcgctgtactcccgattttggagttgtgtcataagggtgattcatactcctgaagtataagtagttttaaaactaaaattttgagcacaaaaatgatatatgattttattactactcttttactttctcattgttttatttattcatatctctctacatttaattatttataatatgccttgttgagtacataagtactcattcttgcataatttaacatatagaggaattgtgctacaagaagatcagaagatagtgaggtctaaagcaacaacgagtttttctaggcttgtctacactcgagcttttgcctatggagtttattagttgtaaattagtagtttaggaggttagtagttgggtagtttggattcttccttgtattttcaaataaggatgtgttagtttggaacttttaaacctttaacagttgtataattagcttgtatgatcaaatttgtataattaatcaaaagttgttatgtatattaatctgtgcgtaatcgaaatcctggacgatcacgagtggattttcggggcaccaggcctaatttaggtgtccccacatatatgcatacaaaaaaagtcaatttccattttagataaaaatcaagcttcattttagttttccattgaagttgaaaatgaaaaataaacagagtacaataatgcacatggaatccatgttggcaagaaatgaatcattgcaacggagaagaaaccaagcctcatttttatttccatacaaaataacattttgggaaaaatcagaaattaactgcgtagaaccatagctatatctttacattagatgaataatatattcagattgttcctaatgaaaatacatcaatatatattgtggtaaaatctagtaggttcactaaattaattaacttatgatcttgtaacatgtgtcactaatatttaacataaaaatagaacaagtaccatgcagtttgtctattgctcccattatggcaatttgaaaaggatgcttctcttcttccaccagttcattgtgccctttggagtagattgttttaatcaatttattctcaaatgatttgaaaaaagaagaagcatatagcagtaccaagctagcaccaacatgaccttgcatgacacgcttccgatgttcatggaagtttaggcaaatatatcaatcctctgtagccccgattgctgcagtacagcacccgcacgatctccagctacacatccatctgcgcacccttacgttggtatactccaccagctcagatcgccggcattgcacctgatcagaagccaagcctccataactgcaggaatcaagcagcaataaaatccggcttaaaacacaagaatccaaaatttgaagccccatcactgcataggaacagtgatcgatactctgcaaacagagctactctcgttctccaaaccgggcgaaatgcttcaggcacctaacaatttggccaagttaagcaccgcgaagacttgggtgacccgagttggagacttggagtcaacaaagcaaaattatcttttctttagcaaaaagaggataagaaaagaatataaacatgataccggtttccttaataaatctggaaattacctttggaatatccctgaagagtgagggaacgagcggtagcactaacctgctagaaaaatccatgtagctattgccggagattatggagggaatcgcctgtattcctccgccccgcccacccattcttctccggcgacggcggcgggggtcgcactcgcagcggtttccccacccgtccagactatggtgggcccaaacctaattttatcttggaataagttcactttgtgaccctgaaaaagtgatcgaaatctaatccgtgaccctaaaccacgaaaccggatatctcgacccccaactctcaaaaccggttttggagggcggtttcactgacgtgcgcctacgtggcagtattgactcggtctcctttccacgtggcgttgacgtggcgcttaggtggtattagaaataaaaaatactagaggatgccccgcacgttgctgcaggacttggttaacatcaatttgttagataggaggtacaatctcaagaagaaacggacaaaataaatgactttcttggagaaattctttttagcagccctatccaaattttgtagataatttagatagcacattcaaagcgtaagctataaagaagcaaaatggtctaacataagttaacaaattgtaatgtcaactaaaggggtgttcggccataaagctctttttatacggattgacgggccggatacatgtagatgtgaatgaagatgagccaatgtgttcatgtgggctacattttggcactgaggaggtgaagagactcacccggtacctgatgggttgggctctatgccgcgttccatccaacggctaagaagcgatctaatgcattcatccaatgattcacaactgatgatgatgtggaagcatgaggtttgaacttttggcattaactttatagaaagaagggatgtgtgggacctatttgtcattcaccaaaaaatatgtgtgggacctactgacatacgaggccgacgtaaatcatcctcctcatcctccccctctctttctcttccgttcgctgtccgtgcgctggcaggcgggccccgctcgctaggagcttcttctacctctgtccgtcgtctgttcatctctcccgtgaaactcaagcactgccgccttcgttgatctccctgccctatcgtttctcctccaaattaattgcaaaaatcggttccttgtgtagtgggcatcaatttccccaacaaatcccacttaatcccgcactaaatcgccctcaatcgtcaagcactgccgcacgtagggacgacgccgcggaggcggccgggagggagcagcggggcacgcgtcgatgtggcggccgaggaggagaaggacgctggccaccgcgccgcggcgggatccggcggggagggcgtttcttggccatggtcgtcgatgccggcggcggagcagaaggataatgagacggcatcagtagcgacgacgatggagctagagggacatggtcgtggtcacaagcggcggcgactcagcggccaagctacgacgcagctggtcgaagaagttgataagcagcaggaggaggaggcgccggcgccgacctgcagcatttgtctgcaaccctggacctgcaacggcgaccatcgcatctggtactatacgttcctgcatgcatgacacgtctcaattgatgagctactcgatcgattgttaattagtactaatttgataactaatcaattatatatatagtactatagtagtcctccttaatttatatatgttaattgcatgcatttcctctttcagttgcattccctgtggacatgtttacggcagatcgtgcctggagaagtggctgctacatgctgttcttcaacgcggcactggacaagcaaaggtaattactactccactaattaattagttgtgcgttgcttgattaatcagctagtgactatactgagcagtgtcctcaatgcggtgaaagttcgagccacagcgcattttttagcgaacgcgcaaaagaattgctcgtcaatatattagcatgaaaagagtttttgttacacaaagcaatcagccagactggcttatgcctaaagagggggaacaaagtaaaaagaaaacttgaagcgagaaactactacgacggttaaaaacacaactccaaacagcgggagggggtagaggcacgctacactccaagaaatccccaaaaaaagcaatgtcggctaaagaccacagctggccctccgagtggatggactccaaaacgactgcaaccgaagcgagcgcagagtcgaaaaccctggagtttcgttccttgcacagctgccaggagactaggagtaccaaggagtcgaagccgctgcggaggtgctcaggtaaacaggccctggaggatgaccaccaatcctggagccagctgccacgagggggagagagggcagcccagccaggaggggacatcacacggagccagacctgccgagcgaacacgcaatcgatgaggatgtggttcgccgtctcaaactcctgagtgcaaaaggggcaagcagagtggctatcgataccacgcttttggagaagatcggcagtccagcagcgctgctgaaatgcaaaccaaaggaagaacttgcatttagcagagcccttcgcgtgccagagtaggtcggcacaggcaaaagagtgctggccaaggaagaacgcccgatacgccgatcacaccgagtagcactggtcacccgtccaactccagacgaggtgatcctcaacacccggcgagagctgggtaggaagcaccgcgtcccagactaacaggaactgagagatgaccgggacagtgagggcgccacgtatgtcaccaacccaggagtagttcgctaacccagtagcaaccgtgcgcgatccccggaagcgtggaggcacggcgtggaggaggtcaggagctatagaagctatcgagcgaccatcgatccaccggtcaatccagaagagcttggattgaccatctcccaggatagagaaggtgtatgctacaaacatgtcggagacgctccgcttaataggggccttcagatcagaccagtagggatgccccgagcgctgaagccagagctagcgaacactcaaggcaaagccagccatcctgagatccggaatgcccggtccaccgagatccctaggacggcaaaccctcatccaggacacccggcactgtcccccattggccgagtccgtacccgtccacaagaaggcgcgacacttcttgtcaatggctttgataacccagcttggcaagccgatcgccacagaaacatagaccggaatggaagagagaaccaactggactagaaccgagtgacccgccagagtggtgagacggcccttccaggggggagccgatgggagactttatccacaagcggtttcagggccgcttttggcagcttgcgaactgacagtggaatgccgaggtaggtgtagggaaactccgagatcgagcaaggaaaagaggattgaactagctccaggtcaagaaccgagcagcggatcagcggatcggagtaatcgagcacttggtgaagttggtccgaagcccggaagcggcaccgaagacagagaggatgccttggatgaactcaaggtcctgccgaacgggggaaaggaagagaactagatcatcggcgtagagggatgcacgatgtcgaatagcacgataattgaggggaagaaaaccacccgagtcagaggctttgcggagcaatgcattgagcacatccatgactagaatgaaaagcatgggggaaagaggatctccttgacgaagacctctccgatgggggaaccgtggacctggcaccccattaaccagcactcgggaagaggaggcactgagaatgagggagatccaatcacgccaacgttgactgaagccaagctgggctagcacctcaagcaagaaaggccagctgaccgtgtcaaaggccttcgcaatatccaccttgagaagaagtcggggaacgcgtttggcgtggagcgcccttgccacaagctggacaaagcggaagttgtcatgaagagagcggcccttgatgaaagcgctctggttaggcgccacaagctcgtccaggcgaggggagagacaagaggctaagatcttggagaacagcttcccaaagctgtggataaggctaatcggcctgaaatccttaacgtcaacagcctcgtccttcttcggcaagagggagatcagggcgtcgttgagggaagtgaaaccttggccgttggtcaggaacaaggagttaagggccaccagaattttgaccttgatcaccgggcagcaagtcttgtagaaacagcctgtaaaactgtcaggaccgggcgccttattagagggcaaggacttaatcaccgcccagacctcatcctctgtgaagggacagtccagcccctcaagctgcacagggcagaggccaagagagtggaggtctagggcgagttcacgctcgacgctcgtccccaaggtggcgcaaaagtgagaggaggcaagctcttgcagcgcatcatgggagatggcaagctggtcaccatcacgaaggtgcgtgatgaagttcttccgcctacgagctctggcgtgcaggtgaaagaacttggtattagtgtcaccctccttaagctagaccaaacgcgaacgctgacgcgtgatggtacgctcaagtgaggcaagaccaagacacttcaactttaaatctcgccgcagccaggtctccaagggggaaagagaccgactctcctgcgcaacatgaggccggaagacaagttccttcgccatctgaagctgtagacgaacactgccaatgtgacggtcactccagctctgtaagcgcttagccgtggtagagaagcaccaggcaagagcagcaagagggggtaggttggcagggggatgccaggcgtcctgcacgacttgaagaaaagccgtcgaacttgggccaaaaggccttaaaacgaaaacgatgcgcttttggggaggtgacgcaggtatgaaggagaagagcacagtgaactgaggcgacagaagaggccgcttggaggaggcaagaggggaaaagctcctcccaatccgcagagaagaggacgcggtcgagcttaacaagcgtgggcgactcgcgctcattgctccaagtgaagcaacgtccgtgaagcggcagctcctggagttccaactcgtcgatgagccgacgaaaacgacccatcatatgacgattgagattaaggttgtttttatcccgagcttcgagaatgaggttgaaatcgcctacgatggcccacggccccgtgcgagaggagcgtagtgaacgaagctcatctaagaaacgaagcttgtcaggctcctcctgtgtcccatagatgatggagagccaccagggggcaacatcagaaaggtgccgaaccaacgcggtaagagagaaatccgcaaggtgaacatctgagatagaccagacggtcgtccgccaggcaagcaacacccccccactccggctgaccgcaggcaagaaagaataatcaaactcgaggcctagcgcattaccaacctctacgcgccaggaatcaatatatgggacggttgctgcaaaaaccatgcgaatgttagttagttaattaattagtactttattatacattgtcatgcatgcatgatcaattaaattcttgtgcacaggaggtaggagagtattacaaccgtgcgtacgaggggctgaaaacacaaatggagtcgacgatcgccgaagaaggcgcttcggaattcatctcatcctttataatataatggtactttttcttctttgttcagcaataacttaatcttggaataaaacactcgtgaaggatctggaagaattggatgggcttgtgaaatcggtcggcaggcagtttgagagccttgaatcatctgtcaagacattcctgctatcaatgacggagcggatgaagaagatggtttcacagcggcctgccatggatctcgttcaatatatcgagaaggatgcccatgaaatcgtatccgcgctctcccagaaacctccataatcatcatcatccaatcgatcctgcgtgctagctcatatgtgctagcttcttgtggtggggttcgtttaatttgtagagagcggtgatataagaaaattacttcttgcaactgaattctcgtttggctctagaattggctaatagctatatatagcctgggtgattttcggctacgacctcgatgctggcacggtcaccttcgccaccgcagactgtgcggggagcagccggctggcggagcagacaagcggcgagcaggcgcgctgcgggagaggaagatggcactgacagggagcgggatggggagagcgaggacgccgccgccatcgtcgtccacggccgcagatctcgcgcccgcgccgtcagcggcgtcggcggtgggaatgtgtgagcgcggggcagcggcgagccgagcaggcggtggcgggcggagcgggcacgacgccgaagacaacttcttcccgcgccggcgccgccgggcgcctctcccatctcaagcgtcgcagccgtcgccgccttccttcttccgtgtcgccgccgccgcctcccgggcctgtcaaatggtccgaccccgaggtcgcatgcgccgccgccgt

SEQ ID NO: 21316 - DNA, 3469 bp, Oryza sativa
ccacgtcagataaaaccgggagcagaaccaccggaggatctaaactaacgattttattagttgagggacacccggtatctggttttgcggttaggggaccattttgtaactcgatgacaagttgagggaccttcggtgtactttttccattagatttcgattagttttgaggttcaaagtgaacttattccttttatctttcgggccaaatattcatgggcctttatggatccaaattcttttgggctattcctactcagtattctacttatttgatgggccaaaaggccgcaaattcgccgccgtgaagctctggatgctgtttctctctctccttcctcggcgcacccggccgccggccatccaccgccgtcgcatccaccggccgccgccacgcctcctcctcgccaccacttcctcctcctgccgcgtaaccactaccgcctccacgcaacaatgccctccatctactctcgccctcctcgccgaccacccgcacccggccgtcgcggagttcccgcgcgccggcttctcccgcctcggcgaccaccccctcctcgcccgcgccatccacggcctcgccgtccgcctcgcactcccgctcagcgccttccaccgcaacaccctcctcgccttctacttccgccaacgggatgcctccgccgccgccgccgcgctccacctgttcgacgaaatggccgaccggaccccatccacctggtacaccgccgtctccggctgcgtccgctgcggacgcgacgggacggccttcgagatgctccgcggtatgcgggagcgtggcgtcccgctcagcgggttcgcgctcgccagcctcgtcaccgcgtgcgagcgccggggccgggacgagggcatcgcgtgcggcgccgccatccacgcgctcacccacagggccgggctcatgggcaacgtctacatcggcacggcgctcctgcacttgtatggctcccgtgggatcgtgtccgatgcgcagaggttgttctgggagatgcccgagaggaatgtcgtgtcgtggacagcactgatggtggcattgtcatccaatggttacctggaagaggcattgagagcttaccgtcagatgaggagggatggggtcccatgcaatgcaaatgcgttcgcgacagtggtcagcttgtgtggatcgctcgagaatgaggtgcctgggcttcaggttgcttcccaggtcattgtctctggactccaaaaccaggtctctgtggcgaattcgttgattaccatgtttggcaacttgggaagggtgcatgatgctgagaagctctttgatcgaatggaggaacatgatactatttcatggaacgcgatgatatcgatgtactcacatcaaggaatctgcagcaaatgttttctggtgttttcagatatgcgtcatcatggattaaggcctgatgcaacaaccctgtgcagcttgatgtctgtctgtgcctcctcagatcatttcagccatggaagtggaattcattccctgtgtctcaggagcagtctggattcatcagtaacagtaattaatgctctggttaatatgtactctgctgctggaaaattgagtgatgctgagtttctgttctggaacatgagtagaagggacctaatatcatggaacactatgatttcatcctatgtgcagaactgtaatagcaccgacgcgttgaagacactaggtcagttatttcatacaaatgaaagcccaaatcacctgacattttccagtgctctaggagcatgttcaagtccaggagccttgatagatggcaaaatggttcatgccatcgtattgcagttgagtcttcagagaaatctactggttggtaattctctcatcacgatgtatgggaaatgcaattctatggaagatgctgagaaagtttttcagtccatgccgactcatgatattgtcagctacaatgtacttattggtggctacgcagtacttgaggatggtacaaaggcaatgcaagtattttcttggatgagaagtgcagggataaagccaaattacattacaatgataaatatccatggttctttcgcatcttcaaatgatctgcataattatggaaggcccttacatgcatacataatacgcactggatttttgtcagatgagtatgttgctaactctctaatcacaatgtatgcaaaatgtggcaatttagagtcaagcactaatatattcaatagtatcaccaacaaaaacattgtttcatggaatgccataatagcagcgaatgtccaacttggccatggagaggaagctctaaagctcttcattgatatgcagcatgctggaaacaaacttgatcgtgtttgcctagctgaatgtctgtcatcctgtgcaagcctcgcatcattagaagaaggcatgcagctacatggtcttggtatgaaatctgggctggattcagactcatacgttgttaatgctgcaatggatatgtatgggaaatgtggaaagatggatgaaatgttgcaagtggttcctgaccaagccattcgacctcaacaatgctggaatacgctgatatctggttatgcaaaatatgggtatttcaaggaagctgaggaaacatttaagcaaatggttgcaacgggtagaaagccagactatgtaacgtttgttgctctactctcagcttgtagtcatgctggtctagtagacaagggtatagattactataactctatggcttcttcctttggtgtttcccctggaataaaacattgtgtatgcatagtggatcttctcggacgcttaggtcggtttgcagaggcagagaaatttattgaagaaatgccagtcttaccaaatgatctgatatggcggagtttgttgtcctctagtagaacccacaaaaatcttgaaattgggaggaaaaccgccaaaaagcttcttgaattggatccattcgatgattcagcttatgttcttctgtcaaacttatatgctacaaatgcaagatgggcggatgttgacaaattacgaagtcacatgaaaaccatcaatataaacaaaagaccagcttgcagttggcttaagcttaagaatgaagtaagcacctttggtattggtgaccggggtcataagcatgcagagaagatctacgcaaagttagatgaaatgttgctgaaactcagggaagtaggttatattgctgacacatcatctgcactgcatgatacagatgaagagcagaaggagcagaacctttggaaccatagtgagaaacttgcgttggcatatggccttatcgttgtcccagaaggatctacagtaagaatattcaagaatctcagagtctgttcagactgtcatctggtatttaagctggttagcatggtttttaatagggaaattgtgttgagagacccatataggtttcaccacttcaaagtaggatcatgttcttgttcagatttttggtgagatagt

SEQ ID NO: 21317 - DNA, 3205 bp, Oryza sativa
acgtaactaccactttgttcatagatcatggtccatgattatagattcatggcccatgatgatagattgctttgcagcgtatgggctaatggagatgtgatggctggtgctgaaatgctcacctcaactactgaactttgaatgcacagcactactactacaagtcaagtagactcctgttcgttgtactacgtggtcaccggaattagcaggggcaggcagagtccaccatgatcaggaagctcaagcatcgtaggctgatgaactctgagccgacatgaacgcaaccaagcaaagcagatcagtgtgcattgcaggtcgacgatcgacgtcgaatgcatgggtcgatggccgctgttttcattggggtcgttgtttgcttgagatagagtgtgatacatttacttcctttccctctgagataggcgtcaatctatgcatgaatgtcatgacagtgagaggttcttgattaattagttttatgctagaaaatgattgtgcaacgatccttatgaagttatgatccattaatcgcttccaccgtctttttgttaggcaccatagataattgcctgacaatgattagtagtgtcacacgttgtgcttagctttgaacattaataaatttgattaataactgacaaatagcgtttgtagtccaacggttagcataattgccttccaagcaatagacccgggttcgactcccggcaaacgcaattatttgcatggttcttcctttttcacttgcctgaaaccttttctgattccttttaaagttcatcctgtccattttaaatacttgaataaaatacataatggtcttttcatgtctttaatttagacactttttcacttgcctgaagccttttcagcttttctgattccttttaatgttcatcctggctatttaaaatacttgaataaaatacataatggtcttttcatgtctttaatttagaccgtatagaagatcatgaaagccttttctgattcctttttaagttcatgatggccattttaaatacttgaataaaatacataatggcattttcatgtcttcaatttagacagtacagaagattatgatcctttcaaaattaagagcgacagtttattatgttttgtgctggtttacatattctagtataaatgttttattaaatgagatagtggcatgtggattgcattgttgcttctctattatgtcatcttcatggaatggacccatgatagattgcatatttcttccaacagacaggagtaatgttcaaacttccaaaaattttatctttcagctaggatatgccagtcttcataatgaacaataaatagttgataaatggtactcctagatcactttccattatatgtttacccaaaatttgtggtactacaagtccaagatgctccattttctccttttgggattttcttcagagagacagcaagtctatgattcccatattcactttcatttaataggatgtcagagtatgtacaataattaatagcaggttctttgagtaggtaacaaggtaagtttgctgatatacttactctgtcccacattaagtttatttttagagtaatcaatgcatcggaatttgtaaatgtagaaaataattgtatttagaggtggataaaatgatgaatggttacattaggatttgataaagtaggtgtattctagtccttttcttttgtattgatatgtgtgtaatggataaaaaaataaacttattttagaacataggtagtagaaaaaagaggaggaaggagagagagagaaacatactaagagtaggtacaatagcggactataagccaaaactataaacatatttcgaggagataaatgaggagagaggtgagcagcagactacagatttatagccagctgtagcactaacttcaagatggcaatgtttgtatgacaggtgggaccaggtattaataatatagtatatatattcataggtaactattgtatgaattaactattaaattgactatagatgatttggagctagtagctggctatactattaaacttgctctaagcttaacaatgacttaacatcaattcttagcatttataaaaagaaactttgcttggggaagagaaaagaaagataataaaaacttatcttagttcactaattattatagcctttgttatctcaatggttataaaatcatagtctacaaataaactaaaagactatatcagactctatctttgaatatgccctaagaaaatatacatagattttttttaaaacaagcaaattgcaacaatggtcgagcatacctaacaaattaaatgcactaattaattcacacacgtagtagtactttctctacaagctccttgatggtgccagcttcttgttgtttctatacaatcattaatttgattaaaacacacagaagaaatcaacctgatgaacacaccagccaaactgaagcaagaatgaaatacagtataaacacacaccaaattaaactacccagcaacataaaaaaataattaaaaagataaaagaacaaccgaaatctatctagaacttttttgagaacttttttggctaatctaattcataattattgcatcttcttcttccccggagcagagtggttgtcttgggtggtgttgacgacgccatcgttgccggcgagcatgaggtacttgtccttcctggtgagcatggtgcagcggtagccgagcgcgtcgcccatcctcctctgcacgaggttggccacgtcggtggacggcgccctccgctccctcgccggcgacgtgtccaccctctccaggaactgcacggcgtagcacgtcctcgggttggcgatgtagtagagcgggtccaggcacttgagcccgccggccgtcgtcgcgtagaacatcgccgtgtcgacggcgatcccgacggggaccacgtcgtcgctcagctccgcgaacagcgggctgaaccggagcaggcacggctcccggcacgtcgtcccctcggggcagacgacgacgaggtcgccgccgtcgaggagccgcgccatggcgcgcccgtcgctgtcgcggtcccgcgtcagccgcaccgtccgcccgatcggcgagatcagctccgacagccggctcaggctgtacgacacggcgcgcacggggcggtccagcgccaccgacacgtacaccgggtcgatcagcgtc

SEQ ID NO: 21318 - DNA, 2513 bp, Oryza sativa
cgtgtcaccaggtacacctcctgtgttgtgtgagtgagtaattaataattaacttgtcaaattaaatacagattttttgcgaatacgtaaaaggattgtacgtcaatatattagtaagaaatagaggttttgatacacaacgcaatcggctagacatacgtatgctggaagagagtaaaaaaaaaatcactgcaacaaccaattgcgaaaagaaaaggactactgcgaaaaaaaaaactactccaacaaacaagagggagggggtggcaccacactatgctgctagcaaatctcaaaagtggttggggaaataaaatgaaatggaatggaatggaatgcatacagtaattcacatgagggaaattaatttgaaaatagtggtattggttgtatctcaaattgttctcaaatttaattaacgtggggaatggaactgttgtgtgattaaatggtcaatttaattacagatttgacaagatggaatgcatacagcaatgcacatgaggggaattaattttgaaaatagtagtattagttgtatcaaattgttctgatcaaatttaattaacgtgggaacacgaaactgttgtataattaaatggtcgaattaattacagatttgacaagatgaaatgcatacacagtaattcagatctcaaattttataacgtgggaacgaaactgttgcatgtgtgattaaatggtcagattaattagagatttgacgaaatgttgtgtatgcactatacagtactacttcacatgaggaaaattctctatttctatcaaaatattctctatttttttggaggactatcaaaatattcttaaatttaattgacacgggaaagtgctggggagtttgggaaaaggggtaaaacctgtgacttgatggtaaaggtcacattctttctgggaaaattaatgagtggccgtctaacagtaacagatattatgcttttgttggtctcacatgatgagatacaaaaagaatacataaaaagaggaaaaaaagtatgtatatatgatcaatgattgcacgatcagcatgagaccggccgttgaaaagacgtcgtgcacgtaattaactattacatctaattttactttcaggtgtaaatatgcagatattatatacgttgtttcaatccaatcacgcgtattacatgcatgtctaatacctgaactagctaaatcacacaaaccaaaaaggggagtttatacatgtaaaactagctaccttagctaggtgatctaaactcacatgcaagttaagtcaaatatatatatatatatatatatatatatatatatatatataacaaagtataagaattaacacaaacatgcaaattttacatgttgaattaattacttatgacatattataccttgcaacaatgtgagagatgatgttggaggaactccaaggaggtagagaagcccacaacatcaaccaacattttcttctcctcaagcaacacctcctcttgatcaccaccttcttcctcctccatgatgccagtgaagaacccccaaatcaccttcatctccctacctgaaacaacctcaacctccaagtactccttcaagaacccttcaaccatgatcctaggcatctttgtcacacacaccctcctcatggcactcctcatcacatcaaacccttcctccccaacatcctcaaggaaccacttgggaagcacggctcgcccggcccgaaaccggcttgcccgtaaaccgcagaaggacaccattgccatgaccttcaaggccatgtcacttcccatgacacatagcaatgggtagaggaggaggagcacaaggcccctcaagaaccctcctgcctctagtgccacaagcatgaagtaggggaacaaggaggatgatctaagcaaaccgccttcgacgtcgagtactagggttttcgcggcgagcttctccatgggagggaagcttgaggaggacttgtgcagcaaggaagggtgtggcaatgtggtgttggtgttggatgatgatctagagataggcttcccatgaaggagtagggataccaaggcagagaacagcctatgtgacagcttcttcttgggcatggtgtactgttgttggtggcaagctaggtatagtatggtagaggaagaaatggattgaattgtggagaggtagatcaatggtcccttcttttataggacaagacaacacttggatttcctgcctgatcatgcatgaaagagctagatagatagataggtgaaagttccatacttattactagtacttaattttcagggaccatatgcatggcatgcatgcctacatggctgtccttctcctttagtaacaaactctgaaataaataatgcacagtttactttcttattcaggatagcatgttagatatttggtcatagatcgcacactagatgtcttgatctcattgagaaccgtccagcatgagctagtagccatagtacatgtatattcatggcagggaagaaagggactgtaga

SEQ ID NO: 21319 - DNA, 1329 bp, Oryza sativa
aattcctgcagccctgcgtgcatgctcacataggtatttgctcagacttttaaaaaacacacacacatatacaatatctactcagggtgcggtataattaaaacacatctaatgttagtaatcattttattgagagtggaatcatcataaatcttcatattaaatctaacagttttactatcaaatatttaagaacatataacgtgtagtaaaacatttcttttcttttggactaagcatttcataaattattagaatactggaaatttaaaagttaggccaatgttatccaatatactataaacaacttcaagggtcgtttatatttttttcattgcaatggaaaacctatatgcacatatacatgtgcgtaattttacacacttcttggagcatttacttttaaatcaacaataatatagatataatgtttaaccccctaactatattttggttgtcattttttttggcctgtcagccttgagtaaacaggcacgtaatatgttagaatcaaatgagctagacccaatttaatcctaataaattttatagacctacaattaatgttaacaagattaataccatcttgaaaaccaacgagaaagaacctcaacttaaatatgctgctatatgagagcacttgttgagcgattgaggtggtggtgagacttccacacacgcgctgggctagtccatgagcgagggtgaggcgtgaccagcgggcgtatggggacttgcctgcctccctaatgctaccttttgttttgatgaacaaaggcataaccgacgggtgacattacttgaagtattggacgataacttaatgcgcacacaacgttatctccgacgggtgacattacttcaagtattggacgagacctcaatgcgcacgcaacgttatctcccctactagcatgtacaaaaacctctcttgattctaagcactttgagcacacgagtgttcaggacaaggttatcttccccattgggaaagacataaacctctctcggttctaagcacttgcgcgcacaagtatttgggacgagcaggcttccagaactccattcgcttgagtacgtacacaggttagacgagcgatcaagtttttgaggagcacgttcttcacacggctgctctcggcactgcatctccttccactacatcaacatgtcgcccgtaacctgaatggcagcaacggaggtggaggcgagaatgacaatgacaacggcaatgaaggcaacaacaccaaccatgcctcatccagtaccagaacatacactctctgggtatatcactctattcaccttagtattaaacatgttgctaga

SEQ ID NO: 21320 - DNA, 5298 bp, Oryza sativa
caatagagaactatagagcataaagcttggcaccggatgtacgtagtaaaggctattggtgctcatacgttttgagctggaccagtgggtcgctccaagatgccaccatgtgcaagcaaagcccagagatgtgtgatgaactctcctccccttggcagggtttccaggtgcgctttggcatcattcgaaggtgcaatgtacagcatcatctctgcccagaaatcacacagcaccttccatctgtcccccgggtgttcgatctcgatgagattgtttgcgagccgaccgcccacaacgaggagacggttgtcgccatggtcctggcttcttagcgcttccttccgctgctgcattgttttcttacccttcagcaattcgcgggcttcctcgaccagggcgtcaaatatggattcggagacgaagctatgatccggtaacaattccggagcaaaggctactaggtaggcacagtaccttgacaagctacaagctacgtgctgattagtagtagtagtagtactgtctattccatgttgatcttcgtcttccacctcgcaaagagtagtggcgatgtgccaagccattatgatatgtgttgtagttgggagtgtggtgcatgaccatgaaagttggtagtatacctcgttagcgtgcagagatatgacacagtttcccagttggccaaggcctctattcttcttcagggtttctataacggttttatttacatccatggataatctgacacgcttatcttccttgcggcccttcttggtcttattgaccaaggagaaggtagcatggtacagtatgttcatcgatttgtagtcaaaacttttgagcagtgtgtactgaccgagtttatcttcccagctccggaagtacctgaggctcgtgatgcatccaatcaacttggagaacaatacgctactgttccatgaatctgtggtaacatatttcgatatcatggctactttgctccaggccgaggccaggtatatgtacacctgtaaaccctcaagcagagcgattgcgatcgctgtcacggaggtgaagagagcgtcgtagttcctgtggttagcattgacgaggaatttgagctcatcttcatcgggtacccggaggaaatgctggaacagcttgtaggcaagccaaccgcaggtcgggaccatggcaaaagacaacgtgacgaacagatggtgactgctatagataaggaagtacttggtgtagaagtagtcgtgcacaaaggctaattctacctcgatgaccctgaaggttcgttcgacgcacctgtcgccatggagcaggccaccgaagaggaagtcgcgggtcttgtggagatttgattcggcgagcacctgaaagccggcaaacctgcggttcagcatcttggacaaggccatggagaggcacacgtccttgagcctgccgccattgccaccggagagcagactcccattgcagttccagatatcttgaacggtaacgagctttgcccggtcatcgtcgttgtacctaagatggtactcgggaggctccaccctaggattctgctcgtcctctcctgcaaccacatagtggtacccttgcatgtcgacggcgtctcgtcgttggaccccgtcgccggcaggtcgcaggtgctcgtagctcatgtagtctgccacccatttggtactcttggagagcatggagcttctactggctagcttgaacgacgcgacccgtgtgccggatttcaatatgactatgcagtatatgacccatagaatgtactggaaatccgagccaccagaggaaaccaccagccaacccacccagaaagactcgatgagctgcttcaagtagaacctcttccagtcgtcgttgtctagtaggctataagcagagaaagaatcggcgctgccgaggaagatgaagaggatgatggcccagacggagaagaggctgttcttgtaaggggacgactgcatcagccccagggtgtagctcaccatggggatggaagcagcgtacgccacccagatggtcattttgacagcttcacagctggaccgccggcggtaggagccgaggatgaggagcacaaacagcccgacgacgcccaggaacacgagaacctcgatgcggatcaatcgcaactttgggctgttgagcccgtgaaccatatcgacgagtgccatatatacgtaaatatgctatctaggcctaggtgttggtgtactggttaatatataggcagcagttgcacgaaggatgatagccctaccagctgctgctaggtagctagctaggtcatcgataattatacactttatccaaccatcccccctgccttgtccagaccatctgacggtcggacccacttacacataacaactccacttacaatttcatttttattttcattctcgtttcgtacaaaagggttaatatagttgaagggacaagctcttataagttgattccacttttactaaactagcaatgtggtatgaaacatacatacacagcttacatgcatgtaccacacatttctaattcaaattgggccgtgatgtcacactgtcctaatcgatctcttaacttttgcccgatgttataattaggaactgaagacttgacgaagtcacgcgaggatcatttccgaccttgcacactgaccctcgtttgtacctcagttctattaattaaggggcaaaacgtacagtatagtgctagggtataagtttcgcctcgttctttttaatcactagctctattagatttttatggacacgcttccattttctgaacacggtacgtaccgttgaatccaacttcttaactagttaattaaaaaatttgcaactttccgttcgtcacatcaattattttttatttgtaagtgcgaccgagcgatggcctccattcccacacacgtaagtaacacatcgcgtaaagcggatacaacacaaattcaatagatacaaaatctaattggacaattcatatgatatttcacactattgataatatattataaaaaataatgatcaaattataaagtttgtttaaaacttagacaaagtataatattggagactatgcagacacatattgtcacgccccgaactagccccgagcggaactagcccgtgacgctccaaattaacctgttaatcgataccagtcccaggaaacagtgctggtatcacaggaagacagaatatcacagcaacagatgtctctttattatagagtaggagtatagtcatgttgggctgcggacagatcccgagctcacaactgcattacaaaagggaagcagaagccaagacttggaccaaacatcacaggcgcgacttgggaactaggccgaaaccctaaaactcatcgtagccgacttgctcctagaagaactcctcgtcagcgggatccgcttcatcttcttcagcaactagggaggattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagttttttatgaattgatcaaggttggcatccggccaacagctttcaaacggccacccgggcctggctgatcccattagccgcaaattttccaaacatcgaacccaaaccacctcagcaaatttcacaaagcagtagtcaaacaaaactacactaggaatcacctcacattcgcccatgaccatgggcacggctattcgaacagtttaataacctctgcagagggggtacactttacccacacgacattactaacctggatcatccagcccgtgcagaacggccacgactagagaccttaaggctttcatgacaaggcatttcgaaagccgacacaggttcaccatatgccaacaagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccaaccatgtggtcgcacttgtcttatgttcggatgaaattccaaggaaacggtccttaagtgcaagagcgggaaaccgtacacccggtacgttccccggtccccgattttttggaaattcatttagttcgcaagcaccgacccaggtgtcgggttttccaagtcttttgtaaaacccaagttttacccatggttggatattttatattttgagggggggtgttccgatgcgcgtacccgaaggcccgttaacaaggaggtttaagtgttcaataattcaaggagggtaattgcagcaattaggattggggccggcaggccgtctcgcaagccgcggccgaattacttgtgtaaatcctattcatgcaatatttgcagaaaagaaatacttagatttaaattataggtgcaagatgatcaaaggtgacttgccttgctcgagatcttgaacttgatcttcgaaatcctcgcactgcgggtcttcgggctccgaaactacacgcgaaatgggacaactcaacaaacggcgaaaataaagccatattattgacctctaggcgtgtcattagatagatctcgagatttgaggagttttggaagttgaacggagtcaaacggacttacggttgggaagattttgaatttctaagtttattcgatttttggtctaaaggaaaaggatttatttaaatcctttttgagagaagaaaagaaaagaaaagaaagagggaggggaaatagacttccctcgggcggctagggcgcggcccgagagaaaggggcggcttggccaagcttaatgggctggccggtccaagaaggcggcccaaggcgcgcgcgcgggcggggaggagagagagagagccggtgggccgggtccaccttgcgtggtcccgggtaggacccgcttgtcagcggctcggcttaccatgtggagggagtacgcggcgcggcgctagggtgtggagcggggcgcggtgcatgcgcgtggctcgcgggggtgcggatgcagcgggcccacgcgcagcctcacggctcgcggtggaccgcgcgcgcgagcggggcggagggaagcggcggaccggggtcagcttgacccggtcgcggccgaggtggcgccgacgtggcgcctacgtggct

SEQ ID NO: 21321 - DNA, 2437 bp, Oryza sativa
ggagtgatctctccggcctcgggccggggaagaggaagaagacgagcacccggagtccccttccgcgtcctagcgcgcaccggctcctccggcacacgcgacggcggcggtcggcgagagagacagagggacggcaatggcgcgggcgaaaaacggggaagattgggagggaaaaagggaagggagggcgcctgggtttatagggcggcaatgtcggtttggaaaccgaccttgggcggtcaaggcgcgagctggcgctcggcgctcgcggccaaaacggcgacagaggcggatgacgccgacggggaagagggagagagggagagagggaaaaaggaagggagaaagggggcttgccccttgcctctttgggaaaagaatgagggagagagggcgatgaggaggagccctgcctcctttccttggaagcacgcgcggggagaggcggggccgagtcgatgacgacggcgatgacggcgggggcggtttggaacggagcggcgacacgggcggcaggcgcgggctcaggcgcggcaggcgctgacggcggcggcgtctggccggtcggccaccatggcgcgcgcgcgcgggaagcaacgggcggcgccgcgatttcgcgggcggggagctcgcggggatggaggcggggagagggagagcgagggggaggcgctcggcgcggctcacgggcagagcggggagagagggagagagagagagagagagagatgaagagagatgggccgagaggaattcggcccatcgaacctgagggaggcaaaacagacttttgcggagggatttgatttgggacggatcgagattcgggatttgaatttgacgatagaacggggatttgagatccggactgactgcaagcgaagaaacaattttcgcaattagggtttttagaatttaattttcccgcaatgcgccacgacggaatgggcgctacacatatataatatgccaatatatttttcaaagtgaggttgtatcctctcttactataaagttataactcactaacttttaaagcttaacatgcaaaaaatactacatcatcatacactaacaagatgctatatcattatcatccactaacaaccattaaatttaaacatcatgcaaacatgctatattatctataaacttatatttaacatgtgatcatcatttcatataattcacataatatttcaatgtagattttcattatttttttataatatgctatgtacctgttgacagagtagatcacaactaggttatttgcagaatatggagatcgttgttgctacgatatacgcgagattgggggtaaagatacagagacaaggatgtttatacaggtttgggccccttaactgacaggtaatagacctactcatattggtcgaagccagtattgctcttcttcatcagaatcaaacaagtacaatatttgggataacatatctagtcatcattgacttgacggcatggaacaccacacgtagtcgacgacggaatagtcttcctgctcgaatacaaactcgatgacataagagatggcatttgagtctgtctaggcttgtctccgatgtctatgtctggtgatgtgtattggtatctattctcactgagcgtgtttattatggttaggcttggcttgatctcccccctctcctcctagggggcttgtatttataccacagatgtcccttgtccaaatagaaataggaagacaaaaatggatacgatccgagtagtccttgtagtttccatgtagaactctgcttctccttctgtataaggaatattttccatatatgaggcatgattccatataaaacttggtatatggtgggccccgctaagctcaacctaaggctattgggtttgccttatccataacactggcagtacctacatagttcatcctcacgtagttaatatttttttctcttgtttcattaagccatatcacatcaattgtttttagtgcttaaatgattaatctatggtccaaattatctctctcattttcttctctcattagtccatattacctcaattatctttaccctttagatgattaatctatggtccaaactatctcaatacttttcttctttcataaagtcatatcaccttacttttacatttgaatcatcattctatttactatttaaatttaatttatcataaacctcattaacttacgtaattgttaacggaattttgcatctgattcggagaaggaagaagatcgatcggcgaagaagatggcgaagccggcgtgcacgctgatggcgagggaggccgagaacggcatccatgatccaatgaaaggtaggcatcgtaccttctgttgtttttctgttcgcttttcctttagatcaaaagcgatgggtttccttctttcacttcgcgatgtacttcgcgagagcgaaag

SEQ ID NO: 21322 - DNA, 4427 bp, Oryza sativa
cgaactttggagttcgatagcgtgtcaaacaaccgtagagttcgattgggttgtttattagataaaataattcgaagtgcatacatgcatttgcatgcaggtcctatcgaccaatgtctgtcgataggtcctgcacacccacatgcaacaacaggccatttactggtctatgcgcatgcattgtacttttaatattttttcaccataccaatccctatcgaacatacatattgaacagtgtttgtttgatatgtacctaatagaacatcagtagcaaaagtgggaccagcggaggggcctgtcaggtgatgaaagggagccattgtaggtggggccgatggagaagtaaagaaagagagataagaggaagagagagaatgacatgtgggcctcacaggatgactcagcgggatagaataggtcaaagcgttacgtaagtgaaatcgtgttttacatggctactgtgtgtaattctttttcttgcaaaagattcgcctatgcaggtgtccaatcggatgttacatgtatataacgtgattttttttctaaaaagaaaaagaaagagtccttatctacttcaaattctcatattttttattttattttatttcaattaatatgagaatttatagaccttgagagctacagtggagacttttttttctattactttattaagttaattaattaataggtttatgcatctcataggaagacatgagccatcgagcccattagccttctgttttccgcaacgattgatacttctcgcaagtttcttcttgaagatgacgtcatgacggcgaatatattccagcgataatcagctgcggttaatttgttctggcaggtcggcaccttggccttcagtagttcagtgtccgagggagattccaaaaccaagttgatcacggtggaattacggacgatgatgagctactagctcttgattgttttctgctttgtattagtggatacttttgctgatatactacgcgaaagctgtcaactttgacgccggatttctcaagtagcttagcatggaactggacaacgttttgtctcaaggtgctgagatactaaacatctggacagaaaaataaatgactactagtgacatgaacatttaaaaattgcaacttcccattcacaaggcaacatgccaattgtaaattgatgtttgacaattggtttgctaaagaattcgagttggcgatggcacttcaagttgggacaactctgtccttataaaactgatcatcgagactgtaccgttatatgaacaagtatgttttttcccccattgactacaactcatttgagtctgcaagtcaaatactgctgtgagcaatcaagaatctgcattctaccctcctgttatgaacttttttagattgtaaagactctttcctgcccaaaaacgattccattagttgagatgctcttacactcatatattaaattccttacccttccataactaattttgaactattcaacaatatcctcttcatacattggtgctccccagccattcattgccccttcacagtacactgatggtccctcgagtcatcaatctgaatgtaagtatcctcctcctcacggccaccgaagagctccgccataaaaatcgacgatcgtgcggcgagcacgtccgctggcgaggaggtcgcggagatgccggtgcaagtccggtggtggcaccaccacggacgacgatgacgccgcctcgcgacggcggtggagggcactcagtaaccacggcgatgtcacacctgataccatagccctaacgttatttgtagccatggacaattaaaggagaaaggtcaccggcgacgatgggggaattttcatgcggaccatgtggccgctcccgtcgggtatactgaacacgtattctgcggtgacgacgtcggcggcgtcggccggtcgaggtagaggaagacagatacccagtcggcgaactcccggcgatcgccgtcgggtagtaggcgacgtatatatataccaggtgtccaggtgtcacccctccgtcgtggaacttacaggagttgatgctcttgccgacgccgatccctttggttctactgtagccggcgacctggatggtgactgacccggtttccattgctctcttgctgtcgatggccgacgacgacgtggttttgccgccgtcgccggtggcagacttggaagttgtgagacccattagattttcaatcaactttgctatacgtccgacgcatgtgtccgacgcttgtacgactgaaacagtggaaaaacgagcaatgacggcgtcagatatgactacgggtcgctgggcctcgttgttgtttgcttgcgtactgggctttctgtacactggggccagtctggctgagaacatgtatcagcttaggttgctattaaaatgattcactccagatgttagattagtttagacctttaggatgtgaaaccaatatattctcacagccataacatgcaagtcctctaaaaaaagccataacatacaagtaaaaaatgattgaccagacctgtgaaaagcaacgcaccacggcttcaatttccatattcatggccaaaatcagttcattaaacagaatacaggtagagtgacattcaaaatacaggtagagtgacatccaaaatcacaagcatactgtctaacattgaataataataaactagcaaatgttgtttagttcgtcgattgagatcacaagtaatgcaagcaaaaaatcattctctctttcatccattcatatgctgggatagaagctccgtcaaatcaccatttccctgcaaaagtaaaaggaacagagcaacaagttaggggaaagtactatgcactgatatatactagaaggcaacaatgaaaattagcacctgaagaagatccatgtaagaactaatgtgagatggtggtgccgggtgatttgattggagtccctgtacaacaatattgtcaaatcaattacagcaatgcaaaattatgtatggcaaatcagtcacacaaattacctgaaactcatttgcagcaaactctgcactgcctgcctcatatgctccaccatagcaatgatcaaaatttacctaataatgaagtgcatatattcagaaacgatagagagatgaaatatttcaagtacttaatactactgaatagaatatgctgtacacattttaataaatatattacctccatttgtctagagttctgaatattgataagctgtttatcttttgatataacatttttggtccttgtctttctccttcttcgactttgtacttcaattgtagattcttgttgcttcttcattctcaatctccttaccacttgatccaattttgattgttttctcagtgaaggaggacgacctcttctacgaactgatattgggcttagcaccatttttccttgtttcagcaccatatctttattcttccattttgctgatattcctgaatttccttgctgccatggtgtgcatcaatctttatttgcaattcatttaggccatccatcactaaattgcacaatgcatctgaaactgaaccattctctgccacttcattaaaacgcttgcacaacgtatcaaaacgcctaacaattggcgtgtcaagctgatcatcataggagcatttaataaatgtgtgcttgcgcttgaaatcctttctccatcgttgtagtatatatttggaagggactttttctatatcaacaagagggagtattgaaaggatatgtctacacaagatccctcggaattcgaaatgccgacattcacaatgcaagtcacaatcctcttggttgaacaaaacaagtaactctgaaacaaccctttgctctccaatttttcggtcctctctgacactgaaagtatgaaccaacccttctgtcttccgaagagttgcatagtagtagattttgcctcttagctcatcctgaaactctttaaacttcttgttggtatatgccacctgaaattgcctctcaaattcatagtgagtaatgcaaggaattgcctcttggaatgatttacaatcagacttgttttctttctctactttgtctcttagtgcattgtcatattgctccacaaattgcttaagtgtggttctagcattaacataaccatcaaagaaggcattcacactctcactcctttgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatcatacaccacattagacaatgtagagctaataacttcatattctaagtacccaccaagtttttcaggaatcttcttcatgatatgcc

SEQ ID NO: 21323 - DNA, 1859 bp, Oryza sativa
tactattaaacttgctcgtaacatcttgtaacaccatagagaaaagaaacaatgagcaacatgggttaaaagtgtaacaccccaaatatctataccatttagcttcgtgaattccagcttaattcctagtgagtgaaaagtagtaattctgtaattgtagggtcgaaattaagaatgcctttaagccgtatggaattgtaacaagagacaaaggaagcggacggcgaggtaggcgacgacggcgaacaggaacagaatggggcgcaccgccttgctccggcgacccatcagcccgagcgcgaacgggtagagatgcaccaccacccacacgttgaacgccaccgggagtgccgccgccgccgccgccgccgccgacggagcgtcccaccaccaccaccggccaccaccacccgccgccgccatcgacgccacgttcactgccagagccgccgccgtcggcgccatcagcgccgtccacctcacggcgtacagctccgcgtactgcctatccttaccggcgaccggcgtcgccgacgacgcgagatgcttcgaggtcagcttgaacgatatttccttccccgtcgcgaccttgagcgccacctgcgccaccgcggcgaggtacgcgctcgtcgcggacaccatccagaactgctcgttccgccaccactcacccagcgcgatccccgaccacctcgtctccagcacggccaccgccgcgagcgtcaccatcagcgccgccaggaacgcgacgtacgtcggtgtcggcgcggcgttccagccgccgccgccggcgatgagcgggatcgccgggaagaggcagtaggccatgaggaagagcgacgtgaacgggtacaccgtcgtgttgaggtaggcggcgcgctgcagcgggtggaggcggcggcggccgccggcgaggagtgcgttgttgcgggagaagaagatctcgagggagcccgccgcccagcggagcacctggtggaggcggtcggcgaggttgatcggcgccgtgccgcggaacgcgtcgggcgcggcggcgtagtaggcggagcgccaccctcgccggtgcatgcagaagcccgtggccacgtcctccgtcacggtgccgtacacccagccgacgtccctgccccacgccgtcccgtcctcgtacgcgcacgacacgagcgcactcgcctcggcaatggcgtcgccgtcgtcgcgactgtgactctgctccgcccgaacggaggctaggaacggcgccgactcgccgaacttggcagggtccgcggcgacaccgccgccgggcgatctccagcgcggtgggtcgacgccgtagagcgcgacgcggcggaacaagcagccggtgccgacgtagatggggccctggaggccgtcgaggccaagctcggtacagtcgaagaagacgcggttgtggttggcgtagcggtcgccgggatcgacgccgtcgaaccgctgcgggaactggacgaacgcgacatcgccggcgtcttcggcgccgccgccgcggcgttcgatcatgaagcaaatgccggcgcggagggcctgcgagttgttgacatagtggtcgcagtcgaggttgaggatgaagggcgcgttcgagagcacggcggatgcgcgcagcagcgcgttcatggcgccggccttccggtggtgtgcgcggccgcggcgcttctcgcggcacacgtacacaagcgccgggaggcgcacgtcgacggaggcgaggtcgatgagcttgctcccgtccgcgacgccgagctgtggcgcgctcccagcagaatcgatcagtacctgcacaactccggcgtggtcatcggccgcgccgcagcgccggcggcgcgcgtcggcggcctgcagcg

SEQ ID NO: 21324 - DNA, 4267 bp, Oryza sativa
cggctcgacgccgtgcttccggcagaagggcacccacagtgccgcgaaccgggccgcctccacgaccgccccgcgtgtcacctccgcgccggcgtcgtcggagacgtagcacgtcaccttgccggcggggtagcccgcggcgaggatggacagcacggtgttcgccgtggcgagcggcggctccttgtcggggtcggcggtggtgacgaacacgtccatcgccgggagcagcgtgtcgtcgttcagcgccgtgacgtcgacggcgcgccggacgggcatcgtcttgggcagctggtcgagcacccacatgaacgcgaaccagagctcgccggcgatggacgccgtccaaaatgtcgccgccttgctcatgccgatgccgccggcgtcggtggagctgatggcgcgagcagcgtaggtgattctccacttgaagaagagcacgaagatggcgatgcgaacaaagatggtgagcctacaagtgcattgtcaatagatgtgattacggtgagttcgtactccaagttcggaactgatcatttcttctgcatgaaaacgatgtacttcctccgtttcacaatgtaaaactttttatcattgtccatattcatttaaatgttaatgaatctagacatatgtatgtgtgtagatttattaacatctatatatgtgtgggcaatgctagaaagacttacattgtaaaacggagggagtagctaattagactatgattaattaaatattagtttatttttttaaaaataatagattaaaattatttgttaaatagacaatcgtattgaaaacttttataaaagaagcacaatttaacaattcaaaaattcgaaaagagtttgctcaagaaaaagagagtaggagttgggaaatagaagtatgaaacatagccttagggcatcctcaatgctttatatttaatagagcaacaagatgaaacccacgtttctatattctttagtttataatgcatattacaatgtatatggtctcttcataactataagatgggcccactaagaaaaaaaaaccttcatccactcagaattgaagtgtacatgcatgctacaaagccttatttttttttaattcttatggtctagctttaagcttaaggttacccttagcactattctcttcttagctcatctcccaatgtataaaagtataacaaaaattactactttatttgataagattagttttcatgtacactgtggttgcccttagtccgtcagtgacccgctcattgatctgaaatgcaaggatccaacatttgtcaaaactcccagaattggagttgccatcaatttttaatagcagtgcactttgcctccctgagacattttaacttgcatgacattataattagaaaaaaaaagcaaagaatacagtgggtcccacatgttagtaacataggggatccattcttctttttttttctctgtcaagcatgtctagaaacactttgcgtgcaacaagaacacatcatcgaggtgagggaatcaacagcaacaagttgtttaggcttaactctgtcattcggtcggtgagcggcgggggaaaggagggcacctgcactgtggtagagagagaggggtggccggtggcagcgaattagatgatggtgtcgggcaggcgtatagcgcgatggtgactcgattgaatccagtgagggcaaaatgtcgtggaagtagattgtggccgcatgaatccaacagggaagacagtgattgtggaggtgctcttgttggtgcaaaacgcgacggtaagaagcaaacagttgtacatgagaggaagctcaagttcatggtgaaccactacattgatcaccgccattatggagggtaacggacacaagctaggaggaacaagttgtgacacagtaggttttacgagaaaactcactacagagagatcgacgagggtggagcatgggatggcatcaatggcggcaacaatagttttcaacgtttgtggccgcgggaggacgaggatggttgcagaagaagaagaagaagcctgcgtattgactaatattcgtctttagaatgaaagtagctatgaagcccaatctactctcgattcaagagagggcatagtcgtatgggtagggtgtttgtggggagctgccttggatatgaggaattcctcaaatctaaaaaaaaaatagaacaaaggcaatgtccgtgacgaagatctttcttttctatcaatagatagaaatgagtattcgttataggggataggatctatctgctctctctctctctctattttctttgatgcaatttagagagaaagagcagtacgaactagaaaaaaaaagataatcgggagatgattaaaaaatagatacatagacatctaaatctaaagtaaagggatgtatatagtattcctatatatatcatctatctatgaaaaaagtaaacagagttcgtttttgggttccccgaagccccaaatggattggatcgtttctgcttctgccaacgaaatgaaggcctcgccccttccgaatgcttcttcgatcctgaagttctcgcgaagagaataagatgcagctccctctccctctgtctttttccgctttgctaatattcccctctaacgtgggccgagccaggcttaggcgggcgcgggaggaagaaataaagtcgaagagtgtcttctcctttgtcctttttcagtgcaacataggaaagcaccctctttttgtaatccctgcagcttcccaaaggcttttttttattgaacgcatggtgtagctaggacctctccaatcatgtttgagcctatgttcacccggggcccaaaaaggagaattccggaatgcctgccaacgttcagataaagtgcatatcccttaccactaaaggaaaggctcgacgaagggggtgggggtgggtgggagattttccggctcgatgaaggggacttttagagatattgagatgttgatttgtttttcatcgaaaaggaagaaggccaaggggatagctgccttccttcagactttgcctgccgacgttctaataaagaattccggctcggcccaggaaagcattggcaacaacataaataaaggggtccatgtagttgctgcgcccgcccactgagtagcaggttcggcatctactgcaaaagagagattgagtctgagggagaggggggtttttttggggctcgagagattgaatagatagggcctcacaaattgttaattcgccgctggggaattcacataaaagggaatgatttattctcaactaaaaaagtgctctttgaaccgaacatgaaagctgtaagtaagtgaggaggaggcgacggctgcaatgtccttgaggatgaggtcctcctagtacacccgctctctatggcccttcctcctctcgtcctctagtgcttcatccacccactccctctccagaagcacacctctagtattggcgcgtcccaagagttccatcactactaccactaacgttttggcctcgccgaccaccctcatcaaatcctcagcatgcgtgaacgagagacaaagagaggggggagaaagaggtggtgacaagtgggccttaataacggtgaggctggtccatggatgactcaggatagtcaacatgccaacaagcagctaaataatgcattaaaaaactttccatataaaagttcttagaaaataaaaaatcatttaaaaaatatttaattaattatatgctaatgacttttttccatttcattgatcagctcaaccaaaaagcttgagcaaacgggcctatgaatttttattaatgaaacacaatcgtgatgaagacactcatataaactagatgattcccccacgctgctgcgggaattggtataaaacttttgtttgcaaatttcatgataagaaatttagaaggcattgggtatatataaaaatgctagctataacttaagtcaaaatagaaatacacaagattataatttataaaaaaaacttgacatatagaaaaacaaagatgatattatgatagtatatatgttgatagcgtgaataatcgattattgaactgtcttgtcttgtgatcgaaacagacatgccctatataggcatagttcatttttctttaatataatttagagacaaccataaatgtatatgctagtctatatatgatatatgttcattaattaagaatatatgtacacaaaattaaaaagaatatgatttggtaccataccgtttagcttcatgcatggcatt

SEQ ID NO: 21325 - DNA, 26623 bp, Oryza sativa
taactctacgagcaccttcaaagatgggatcaatatatatgttaatagtgtcgaaatcaccacaaacgccacatcacacaaaatcatactcaaaacagccaacgacgaacataatttctctagttttttaaaggacttctttttagacgaggccaaagttcatgaaccgaaaacaaccactttaattatttgttggttttcgtagcactttgctaagatataattaagttgtataaatatgtataagtttttggttcaccataaacatgatgatctgaaacacaacattcgtgtgtcgtaggtgcactactacaaatttaaggcacctacaacttgatggtacactcatatatgtatatataccctcacctgtataacttgatggtagttgtcgagatgcgagtcgtccggacgagcggcgccctctcgtcgccggcggccagcttcgtctcggactccggcgacgccgccgcggcataggcatccttcttggccgggcatgtcgccgccggcaagctctcagtggccaagcctgctgacggcggcatgtgctctctctagcttcaaatatattcctaatgcattcgaaagtcccagtatagggctagctagcgatttatattcgtgcaaaaataatgcgttatcacgtacgcattcatgcacacttatcccctgtacatgttgtttttttaattattcataaacatatcctaccttttgctttggctaattaagtggcggcaacttttaggttcttgtgtcatgcaaaatgttaaacaagcatagcctagtgttgatatatttcccaaatttaaccgaaagaagtcaggtgtctcctttggaacatctagaaatataggcgtatatatagtatatgattgtctaattttgagctttgactccattaaaaacattttgatctttgactaacgattaatccaataaatctagatttttccataaaagaatgataatataattcttcttagttattactatgatttcataaccatataagcgaaattatataagagaaatttatgatgaaatattcctttttaggacagtcaagagctataaatgaaatgtgacgtatatatctgatattccccaaaacagtctgtataggtggcacaattgtgttttgtcgccttgtcaaataatttcacccctagagataattaaaaggtctcgcatgcttaaatattgtttcttctacaaaatatgaaaaaataaatataaagacggttttggccgtctctattgatcaccactatctcatagacatggttagaacctgtctagggcaatggtaataccttagagatgggtcttagaactgtctgtgattacatattataaaacatctctgatttgtcctaatataagtcaaacttctttatatatatttaactaaatttatagactaatttagcaacatctggagagatggaaataaaacataagtcatgtttgtcctaactcgtataatgtgtatgtacacatctccataagacatataagacatgtgatccactattgaaataaacataacaataaataaaggtgctcatgaaagtaaatatacttcaggagagagagatatatgaaagggaaatagagtgtgggacttagatggtatgctgggcccacatggttgtattttttgggttggtgttggtactcacccagaatcatcacctagcatggaagatgttgcaaatattattctgaatagagaatgtctcgagctttactacgacctatatagatgaataaatatgaaaaaaaatataaaaataaagtagtgattataataaattataaatgatatgagatgtttgtatgagttttaagatatattttttattgaataatgatgaggcttgtttgcatgttaagttttaatgggttgtagctatatgtgtgtagtgttgtatcaagttctcttcacttggtaatggtaagcaagcacactatataatcatgcatgctgttagttgtagatccgcgtaattagtttaatgcatttcttgctgacgatcgatgcatggaaacagatggaactctcaaagtgtactaatgcagaatccactttgcatctcaaagtgtactaatgcagaatccactttgcatccaccaaacatgcaactggacttggcaaacacatattccattcaagaaacggaagagccttcctacgcaccgtccactgatcatcactactcttgctgacagaaacaaacgagatgcccgcactacaagaggaaccccctttagtaatacatatatgtattgctaaaagtctctataagtattgctagggtctgcaccaacgtatttaatatgcgttgcctatgctgccgttgctaggatcaattacaacacatagacaaccgttgataacaagtggaaataagcgttgctacttagcaacaattttaataggtttcagcaatacttatatatgttgttcccttgagagatgaacagttttatataatcttagcaatggatataatcaagttgctgcaacatgtacaaatattgtaatttgagctatccactgtaggtggcctttgaccaattattttgtcaggcaagagacccatgaactcaaagcatgcacaagtgacaatagtccaatcaatcatgataatcgattatatattaaatatagtattttgcattacatagacaatcatcagtataattcatggcattaaacctttgttcagaacattaatgcagaaaatagaatctaaagtatataaaaaaaacacatcttgttgcccccattctccaccttgcagccatcatcattccgtgatatgtacaggtgacctagttgcgtactggcagtcacgaaatttcccccacatcttcacccatttatcttgtcaacctataatagaaaaaatatataagcattaatataccattatgaagacgaaaagcacatctccgaagaaagaagtaagagataggaacatacaaaaattgcaggctacgcaatttcaagtcctacaacatgaccaacaattttgtagcctttgtatggcctaatcaaatcttcggattttgccaatgcaagatcgacatgaaccattaaaaattcatttcctagctcaacacctccaactctgtgtgttggatcacagcttacaatagtggcaagagccacgtttgtattccgatttttccaactttttaagaatactttagttccaacctgaagtgcataaatacatccatcaatattatcaatgtactttaagaaattcaagtatcataaataatttcacagtaaaatacctccattgaattgtcagtgataaagtccattttgttgcactgttgtttctataaaaaaaatttggatcatggtttgcaatttaaccacaagatagaaagaaagaaagaccaaacagagccaattattgttctccaattgaatcataatactagtgaatcatgcatgttatagtttgaatggactgatatttgtaaacatggtgaataaaaaaacaaccttgtatgcaccaccaactttatgtgcatgtaccatatggctttcctgattgtcaggtttcttgttctataggggagggcaacaaatcagtgctaaaattatatatattaagaaattttactttcaaacttttctatcaaataatttttgaactaaataagaagtgaaaactaaccttggcacaaataatctccatctgtttcccatggtcatttaggccaaaggttcgtttgttctagaataaaagaatacatcacattgtcatgaactatagtaaacattcatagttagttacaaacagtaccaaataatataatgctatgtatccatgataaccatataataggatgcaaccatggtgagttcagaataaaaatataaattgaaagacaaggaccttgtgtgcagtagcatgcttggttggtggtgtcttatcctcatcttgaacatggctttgtgaattctgttgtcaaagagagcatatattcccagttacaaaatagtgcaactattcccatgtataaaacaatgaaatttatgtatattaccatcacaatgttttcctgctcaacatgacaaatttcttgcaagggaccgtcaccatacactttctatcacagtggaaaataaaaggacattaagaccagattttattaaactattagactaaaatgttagcaaggtttaccactgttgaattgtcagttaaaaagtccattgtgttgcattgtcgtttctgaaaaaatagagagaatttacagtaaaaaccaacatgctgtgtgtgctattttagttgttgtgtagtgttcaataaatagaaatagcattttgaacttgaaacaattagactaaccttagaagcagtactatacttgtttaggcttggtctaacaagcttgcgggtaaggttctctttgttctgcaatacacatgtgtgttatagtttcaaagagcttatatctgtagacatggtgacttaaagtgatgaaaaaataaccttgtgtgtacttgtaactttgtgtgcattcaccatatagttgtcctggttgttaggtttattgttctacagtggaaggtaacaaataaattttacaaatctatatatacatttatatatcgaaattaagctactttcaaacacttattgactatggcattgagtttgaaaggataaagagagaacttaatcaacttaccttgtatgcactagaaatactcttccctggttgcataagctcattctggtccaaatttcctttgcgctgcaatggaatagctcataaaattggcacaaactataatgttccaattatttgtttactctgacatcatgcactccaattaataaaaaagtgaaattaaccttgtttgcacaggaagtaatcttcctttgcttcccactgtgattctggcccaaagactgtgtattctagagtaaaagaaggcatatgattataatgaatgctatgtaaataatagtgaatatatatatatataataatattttaaatgcaaaggcaaggaccttgtaaacagtagaatgcttggttggtggttgcaaattctcatcgtgcacatggctttgtgtattctattgtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacataccctcctttttgaattaggtacgtcatcacaaatagcttttttgtttgttgacgctccatctaaacctccctgttacttcaattaggtaagttagatgcattcattgggtcacacacaagctcatataatttttttaggactcaactcccttaaattcacctgattcttttgtgccttttccaacttggttgccttctcttttaattgtaaaagttcagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctagttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtggtttcttctttgcaggatctttttgtctctatggaacacatgaccaaatcagtaaagtcttaacagtagctatacatgcttgaaatggaaatagatgaatactattcaagacatgttttaccatctcttctcttgtgtgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtacatgtaccttcgatttctcgttcatccaatgattgacaagagcaatccactggtcagaaagcacaccttctaggacattgttgcaattagcttccttagtctcattcacatcaaaatacaaatcttttagttttgctttatattgccaccatctttctacaattttttttaatatgaactcttccatccgaggagcataaaggaatctcatctacatatagcaacacagaaactcatatggccatatggggatatgcataacataatacaagaagttagcaaaaatgttgatctgaaaaggaattaccttacttgcttaagtatgtcctttttaacttttagttcatttgtatttttctctctctttcctattacatatctccagtctgtgtagcctaagctacacagactaccattcctagctaccattccaagaaatttacccaaaattccagcttcttcccctaccgcctgattgagatcattgcattgaaccacaattctaagccctttcggaaggttccaaacatctttcagttttgtcgaaaggttccaaacatctttcagttttgtcttgccacgtgtttcaggtgctccattttcaactgttcggtgttaaattgcaaagacaaaagtgatccttagtaatcagggatacgagtaataatgtcattatttcttaccattaggactgttaaacttagcagttacctcgaacattaatatcaacatcagtatcttcattgctttcatcatcaatatcaacatcgtcattagtgtcttcattgctttctccatcattgatatcaaaatcgtcatcagtgtcttcattgccttctccaaaatcatcacatacagtttcttgttcagatggtgtggcaagctatggaagggtattttcttcttcagtctgttcctctgacaaatattcctcattgctctgaacaatacgccttcttctactccttgccatatctcttgcacccaaaaaaacctatctgtcatttatggcgtcgaaagtatatcattctcatttcagaagtaggactgtgctgtacatagtttcagacagaataatttcagaattgattataccctgagccattttggatttgtttttgaagaacaacagagtactgctgtcccaaaagtaatgctataatatggatctgtttgtcatactcactaattcatttgtccattttataggccaacaatttgaaacaagtaatgggtagaaataacaaaatttaattggctgcaaggtaaaactagatcacatattgtattgcttacagttgtgtgaagcctagccgtacgtagaccaggctccttcagctatggacggtcagtgcatctgactccaaacctgaaaatagaacacatcaaattggtaagtattgtagtactggaagggaattagcctccattgcaatttggcgactcagagaggtagtaagatgtgcagagggaggcagagattccggggcttggaaacattgccgccaaccgcgcggggtggagcagagcgaagtggacagccggtgtcgggaggtataacccgcatcaattgcagtgccccggtcacccagcacatcggctgggggcgtctccggcccgccgcatgccctacgtcatccatgccctacgactggatgaaattcggacgtaacatattttggttagttgtttaatttatctaagcatgaccgaaaagacacgtgtttttccatggccaatccggtccggacagaccgcatgaaaaagacatgtaatatatttttggtcctaaaatatagttatttaaaaaatgttagcacgataaaaaaacacgtgtttttcgttgtcgacccggtccggacagaccgcatgaaaaaatatatataactaaataacagtgatttaatattttaggacaacaaaaaaccacatgttttttcgttgttgacccggccggacagaccgtatgaaatctggacgtaaaatttgtgttaaaatagtagttagttaatttatcatagaacgaccaaaaaaacacgtgttttttcgttgttgacccagtccgaacagacgggatgaaattcggacgtaacatatttttgtcttaaaatagtagttatttaatttatattagaacgactgaaaagacacttgtttttccattgtcgatctggtctggatagactgcatgaaaaagtggcataatatattttaggtgttaaaatatagttaattaaaaatgttagcacgacaaaaaaaatcatatgttatttcattgtcgacccggtccggacagaccgcatggaaaagagatgcaatatatttttggtcttaaactatagttatttaaaaaatgttagcacaaccaaaaaatcacgtgttatttcattgttgacccgttccggacagaccacatgaaaaatatatataattaaataacagtgatttaattttttaggacaacaaaaaaccacgtgttttttcattgtcgacacaatccggacagatcgtatgaaatctgtacataaaatatttttttgtcttaaaatagtagttagttaatttatcatagcacgacaaaaacacgtgttttttcattgtcgacccggtccggacagactggatgaaatccggatattctgaaaataagttttcaaatggtttatttttaaaattttaaaataaaaaagttcaaaaaattaaaaaatttctggggcaacagaattttttttcccgttcaaggagaggaaaaagtttttaggaattgccactagagaaatgaaaaaaattatgcatttgctagttctcgaactagagttgtcaatacagtagaagaagctaagtaccactaggctatgtccccctttatttattttttcacgttagctgcaattgagaatataaatagacagaatataaatagacttctccaggtatttatataagatggaaatttaaattctgttagcacgaccgaaaaggcacatgctatttcgttgtcgacccagtctgtacagaacgcatgaaattaagacgtaaaatatttttggtcataaaataatagttatttaaattatatttgcaagaccgataaaccacttgttttttcgttgtcgacccggtctggacaagccgtataaaatcaagatgtaaaataatttttctttaaataattgttatttaatttatgttagcacgaccgaaaaaccacatgttttttcgttgtcgtctcggtccatactgatcgcatgataaaatccagacgtaacatattttgtcctaaaataatagttggtgtggccaaaaatatttatattgaaaaaataagttttcgatcagtttaattttaaaattaaaaataaaaagttcaaaaattctcgttatctagccagctaagaaggatagggaaaaaaaattaggaatcgcccctagaaaaaaaataaaaaaaatctaggctggcatatttgttttcctcgttatctagccagctaaggagagggaaaaaaatttaggaatcgccactggagaagaaatggaaaaaaatgcatttgttaggatttgaactacagtcttcgatacggctgaagaagccatgtaccaccaggctatgtccacttcatgttggagttgtccgttcgacttacttattcacgttaggtgccattgacaacgtaaatagttttcttatataggtggaaatggaataacagaacacaatagatgcaaagattataaacgcccattcctttttctcatcatataaacaatatgatatcctggatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctcaatccaaaattactgccataaaaataaagtgctccccaagtgaagatataaataatataaggaaatcattgataatggacagatagatagtgaaaaaccttcataacctcacctttaattagttaccatgttatcgacagttgttccttctatatctcttcgaatccatgtctgaccatcatgtgcactgtcaaatagctccccaagattattgacatggtatggttcgcattccacatcattccattcttcgcccagttcaaatacatctctgggtttcatattccttacaatagaccaccctggatttaaatggtcttcaatgtaaaacacttggttgacttgatttgcaaatacaaagggctcatgctcaatcttttcaccggtatgaattttatttgagaaattcacaagtttgcagccaaacttatctattttcactcattttcctttagttacatcgacccattcatatttaaacaacacaactgagaaatttccatagtagtctaacttaattatatcaagtacccttccataatacatgatatcaccaaggatagggttagtatcactggcggacgtgtagctcgatgtttttacagtcacaacaactccactgttttgagtcaccctggcataacgctttgatctgaacctatacccatgggtattgaatgctctatgtcgttttgctacctcaattggtccacgtgctagccatctaatatcctcatcaatactatcgatacctctttgattctccaactgcaagatctacaccaaaccaaaagatgtattagtatttgaaaaagagaaacataaattttgagacttacataatctctgaaccaatcagggaattgttcattttgcatgttctcaatgttttttggagttagccttttgcgtttcttcctttgcaaatcagcagcatgttctctgcaaaacaaataaacataaatttgaagcaaaacacttacaacacataaaaaaaggctatgttaggacaatacgtacttcagatatggcactatagcatcacagttgtatagcacatatctatatgcttgcaatttctctctatcagttaaggagtacgccgatggttttcccaatggttttcctactggaggaaacaaagtggattcttgcctactcatgggagtctcaaattgatctggtttgtcattattccttgatggtatgttatgcttggtagagaaaccttccaagtatcgcgaacaaaatgccatgcactcatctgccaaatatgattctgcaattgaaccttctggacgcgctttgttgcgaacatacgacttcaatttacccaggtacctgtaatatacatacaaggcacaaaactaataagttagtattgtatcatatgacatatgagaaatattataaattgtatgctaatatatttttagtacctttcaataaagtacatccatcgatagcaaactggcccagcaatcttacattcagtagctaaatggacgactaagtgaaccataacagtgaagaatccaggaggaaatatcatttccattctgcacaatgtgattttaattgcttcttccaaacggtcaagctcatcaacatggagaacttttgaacatattcctcgaaagtaagcagataagtcaaacaagacagatgtgacttcatcgggaagaatacccctcaaagcaattggcatcaattgttgcattagaacatggcaatcatgtgttttgagcccatgaatttttccttcagcagagttcacacatctagatatgtttgaagaatagccacaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgaacttggagattatcctttgactttccttctaaatttagaagtataccataaatattgtcgcacacatttttttctatgtgcatcacatcaagattatgccgaagaagattgccatcccagtaaggtagtgtgaataaactacttactgccttataagtttttgacttcttaaaatcaccgatagcatttatttcatccaataccggacgcccatagtaagtcataggctctgtactaatctctgtggttccatcaaaagaatttctatcaaaacgaaattcatgattaggtggcaaaaatcgacgatgacccataaaacaagatttctcccatgtgccaaacgtttggaccatacatttggaccacaaggcgggcatgcaaattctccatgcaccatatgtgaagcaagcattcctaaagttggcaagtcatttatagtccacagtacagctgccctcaaattaaaagtttcatttctaaatgcatcatatatggaaatgccattgacaaatatgtctcttaaatcttctagaagcggctggaggaaaacatgaatgttatctccaggacttttgagcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgttgtttctctacacatgaacaatcttttcagcctctcctttattggaaaatatcataagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcacttcatttgttcatggatttcatattgaacaaaagcactagcagagataagtgtgatagttcacatccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaatttgatatttcaggttcttgtagataataacaatgacaaggaattgtctcttatgatcatgacgtagcaaaaatagggcaattagaaaagtaccagtataaaatcagtgtcagctaattttgtcacaacctaatagacctcctttatacactgaaacaaaagcttttactctgcaaaaatagagaagagctaaatcaatttacagaaaaaacatccagcaatctaatgtcaaagctgtcatctccaagttaaattccttactataaattacctctagttaatctacagatgatgactccagaagcacatgcgtttaaaacctatgttccaaatatccgttcggatgaacaagaaaaatctgcaggtgttattaaactcaatcagatagactcatgatgcaacaaacctgaataattaaaaaaaattgacattgacctggatctgacactgacctggatttggggccaaatggggaatcaacctatgagaagtggctaagaaaaggaccgtgcttgccgttgacccgctgtcgtcggcctcggcccgtcgccggcctgccgcggccgatcccctcgcgggctcgccgccgccgctgctgagaacgcgccgctggccgccgatgtgcgctgccgccgccgccgtcggtgtgcgccgtggcagtgatgtgcgagagcgtgagaagaaaatgagatgcggtgtgggaacaggatggggcggcgctctcgtgcgtgttgggtgaggtgagagacacgagaggagaggagagaaggtgggagactaaggttgcctgctaaactgctaatttcacagatcgtattttagttgttatgatataaacaactaaataaatcatttgataagaaatgtgattagctcagttggttgggttgcgcatattctatcctagagacccaggttcgaatcctctgtttgcatctttgccccactaatttattcctatcaggtatcagcagccacttcgcttgtggaatttttttaaaaaataaactcgcttgataaattttttagaaaacaaaaacaacacttttcccaataaactcgcttgataaattttttagaaaacaaaaacaacacgcccaatacacaatgtaaaaaaacagctcgctcaattattattattttttaaaaagcatgcttagtccaaaagttttaacaggaaaaaaaaagcaactcacttgataatttcttttaaaaaacaattcgctagaggtccgaaatgtaaaaataaatatctcactcgattattttaaaaaatacaataagttcgcttattccaaaagtttttacagggcatcaagaccattgcaaattcagctctgcaacccatgttctgcaacacatattatctattacaaattaggctcacccactactaagcgttgctagggtcgcattttggcaatgcatccttaatgcgttgccaagcatgtattgctagagggggttcttgttgtagtaacgcatcagttatcaaactaacaaagtataagtaaaatattactacgaaagaacatattgacaaatctattaacttaataaattaacagaaaatttagccaccatgtcctctcacgacttagaaattcccacaattaatcaagattaaattacactagtggaacaataacttggtaggtgggtatgatttagtggaacaacttgtaaaatgtaaaaaaaagtataaatttggtaatcacgtgcattttgataaaaacactgttacatatctatgattcatcctattaattttgttgtttgtattataagaatatgtttcgtagtgctcatcatcggaaacaatgaatatttgattagtcaaatcgcttgaaaattatattagtttgcacttagttttgacggtcattatattttttcagtttcaattcgataggttgtttcattattataaccatgcaaatgcaatacatttagacgcttgtcgagaactcgagatagcctaagtggctgctttttctacatcaacgtaaggttttcggtaggatttttcgtccgtccctttttttcgcatttttttctttttttcgccgctttttcttaggttgatcgagaaatattcaatcagattttatgggatgattggtttagcatcgtacggatattcaatcagatttgatgggatgattggtttagcatagtacggatacgagactgtttccagatattgaagacgacaatcggttatgcgagctaggcctaccgctttacatgtgggctaggtcaaatagagacaatgcaactgctttacttgtgggctaggtcaaatagagacaggccaaacagaggaaggtaacgggctggactaggagggaggtaacgggcaggactaggactgaaaagaggaagaaagacccaaaataaagagtataatgtatgctatacacaattgtttttagccgttgcaacgcacaggtattttttctagtaataaatagatagatatcaaaaatggcaaagtgcacaaactatttttaattctaatagtaccaacattgcaccaacatcctaatcctaaatgaaaattgcagaaagggctaaatagttaaatataaattcatagctaaaatagctactttggtccaaaacaacccaagaactgcttgcgaaacgcctccttgaggttctgccgggtgccgctcttgcatggctcatcgtcattgtcgacgctgcatttgcagatcatcatcaggccatgcaggtcatccggcccgagctccgtggacatcgtcgccgccgccgcggcctcctcgacgacggcgacgtcgcagtggatggcgaactcatcatcggtgctggaccactggctcgccaggacgtcgtggcggatgaacgtgaagcagcagtactccgccttcccggtgccgtggaacgacgtcgcgtagctcctcacctcgttcgtcggaggcacgcacggctgcagactgaccatgcggaaccggacgttggttcggatgccgccgccggcggcggtggcggtgccggggtcggcggcgtggagcttgaggcacacggtggagtagccgttgcccgaatatttatttgctcgagttggggtggaagaagaagctccaggtgtgacctgcggcctggaacttggacgactcgatgtcgtatttgctgccttggtgagatttcttgatcgcgttgcgtattttgatcttgagaaagttgcaaccggaggtggccgccgaagtagaggtggccgtcgacgcggtgacgacgtcctttgtcggtgacgacgacatggcaagctaactagcagctacctggtggtgtgatggaaataacatgcttggagacattgatcatttcatcaatttaaatgcctaatgcttagccgcacgatcagcatgtgttggatgaaaagatgcttgcatacaacaacatctgctgatcgagtcaatcacctgaagacttagttctcacgtgaagagagaacgtgtgcttgtggccgtttggcggctgcgtttctcacggagccgatccggctttgacgcggaggagcaacggattgagcgtgggctgctgttcagtgttagctctatataggagtcaaggagacgtccttgaaggatacagaacacaatagccatctactctgaaattcctctactgccgccgtgttgcgtcgccgtcggtccaagccggccgttgtgctcgtcgtgcaatgagcatcccggtgagcggtgtctccgagccttcgccgcattcgcacctgcacgggggcggtgtaaaggtttctgggcaacgtatttctacgcggccgctcgacatcatcgattgactgcactgcttcgactcgctgatctccgtcgatccattcagtgagtgaattctttcgtttacaaaggaaaggaatctagttttgatcgtacctgagttttatatatgcatggtactgttcatctagattaaaatattgtggctagattaccattgtgattagcttaatgacctacttagcttggttatttatgccttgtttgatatctagcatgatagaatttatgagtttttcttgtcctatcatgtcgcaagtaggttatgcttgctgtatgtgctttcaaataataatgcttggaataaaattaatggctaagtatgtattatttccaacagtggtggtggtggtggtcgacggcgagatcaatcggggacgaagaactcgatgcagggttaacgttggttaaatagattataggagaggtaattaaccacacgtttgacgtacgtacgcccggctatatgccctatccgtattgtagtttggttcggatcatgtatagaagaaaattaagcctggtaattatattagtagtatatctttatcaacttcgataaagcagttgttactgggatatacgtacgaagcagttaatatgcaacacaagttactacagctattaggtcagttaattttagttgggttccgatcggatgcaaaccgttacaaacagttacgtttagagacgggacaatatcaggttgttacggtagataggaatagttttaatgtttccatggtacataatccataatccatgtttgagtcggttataaaaattgaagatgtttttgggttcgttatacgtgtttgagtcagttttaattttatgttttggttttaatctatatgtcctctctatctctctcttattataaaaattgaaaatatttttgcctattttagtacgtcgtctgtgtaagtttttaagtttgtttgcttttggaaatacaaattgaagatgtttccgtgattcgtcatccgtgtttgagtcgattttaattttataatctatatctcttctctatcgctatctctatcttttctccactattataaaaattaaagatatttttgccggtattttggtatgtcatctgtgtacgagtcggtttttaagttcatttgcttttggaaatacatatccatatttgagtcggagtcggtttttaatatcgtttacttttggtaataaagaaggaaacataaaaaaaatctgcttaaaaaactcgtatgctaatttaagacgatcggactccgaactgcagcttatgattttgtaaaacaaatataaatccaagcgaacttcgacagtgaatttcatcttaactaaaccatataacaattataagattaaaatagacttcacccgttgcaatgcatgggcatttttactcgtggattaaaaagtatggtaccgaagagatatcttttaaccagaaagtacgtactggataagttattacactatatatatatatctatatctatatatgtactcatctaccaagtttatatagtgtagacgcaaactactcactaataaaaaaagaaaacaaataaagtccaactatatatgcaatttaaaatatctcacattttgaataacaattaaaataagagtccatgtagaaattctatttagcaaaaactgaaattgtgattaaaaattaagaaacaatgaatattgagataaaaatccatgtagagatataatttagggaaaaatctgaaatgcagattaaaattcaaaaaataagtaatattgagacaagagtccatctctaagtctctctgttcctaagtcctggttcccaactccctccgcctagttttccacgcgcacgcttcccaaaattgctaaacgatgtgtcttttttaaaaaaatttctatacgaaagttacttaaaaaatcatattgatctatttttaaaaaaatagctaatacttaattaatcaatggactgctccatttttcgtgcgcaggagatgggttaccacccattccagtgaacacagccaaaatacaatttaggaacatctaaaattaagattaaaaataaataatattaacagatatagtccatctcaaaaatacaatttacaaataagtaaaactcccattaaaaaaatattatggcgaaaagaattcatgtgcaagtacaatttcgaaatatcttaaatccaggttaaaataaataatattaagagaaagaatccacatgtaaatataactttaaaatatcttaaatataggttaaaaataaatattatagagagtccacgtagaagtaaaattttaaaatatatataattcaaataaaaaataaacgtaatagagaaaagagttctggcagaggtacaatttagagatatttcaaattcagtttgaaaataaataaaattaatagaaatggtccatatagaaatataatttagaaacaatttgagctggagttaatattattgggaaaagatttcatgtaggagtataatttaataatattttaaatctacattaaaagtaaataatattgacagaaagagtttatatttttttgaacgactcacacgagacagtgcgaagttctattgatagagcaggaaaaaaattacaagactacaaccctggagggtcataaccaggaaaaaagaaaaaatataccaccacccacacatcgacatcgccaacacaccagcccaggagaagactaccaccggaccggacgccgctaagcgtgaccgaccgccactagaccaacaaggggacacagacggtatcacccctaggggatgccaaaacgacgtcttcaagaagagaagcgacggagaaaccgccgccgcagtctatcgggactcaaaggagacaagactgggctttcacccggcaaccaccctttgaggggtgagacagaacgacaacgccctcaggagggggaatgaaccatcgttgtcggtctggcagaggccggactgggttttcacctgccgctcaccacctgcgaatccacggctaacgcaccgatgctccaccaccatacaagctctaccgacatgtggggcccctgcaccggcgtcccccgccggccagccttcgagcaccgaagaccgcgccacacccaccgacagctcctccttacacctaggtcgcctcctccaccgccagccgcacctcccgcgccaagccggcctcctccactggacgcgcctctcgcgccaatccggcctccctccatcggccatgcctctcgtgccaagccggcctccatctccaccgcccgcgcctctcgcgcggagtcggcctccgctgccattgactgcgcctctctgcgccaagccggaatccaacccctccaccaaacgatgtcgcgccggccagatgcagccgtctgccatgccctcggctagccgtccgagtccgccatgcctccggtgaccgcagacgcggtcatcaccaccgcagccactgttgccgaacgcccagccacctcgccgtcaccatccttacctcgctccctactcctttcccgcctccattgctatcgtcagcgatccgcatccgccaacgtcaccaccgcctccacggccacggccgctgtcgccgctgccaccgacgccagccatcggctctgcaaaccgctgcgccgccaccctccgccaccaagcagccagctcgacgtcgccgccatgccctccgccgccgtcgccagccgacgctgccgccgtcctcaccgcgagcagcaaatgccgcgagcacggccgccgccgctgtcgccaactgccgctgcaagcaccaaatgccgcgagcaccactgccgctagcaccaccttgagcacgtgttggtattttttaacgacatcactagaaatataattttggtatattatggttacagagttcatccgcaagcgcacgaatataccattgtagcatttcacccgagagtattccaagggtatcgtatttattttatcccgtggaaagatcatgtagagagaactcaactaataatttatatattacttgtgataatcatattctaaacaggggttaagataatccaagggtagagtgacacacaagcattactactcatcctcataataatttatctaagctaagtggaaagaaaagagaaaagaaatctactcctatacttctagtatacatgctatacatacattctagttaactgatttactagctaataccctctatccgatgccctcctggtactttgagaagccacccctgattgccgagttccttacgacagcccgtcatgactatccaaccagggctaaatacggaggaataccctccccaggaaattaacttaggattacatataggcgtggaggaatacccgtactgagctgtcaccatcagcagcccacctctcatccgcaatatataaccccaaataatgatatcccgtaatctagacaccacgtctaaactaccagatactactctaatatcatcgtcatgacatagagtaattgcataagcaaacactatacccgcaccaaagcatctcccagataagctaatcgtacattcagtataacatgaacataatgtaaataggtactcatatactcggaaagtatttcaataccataaatgtatatataagagtattctaataaaagtacaaagcttacaaaagaggaaaggaaagctgctagagctatacacgaactcttctgaaggcttccagactcctgactcctattctatttctattccaccagttagatactactaaactaaacttgagaggaaagagagagctcttgcttgaggtgtgtgttgaggtgaagagagtgagctccttatataaaggtggttatgacggttgtggaaggggaattgtccgaagtaccccgcaaccgccatcaggagaagatctggagcgtccctgccaaaccccacagccaacggtggagaaatgggttcggacgaaccaccaggtgcggccgaaccatcaggttcggccgaacctggggctggctcaacgagcccacaatttggctggtggcctcctggacttctcttctccacagacttgtgaattttggcccagtttgtcgtgtcaattctgagttcttggcccattcatacacaagtctgattctcgacatcgtccgattgatttatcatttgatttgatgttgattctcctccattttattgttattctctgcaaaaggttagtatacctaatactagtggaatattattgctctcatatttttgcattgcaagcatcactagttctctcctattttagtaatattgacggtagaaactgatcgataccgaccgtcagcagcacaaccgccgccgccgtctccaaatgccgccgcgagcaccactgctgcgaggaccaccacgagcacgatcgccgtcgccgtcgccaactgccgcgagccccaccgcgagtaggaccgccgtcgccagccggccaccctccagaccgaccgagaggcgcggatctgggggacatcgccgccatcgccgccatcgccaccaccgccgccatcgccatccccgccgccgccttcacgtccttagccaccgccgccgcctgcgcgccctcagctaacgccatccccgtcgccatcgccatctccaccgccttccaccaccgccgcccagcaccacgtgcccctgccttcgccgtcgccctccccgctgccagttgccaccccgccagatccggctggagcggcctggatctagcggccaccatcgcccgccgaggacggctcccccgcccgcccgaagcgttgtcggtgagaggcctcgccgctaccgtccggccgcttgggcggcggcgaggcggagggggaggagggggaggaaaggggcggctgggtttccgcctcccgtgccgcccgaggggaggacgacgcaagaggccttgtgtcttgtttgctcatattaattgggaagcagccaagcaggagcatatgcacgaaatgctaccactggtgacctatggcggcaggagaggaacacacaactggctaaggccaactagcatggtgaaggtcgctgccagtgggattggaattgggatcctctgatgtgaagtcagaggaacgtggtgactgacatgtgggccttagtttatgggcccaccggtcgaaacatgaattcggcaataataaaagcgggtagcgcacgagacctaaaagtggatggatgcggagacaaggatttagacaggttcaggccctctcaatgagaggtaatacgctactcctgtttggggatttgaatccaccgggtgtagtatagatctgatgatcaggtgtgtcatgccccctagagggcctcctgcccaccttatataggatggggggtaagattacaagatagaaaccttaaccaatacggtatcggtttcctaaatctattttacaatattatcaaatcaagactttaggccgctccataatataaaaggaaacgtaatacccaagtcatgatctgttacatattccatagatataagttatcccctatgactagtcggataaccatgccgtgtgggtatagggtacccataatctccacagtagcccctgagaccttcacagtcgaaaagataatattctctcaaactaattactccaaagccgagtgcttcaatcatctttgccatggtctcccgagtacttttaccaaatctaaagactgtggagggttgaaaactaaagtcaggtgcatcgactagatgcacctaataggtgtagcccccgactatgtggttaattaaacaaaccaagcatatagtcaaggaataaataatccaaccaaccgagtggtttcgataattgtagtcaaccaagcgacttgatattaatatgtagcatatgcggtgtgaatccccaaataatataatccaagtgatataccgacttctttgtaaaaattgatacgagcaacctaaagttgactacatcattgaaaattcacatagcaaaatagctataaaaaagcttgaatgctatgaataaagaaatttccaaagtatcaggcatacgccatgcgcacactgctttaacagatatgcttaagtccctaaaagacacatggtttcaccacactcggaaatatacggcatatatggtgtaaaatccgagtaaataaactcataaaggatttaccaaccgcctggaaaatgaccaagatatataatcagcctaagccataatattggtcaataaaaatgcacacttacgtggcaaaaagcaatgatattgtatccaatcaattgcttaaaaacccaaacagcaccttgacttatataaaaaagtcagcggggcagctgtataaagctttactgtttgacaccttttaagatgcataataacaactcctaaaaatttgagtaactgcggtataaaaggattttaaagcattgggcacttgatcacgcgcactttggcctaagcaaaaagtgcctaagtccctaaaagaacgtgacaggccacacctgaaaatatgggctgcagacatattaagcctaggacaaaaaatatgccttcgaaaccctttaaaggatgacgcatgtaacatgctcccgagtaataaatcttccgggttatatagaccaagtgtagctcgtatgaatagcttctgatctgagtgattatcccttataggatactccaaaatagatataacaattgaatcccgactggcgcaagtattcggttgataacccttacgggaaataataaatagtccagtctttgagcatagaaaatagacccatgatcatgaattcatgttgcatgtatccggaacaagtccaaattgaaggtatgatacttgtgtttgagctaataagcccctgagtatatagcttgtccttttgtcgtaatcataattgtccattgatggtagctgacacagttggcatagagacaagacgaccaatatagagataatattgcccaccagaggtggcaaaaatattggtggtagtgaagatagtgataccatcaaaagtgatgaagttgcacagccgtggagatgaagaaaccagtcggcaacaatcaggtcagccaataatgaagatgaaggcgcccagagataaagttgtgtagccatggcagcgaaataatcagtcggtgacagacgaggcagatcaaagacgatgacgaaatccaccaatcatgaagatgaagaaaatagtcggtgacgacaaacgcaaccgacaataatgatgataagcagcaacagagatgatcgactatgatgacgaagttgcccatcaaacagcagtagcataggctatgttgaagaagcttgacaggatattgatgaagatgacgatgtcggtgatccagtcaatagcaatgtagcaaccaatggtaatgatgaagacgctcatcagcgtttgcatagtagatcaaccgtgaaggcgaaataacaagccgacaatgacggaagtaaccggaggcgaggacgtagtcatccattagcaacggcagagatgtcacggccgatgaagtagaggtgctggtgatgaagtcactgacaataatccatcaaactgttgagaagatatcgaagcttaagtaattttcttgatgtgtgtataatgaagattgatgcaacaccccttgatttgtaaagatggcagtagaacttggagttgtagctgttgcagatgcttcacttaaaggaaagtaaatgctgttgtccaactcatcgaaactgagctgattggttgataactctaaactcccagacatg

SEQ ID NO: 21326 - DNA, 5340 bp, Oryza sativa
aactgaacatagagtcgagaactgtagcttcttgtcgtcgagtagtcattgcaatcaaaagtgaagatgcatgttgaagatgtccgagtaaaaatattgaagatttgaacaccacttgttataataacatgacatcatatttagtgacgcatgccaaaatgtcgaggctcatgtagacgtcgtggttggtgaagtagcaaaactcgcgaagtagcagcaatagagtttgccggtgccgaagataataaagatgaagtcactccaccatgatgacaaagttgcatagtcgtgatgaagtgaacatgagtcggcggcaacataaccagtcggcgatggaataagtagaatgatgacgaaaacgaagacgtccttgaacggcagcaaaataggccagccatgaaagtgaagacaccatgggcggcggcaaaggcaatccgatgatgatgatgatgccagtcaatgttgacgaaaacacgtagccatagaggcgaacaagccagtcggcgtcagacaaggcggccagcaatgaagacgatgacgtccatcaatagtggtagcggtatataccagccgtagaggcgagggcactagtcagcagcagacgaaacgaccggcggcgaagatgataaggccaatcaacagtattagaatcctgcagccatgaaagtgaagaaaccagtcgtagacatagacaacttgagttgaaggtgatgacgcatatttgtggtggcggcgacgtggccagccatgaagacgatagcatcaattagcgtcatacgaagcggccggtcggtgaagatgtaggcgtcaacgacggcagcataataggccagccgtgtaggcggagacaccagtcggcggcggcgaaggcggctggtttgtgaaggtgtagacgcccaacaacggcggcataataggccagccgtgcaggcggaaacaccagtcggcggcggacgaggcgaccgatcggtgaagacgtagacgcccaacaacggcggcataataggccagccgtgcaggcggaaacaccagtcggcggcggacgaggcggccggtcggtgaagacgtagacgcccaacaacagcggcataataggccagccgtgcaggcggtgatagcagtcggcggcggcgaaagcacgctggccagacgctcaacaacggtggtgtgaccaaccaaccgtataggcgaaaacaccagtcggcggcgacgaaggtaagccggttggtgaagacgtagacgcccaacaacggcggcataataggccagccgtgcaggcgaagacagtcagcggcggcgaagacaagccagtggtgatattctgactgatccattcctgaatcgtaggagataagtttaaagctatgaatcccttttatgcatatctggatctggatcttacagaacaaacatataagatgagtagtatctgatgtaaatataatactcgaggaaaattcaagtattttaaaatgtttataatatgtatttctcttcttgtcaattttgatttccccgagcagatgactccgtacgtttaaacactctgcctaactagtcatagcccccaagcatcgagagtcggccaaggcactttccagagatgcaaatgagtgacatgagttcgtcattaatgaaacaaagtttcacggatcagaatttactcactactggagagggaaacactccgtagtgccaaaaacacaccgcaacacacaaaaaacactccgtaatcaggttactcagtgccacactccgcaattttcaccagggagtgatgttgtcttcccgtgcatcgtagcggtgtgtttttatgcatacactccgtaaccatccgaaagttacgtagtgccgtagaaactcggtaaccttttcagcacaccgtccaccggaactgaacagcaacaaggaacgggagacggagcgtttgcacatgatagcacacgttaactttacagggtgtgcgcaaacacaccgtaagttttccctggttacgggtgcagattagtggcactctgtaacattttaggttgttaccgggtgcctcagcattttgatatttgaggggcaaattaataggaatatacagcttcatttctattaattatctatagcagaattccagcatccatacacatcacatgcagttacacataaaacacaataatggatttaaatgcatttgacatgcatgttcattcaattaatcaatatgacaacaatctgatatgaaataataacaatacaaatctcagaaacagctacaactgagatgaaattgagcactatcttcaaccagtataagcatgggcaaccaaaaggccgtgcaaccagaaaaaaagcttagacgaacagcattgccggcagtctggaaaaagaaaaggacttaataaccatcaatcattgtctgtttttcatcctgggatagcttcatcactctaaaatggatgccactatcgccatcagccatgatgtaaccccagcttttaccattagctatagtgtgcttcctagttttccatgaaattgccaattgcttagctcaactaatgaagtccatatgactgcagcatcaggaggtgaaggatctgatgattcacaaaacaaattcaacatcaaaatcccatacatcaatactatgttctgatattaagaaagaagtatacattgttacttagttctggtatgtctttctagtgcttacctttgccaggagcctagaactaaagcagtgtaggtcacattaattgttccaaaggtacaaattagttcttacaaagacacccaatagtattcatgctaaagagagcaattagacatagcctagatagatgaatttactaagacaaccagagagtaacttcaaaaaatttcagaaaacctcggcttgaaccagtgaaatgctaatgatctagtgctaactagctatatgtaaacaaataacataaacactacctttacaaaaatcttaggtattgttcaatgaagaattgtactatgcaaactactatttgtaatggtattgacgaactgtaatatcggaaacattagtgtaagcacatcaccaattatgatttctaacctggaaaaaaatgtaaagggacgaagagattacacttaaatcgttcctgcaacatcattgtcagaagtaattgtgatatgacctccattacatcctatcagaatttccttacctgcatatattttaaacaaaaggttagtacacttgtgaacttataattctgatcagcaactgcagataatttatggattggttgcaccatgtatgctacctatcatattgcagtcctctgagactcggatgtcttcacgaccaatggttgatgtctacacaaagaagaaaaatataatataccaaatcgactttagaattggatcgatgttgttccaggttgtctaaaatatctgtaaggatccttgcatatcttgatgtagctgctcagtcagtagtaaagcttagaagcataactttaatactgatatacatacacccagccctacaggccaaagatgcaagacttcaattactgagatacatacacaaaggcctagggcaaaaatatggtatttgattacagaaagacatgagctgaagcataagcaagcatcctctaggaaaaaaagattcttgtggaaccaatgcagacaaaatctgtcattagaatcaccactgaagaagcgaattttaaaatactaaatcccgctacaaacatcactaagcaaaaatcatgtgcatctacattctacaattttattattctctattttcagaatatgcactgcatcacgaactaatcagccactaaatctcacatcacatccattcactgtcatcagatctgaacaaacacaagatttggcctctacctccaccccacaagactacatcccctttgccccatcagcaaagaacagccaggagcccatcccaacccctctccccatccccttagcccctatcagcaagatgcaaaagaagaagaggaaacattaggagaggggaagaggaaggaggggaggggcaagacgacctcgtactgttgcttccttgaggctgtaccgcttgtgactgccgttgcagctgccgcagagcacgtagcgctcgccaccgcaccggctgcaggcggcgagggcggttgcgccggcgccggctacaacgcgtcggagctcgccggactcgtggaggcggcggacctcctcggcgccgccgaggtggcggccgccgacgaacacctgagggagggtgacaccgcgcgcgcgggggaggagcgcgccgagctcctggaggtagcgggggtccatggcgaggaggggtcgacggctgtcaacggagaggagaggagaggatagaaggggaagattaggttggtcaaagtgaaagtgaaaatatcaggaggggagagagaagaggagatgagatgaaaacatttgaagccaggaggaaggaaaaaaatattaattttaaaatattaaaatttcgaatcgaattttattatactaaatgaactcatgtgtaaaagttgtcaaaaataaagttgtagaactcgttgaaatctaccatttttcttttggtcatttttccatccgactttgattaaactatataaaatttaaattttaaaatataagaaattcaaataatttttcgagtagtaaatgattttaaatgaaaaaaattgtcaacatcaaaattgtaaaacacatcaatatctacaacttttgttttggttatttttctatatgactttgtttcaatagtttgaatttgaatttcaaattatgacaacttcaaacaacgttttcaaatagtaaatgatttcaactgaaaaggtcatcaacaataaagtggtataactcatcaagatctgtgacttttattttgatcatttcttcatccgataaagcgatttgtaacattgttcataaaatgtacatatctcttatatagttttataaactatcagagagatatgtaaattttttgaaaaatgttactatcactttgtcggatgaagaaataacaaaaataaaagttatagatcttaatgagttatataattttgttgttgatgactttttcagctgaaatcatttactgcttcaaaatattatttgaagtttagaaattcaaatttttaattaataaaacaaagtcacaagaaaaaaaaagccaaaaaaataatagcagtaagaatataataacatgatagaacatgattttagaaacatttagaaaaaagaatcatccaatttggagtttatatgagtgagataaattgagaaaatatgtagtgcaaaccacatatacagtggaaactt

SEQ ID NO: 21327 - DNA, 7757 bp, Oryza sativa
  unsure (1)..(7757): unsure at all n locations
attcctgcagccctccagccacacacacgatatgacgtttctacccctcacaagtgcaagtataatgcatgtcaatgaggggtagaaatatcatatcatgtgtgtggctggatcaataacgataaagacgggcggaaaaattgacggaagtgctaaaaatggaaatagggtgaactttggatgctattaaagtgaaccggtaactttcggtgctataaaacgaaaaagtgaactttcgatgctatataaccaattttgcctttttataaccctccagctaaacatgtggcccccaccactatctgctccgttatactacgttacggttaccgtgtgtgttatgcaatagttcaccgtaagtatcaggtgccgtcatattttctgctattgttctgttcccgcccaaggttttcgttcccgcgccattcccgcaacagaaaatgcatgtgcgccaaaaggaacagccgtgcgcgccaacgaaatatgtcggtgctgaaggatgcggggcccacgttccctggtgtaataatattatagcactctgtattttccctgtgttccccagtgtttggactgaacgctacgtgatagaacttgttgcgtagtgtttctctaatccacccggtaatttacagagtgctaaatgaaacactacgtaactttttgctcacactcgggagtgtctcccgtcctggtagtgactactcgggtacttttgcaattcttaagagcagaaaataaattatcttatctctatgtttttgacttttcccaagtaatacttagcaccttgcgttactcggtctatccaacgagcctccaggtgctaggaatcggcctaaaggcaattatccatcgacaaaccaaacggaaagcataggaagatagaactccataactcgataggcacttttgtactcaaattatatcacaagcaatcaagataaatattatgaaaattgttgaaaatataatataacatctgtagcccccaactcactagtcaacggcgaaccaattgatgtagtgaggcaaaggaaaaggaaaatatcatctaaagaaaattaacgatgacttagctttataatattccccttggtgatggcagaggtggccaatgtaggaacaaagtcatccatcaatggcaatgaaaacaccagccatagaagcagcttgaggcgactgatgatgaaaacgaagacgcccatcaacagcggcaaagtccgccaactgtataggcagaaacaccagtcggcggcaatgaaggcgagccggcggtgaagatgtagacgcccaacaatggtggtgtgaccaaataaccgtataagcaaggacaccagtcggcggcgacggaggcaggccggcggtgaagacgtggatgcccatggacggtggtgtgaccaaccaaccgtataggcgaggacaccagtcggcggcgacggaggcaggccggcggtgaagtagtagacgcccaacaacggcggcataataggccagccgtgtaggcggagacaccagtcgacggcggtgaaggcaagccggttggtgaagacgtggatgcccataaacggtggtgtgaccaaccaaccgtataggcgaggacaccagtcggcggcgacggaggcaggccggcagtgaagtagtagatgcccaacaacggcaggcataataggccagccgtgtaggcggagacaccagttggcggcggcgaaggcaagccggtcggtgaagacgttgttgtcatcagcaacggcggtggcgaagacaagccggcggagtagactcgtggccgattgaccgcatagcgagacgcctcgagtccatgaccggcatcaatcgccccagtagtgccgcgcaattatatgcaagtaacaaaaacaaaaaatatcaaaagattaatatgatatttaagaaatctaatgaacaacaataagttggaagggaaaaatcctggtgatgtcggagtttaatgcccacaagcaaccaggaactccgtagaacttgggcgaccatgtgcatgacgatcaaaacttgggtgaaatcgcgcgacatcgactcgccgccacaagttcatgcatttaaaagaagaccaacagattagacgagagcatatacatatatataaatatatataacagctgtatgtgcatatatgaagaagattgatctctgcttttgccatgagtgtatataaagcttctccctgttggttgatgtgcttcaagtcagcatgtgtttccttctggtaggctcggcagtgtccatcaataggcaccacatgccatcggctcggttggcatttagggtcacacaagcacgagaaaagtttcgtcgcttgaggacacggcagaaaacttcgcctccctctcagccgaccaacccatgaacacaagaaaataccagaaagttattctggaattaaaaatcaatctaaaaataataatagattgaaacaacaaacctggtgatatcgaaaattggttccatcgcacttgttgacgggaaactcgacgcacccctacctggcgtgccaactgtcgaaacatgaattcggcaataataaaagcgggtagcgcacgagacctaaaagtggatggatgcggagacaaggatttagacaggttcaggccctctcaatgggaggtaatatcctactcctgtttggggatttgaatccaccgggtgtagtatagatctgatgatcaggtgtgtcatgccccctagagggcctcctgcccaccttatataggatggggagcaggattataagatagaaaccttaaccaatacggtatcggtttcctaaatctattttacaatattatcaaatcaggactttaggccgctccataatataaaaggaaacgtaatacccaagtcatgatctgttacatattccatagatataagttatcccctatgactagtcggataaccatgccgtgtgggtatggggtacccataatctccacaccacctgttagtgaccacgtcgggggaagttcatgtcagaggatctgcttccgtgggattgctaggagggttggcgagtagatgatctgcggttctggttgatctcctgttaatcttctcgtataaatggcaagatggacaataaactgaacggccgaacttttgagccgccaccgcaggagtgcaggacgactgatggtttggcaaaagtgatggaattgccaccacatctgtgcgctgtgttttgcattttgctgggatgtgctccctccctggggcagtttggactccttatctgcttttagtttctttattagccttctgaactatgtagtgaacctgtggtagtttgcatttcgttaatgaaatgggggagcaatgctctctttctcaaaaaaaaaaaagaaaatctaccaactcactttgctatgtcaatcgatccactgtgttctgataatttaagagatacttcgatggatttccattgatatgctgatacttaatatctagttaggtcaagctgtcaactgttgaatgctgggtacggctagaacgaccaatgtacgctgatgttttctagtggcacatgcagcctacatgtggtatacacaggttgtgtttagtttctgaaatcggagagaagtttggggaaagttggtagtttggaaaaaaagttgagagtttatgtgagtagaaaagttttagatgtgatgtgatgtgatggaaagttgggagtttggggaaagtttggtgtgaactaaacagggccacagtgaatttaatcattgacaccctccgctgtcgcgcctgtcgatcctccgctgctcggccacactccggtgcccatcaatccttcggtatggtactgcacccattggggctacacagcagcgcccatcgatcctccgccgcgtgtcctctcgcttgttggcgcccgatgaccccccccatcgccacctgtcaagcttcacctctttgccgattcatcaccgtgcgcctgttagattgtagttgatggctgccaccaagctttaatttgcatctgtttcatatccaaaaaagaggagctcgccggtgctatgggccgccgtctgctacacaaagacaccactggaaaaagcattttcgctgatgttgggtatttttttcgcagacgggtatgacaatcagagtaaaatccccaccagcgaaaatgagtaccggggaggagttggccgttcgccaacgaagatagattattgcaagcggaccacataagggagccgcatgcaaaaatcatctttgcaggcggcacacatatggacccgccggcaatattcacatgcaggcgggctccttaggcggcgccttatgtggtccgcctgcaaaaatagccctataaagtcttcttcttccttgagccttgttcatttcattcgaggtttctttctcctctaacaccaaaaatatatgggagaaggttttgaagttcaaatcttcgggggatttttctatggtagttagatctacacctttccactcttgttatgcattttcttttaataatttcagacctctctttgtgatggatctatgcatgcaaaattgtgaagaaaagctcaacgcttttttcttttcattttttgttactttcctttgatatgtttgtgcttgatgtgtgtacactacttgatgtctcatcctctagtgatttaatgtgctaatataaagtcccaaaattttttattttgccctcacatccatcttctagatttagataggagagagaacaaaaatgtccatctcttaatatggtccatgttaaaaatggattttgctcccatctattccctcttctttcatgtacattttcccacttttgttggactttcctattatattaatttggtatgtctctatataccaaaaataaatataatttgtccatgaaaaatatataataattattaatagttctctatcatttttagtgaaatgaaatttggtatggctatgtaaaaaattaaatgtactatgttttcaaatatttgttgttcattttttgtaatatagttgtacatgaaatttttgtagatatatggataggaaccaatggatatatcattcgttgaggtttttggctccatatatggattaagtgtctaaatttattggtattgccaaggaacacgctgaacagaacaatatgacggggattctttgtccatgtgttgattgtatgaatgaaaaagcgtgggaagatgttgcaaaagtaacggagcacttagtaacttgtggatttatagaaaagtacgaaatatggacacatcatggcgaacatcaagtggatcggcccgaaaaaagaagttccgccagaagttgaagacatggagtacgccgatggttgtggtgaagacaaaatcgatttggaggaaatgttacgtcatgcagatcctgaggtgctcattgggtcggctagaggtttagataattttgatgctttatagaaggcagcgaaggatgttttgtacgatgagataaagggctgtgacagtgagttctcaacattacggtcagttcttgaacttatgaggttaaaggtgagatatggatggtctgatagtagtttcgacggtctgcttgaactattgaagaaaatgattccgaggtctaactcattaccatccaacacatatcaagcgaagaaacacatatgtcccctttcacttggtgtggaaaagattcatgcatgcgtaaatcactacatactctacaggaaagagtatgcttcattggataaatgcccaacatgtggtgctagccggtacacatcaaataccaatacttgtctagaagagtctgacacatttgagggaactaagagaaaaatcctgcagcttgtgatgtggtatcttcttgtcaaaggctgcattaaacggttgttctcaaatccgcaagatgcggaactaatgcgctggcatcaagaagggcacaagaaagatgggatgctctgacacccggtgaatgctcgtcagtggatgcatctagaaaagaatgtgtttgacaacgtaattggaacattgttggacatagcaaagaagactaaggatggtctgcaagcgtagcttgacctagtcgagatgggaattagggaagagttacaccctcaagaaggagagaagaatggcaaagtatatcttccaccaacttgtttcacactaacacccgaggagaaaaaggcattttgcaaatcactccacgatgtgaaagtgcccataggtttctcatcaaacatcagtcgactagtctccatgaaagatttgttggtatctggttataattcgcatgtttgtcatgtcttgctcaccgtgtttcttgccattgcaatacaggacataaaaccagaacatttaaaggttgctatcgcaaggttgtgctactttttcaatgcagtctcatagaaggtcatcagttaggaagagttatcacttcttcgtacattcgcacatgagacacagtgccaacttggatatgtttccctctagcattttttgatacgatggagcacctcatcgttcacatagtgccccagataattgcgcttggcccgttgtacctccatcaaatgtggtcatatgagcgttacatggctattttgaagggctacgtccggaattgcacccatccaaagggatcaatggttgagagttacaatacagaagaggttgtcgagtgctttatcgattacctcaacaatggaaagacaattggaatacatgtacctcgacacgagggtgaattgactggtagggggaccaaaggaaagaagagattcgtcgcccatgattacaaaacacttcgagaagctcacttcagcgttcttcatcagcttgctattgttgagccttacatcgatcaaaacatcaaactactaagatctaacaatacgggacgcacaaccaagtggatcatgaaagaacacaagcgtctcttcatagatggagaaccaccgaggaaataactatgaaaggttggcatgtggtccatcaagtatagtcaattattgggagggatatgacattaatggatacacgtttagtacaagagctcgagatagtaagaccgtcactcaaaacagcggtgtacgtgtggaggaaattgattccctaggagaaaaactatcatacttgggtttattgaagaaatctgggaaattgactatggactcatagtgcaattccccatatttaagtgccagtgggtaaaatacccaaacggtgtcattagtgacaagtttggtcttactgttgttgaccttgagaatgtgggtcacaaggatgacccttgggtactcgccaatcgcatggcccaggtgttctatgtgacagaccctacaaatttgaagaaagaaatagttccatcaggaaaacaaaagatcttgggagtggacggagtcgttgatgtcgaagattacaaccagtacgatagtatggcactgtatactcaatttgtacaaaagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcag

SEQ ID NO: 21328 - DNA, 3102 bp, Oryza sativa
  unsure (1)..(3102): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcaaactctttcaaatttaactaagtttgtatataaatataatataataataatatttacaagaccaaattaggtaactacatctataattaaatatattttcataatatattagtcttaggttaaaaatattactccctccatttcatattataagactttctagcattgtccacattcatatagatgttaataaatatatatatagtagtctgtacatccacattcatatagatgttaataaatatatatatatagtagtctgtatatatatttattaacatctatatgaatatagacaatgctagaagtcttataatacgaaacgggggaagtgctactttttctaaaaacttgatcaaatttaaaacagttttactttaatcaaaattaaaacgacttatagtctgaacagagggaatagtatttatttgcatatttgacggcgtcagcttatacatccatggtttgaaactaaggatacaaatatttatttcagcaaacatgcattttaggaatttaggtcttccaacgtggaacctcatcgtccttccgatattatcactggcacatttctctttgtcataggattttatgctaattaatgagacaaagtgagacttaagatccatgatgtaatcaagaggtaataatttatgaaatagatagtaatgatgctcgaagagtcgtagagccttcgagatgggattaacgtggtagagttaatttacacgttacatcttcgtaaataagtgtactcgattaaagagggtataaaattgcagagacatgatgtatgagtgagtgactataatacttatggtgccatcggttgtcctaatgttaattacaagtcatacggtttattagtaaaaaattataagtaaaatctttataatgtgttcttagctattttaaagtactagaaagcaaaactatgagaaaaaaacttacaatcaatttcaaaattaaattaattgaaattttgatggtggctataagctgtagggatgggagccttataatttgggttatagacccaaacataattttgtaccagactattttcattatttagtctctaggatagcagaagcaggtgtaatctgtcaaattatttgatcttacgtttttagttaatttacaaattatatcttcaaacaatgattgcattgagtcaaaaacctcaagcatgtataagggcactgtagacatgtaaaaagagctgctagtctttacagtattggttcatattcatttgattggggagaatgatatttttagatggaattttcatcaaaatggtcaattcttgatgctttctatgtttttagctttaattaataatggttatgttgagaagaataaattcatatggaaacttaatatgccacttaagattaagattttatgtgttacctacttaaaggggttgttttgacaaaggacaatttggctaagaggaactggcatggtagtatgaaatgttgctttcgcataaaaaatgagactattcaacatttatttttgagtgtcatgcaaaatttctttggagagctttatagttttattctggtttatatactccacataatatatctcatatttttgagaattggcttgtgggagtggataaaaaaactagtaacttattcttgttggagaatccgttatttgttgggtcatatggttgtgtagaaatgatatggtttttggcaagtcaccttctatatcttatatgcaagttcttttcatggcaacatattagcttcggtcatgggctcaactattaaagtgtgatgatgatatcaagctagtaaaagttgcatatcgtaatcttgagtcaacggttatgcagcttttcgccaactttggttggagattcacaaatataattcaataatcatatgttcttcttttaggttggagttttaaatttttgtgtgtgctcctattttgaaaggagtgtgtttttagaactttgtgtgtgctcctgttttgtgaggagtgtgtttttatgtctttgttttgttagtttgagtttggttgaactagtgtaataattggctgtaactctttgagcaaacgccaagatttaattctattatctaaaaaaaagcatattgggttgtaggaaacggccgggatggccggtgcagtcaataatattagagaatttggatcaatgtgtaaaatcccttatatcttagtatagaggaagtatgttattagcgcttctgtttacatggttttctgtctatctataagagttgttgcttcgggacagtcggaaaagaatcatctacgagaacttaagtcaaaacgaaaagagcagataaatagtcacggctgcttatgttatggtttaatttctcaccttctactttatggtaacctaattcttatctcataggtactcctactaattaataatacggttttgctagctagctgtccacagttttggaggctagaaacattcgattttatagccgttcgatctagcgccatgattcgtgcgagattttttttctattggatccaaacctgatgaccaatagatgtgctacccgttggcgtgtatagctgcacgttgcctttttccagaaatttcttggaggcgaggtggcctaggcggaggcggagaccccgccagatgcagctctcggcgatttttttcgccgccggccggtgggtttcttgctgcccgcttcctcaccgatttttccccctcagctgctc

SEQ ID NO: 21329 - DNA, 4840 bp, Oryza sativa
attcctgcagcccggtttcttaatgggcccacacgttctaaacggattggtttcgtgctttcagttggttcaaacccgtttcctgtggtccgttgattacatatcttgaggtgaaaaaaattgaaagttttgaccttaaaaactgtcgacagcccaatagctaatcccttaataatataaaaataatatgtgtagaaaaaacgatgtgggagtatatcccaccactcctaggttttagggcagatatgtggacaaaaatcttaattttcaaaaagataccagcttttaaattaacaacagaacacatttaccatgaggctgcaaaacctaactcctaactcatgataacttcctcactttggcaagccgcaatcctacggtaccactaacagaatgtaggaagtagggtatcttttctgattttgagagagtggatataacatgcatctgctttttacttgtcctgtcttgtcttttttttttttttagttttgggttgttatatgctgctttaccattactttgccgtagtgaaggatgacaacactttcatgatcaaaagcacagggcatggtggaggttgagagacggggatgtgattttcttttataatgggcatataaaaactcgatttttgcttcgtagtaaggtacgtacgaccacttattataaagttctgagctcaaaatctaagtgctacagaatagaacaaaggtgaacgaaaaaacgatacaatgacactgatcaaaaggaaaataagcaattcaatgttgaaaggtcaagtctctattgctaaatctccataaaaaaattgatgaaaatctgtatggtgaatgattctaaattctaacatgcagcgcatataccctccgtattctcttcacccctttaaagttgtccctagaatcaaagcaagtgataggatgtaatggagatcaagaagaaatatagtgccaattggatctcttgtagggcgtggtggaagttaccaaatggattgatagatttggatgtgtaactcaacctgcaccatcaccagtggtatgcttgctagcacaccgctcactgaaccttttcattcatcatcaatctgttggtgctatatgacgacacaatagcagaggatatcgactagtggggtcatcgtggtcatgaaattcacagtggtaactgaaagaaaaatattatgatttacctatgaatgactgtacatatgatttataccactaaactatattagtacataaaacacactctgagctttttaaatgagacaaattaccccattgatcaagatgaatttggtcctacatgtgcaaatccatggtttctacactaaatgtgggactctacactaaacagaaggtacagaaaagtcaaagcttggaggggagaacattgagaagtgaggggatggagaacaaagcataggcatctaggaagtaaggggaagctagacagaaagaggatacgttcccagaaagaaacagatgaagaaaaaagaggtaggtctgataggtgggcctccctactttatgtgcaagccaccaccatatatgatggcacataaaaccacaaattttgtttctacttaactggtggaacaatttattctgtttcaacaacttagggtgtggtctatattatatttgtggtttgagggaataaattagatgaacataaatatagttttggaagtaaatcagacattttcctatttcaaaaataaacaatacatatatacatatactggagtggcatatatcaatatgatattttataaaggcaaatattgtaagtagcaaattttttttgtcgagaacatttcaatgtcatatatctaactaggatattactagaaaacacgcgtggcttttctacgcgcgagtgaatatataacatgaaaaatgggtttccattgaacattgagtccaatactcaatattcacggtagtaaacatcatattacaaataatctgaatatatgcataaaagaaaggtacaagagagaattatcacactgaaatggattctaaaactccctccatacaaaaaactgaattatgtagcctttagatagattcatacattgctaaagaccagtttaactaatgtcgttatattatcattttgaagcttgagaaacatatctcagattcatcccaatagttgataatatgaatgcaagcctcctccggtcctcctatcaccctggatcattacaaatgcgcacggaaatgtgttaacagttctctgaactaatagcgaaataaacaggtgttctgtaaacaaataaaagcagaaaatatacatatataccatctacatgatagtgcttcctagctcatctctgaagatatttgcaagtgcaaccagttagtattaagataatacaagattgctgctacccagccatgacaaccattgacagagtactttcgacgatcagcaaaggctgcaattttgtctggctattcagagaaccccaagttcccgactcagtgcagtgctgtcatcattcatcaagctagtgaaatactcatctccttccattctcattattacatggaaaaaaaacaagaagtttgacatgatcagtaagcaattacaacaaataaaaacctgatatttgacatgataagtatgcaacaacaaataaaaactctctttttctacttgttagcacaattcatagtcctgctgtcagatatatttggatggatatgctatatattttcatgaactacaaatcacattcaccagccaacaacaatctgattacttccaactgcttattcagttttagttgttcatacaatgaagaaaaaaattattggcttccaaaagtgaaacttagcaaatattcagatagtctgtccaagccagcaaatgaactcctgagaacacggaaaatgaagtatttgtttcacatatcatctaaccaacactaatctgcataccccagaagcaagaaccagtaacaaaaaccactcagctagactaagtgtatgtttttaactaattccacagacacttctctacaaggatgcaattttctattttaaaccacatgacactttcttgattcctcctacctaaaattaactatattgtgactccctaaaatgtaatatacgaaaacttgtaaaactctctcttctatgctcaattttttcccttaatctttgaccattacccaaactaataaacaacacaatctgttaattaagatgtgcattcctaccagcaaatttcatgcaagatccacggtaaggaagatcctactgaacaaatgcaatacgtagcaattaaagagcttaaatctccccaagatccatggtatcttgcccctgcatcaaaatccacatggcaggtagaggtagtatgcctgtgatggcgaggtggatttgcagtccaaatccggtggtgtcattcaaagtggtacagcaataaacgacgctgcggccggccgtgggcgtcgcggccgggcgacggcgaggacgaggccgtgcggcggctccgtgcgatgtggaggccgagacggcgtggtggggctgtgcggcggacacgaatcccctcggcttgccaccatcgagctcctcccccaatccagcaaccaggaggaggggacggcggcgggccggatttgagccgcagccgctcgaggagccccgtcgccatgctgccccgagcttgagaggggagaggcattgtcttcgtcggatctcgtcgctgccggcgtgctgctccccaagtccctgcgcgccgtcaccgagctcctcgcccccatcaagcgacgatgaggaggagatggagggtcgccggcgcgtgcgaggagagggcctcgccctgctctcactggggacgtcatgggagaggcggcaacgaggacgagaggagaggtgggggtagggggagaggcggccactaagcggaggaggtggcggctgcgagcctgtgacgacgagaggatgcgaagcggcggcggcggcgaggcccgtggagagagggcagagtgcgaactattttctttttttttttctttcctctcttttattaggtggggattggggagaggcggggccgcgaaagggggagcaagcgggcaaagccgccgaaggaagggacgtcacgtggcacgatttcaggagaggcaacctgaattctcgctgcgccacgtggaccaatcaaagaccagggtttggacccgaaaatcggtattagagatcgctagtccaagatataaacctaggatattattaatatatcatgcaaaacaaggtattgtacagtaaatgattaattcatgggggcactcttataaaaaatttcatcgggtacgaacattctccctcggaatatgtctgaatttatagtaacgtgttatatgatatatcaaagcggtagccgtacagaaatgcttctcgagcggcggagctcaaggtgggaatcgtcgtgtactgtacgaacattttaattaaaaacaaaattgagtatatcgaaggctgagttgtgaattcgtgacttgtgaaaaaatccaccacgagtgcaggacaaccatctcacgcaagttgtcaatatgaatttatatatggcgcaccacgcgtcatatgcagatcgtgaaaaagaagagaagcaagattaaggccaaagataaatataggaaaaagtatgaattctccccccccaaactattacagtcgtctgaattaccccctgaaccacaaaaccggacattcttcacacccaactatacaaactggacgaattacccccctcgacccaatccgcggtggttttggtttacgtggagctgagttagcattctattcattaaaaa

SEQ ID NO: 21330 - DNA, 1547 bp, Oryza sativa
ggcgtcaaatattttaggatggagggagtactaaccaacatgttttatttccatatttcagcagatattcaacgctacgtgattctattcacgcgtttcgttttttccctattttttagggatcatacgcgtcatcatatcagaaatcctcatctaactaatggttagggatgacttgaacgacatgttcgcaaggccatagtcaaggtcaaggtagtactaattatttttgtctcggttatatatcttgtgggatgattaagcctatctgtccatacgtccttatttcatttttacggcagctcatccgtagcttacgagtctaatcacttcaagagtccgcttcagatgagcatatataacatacaattaaaaaatatcattaaccattatttttgtatataccaatgtgttaacaattacatatatttgttactgatatatagaccttttaatccctcgttattctttttcctttaaaaataatagatagttggtaggagatgtttaacatatggatatgggcctgctagccccacctgtaattttttttctcacaagaaaatagaagtatgtggtgcacgcagcaataaaaccaacatcatcactactattttttttaaagaagtatagataacgttcttgactgacttttgataagctgtttgatagttcatatctctgctattataaaaattaaagatatttttaccgacactttggtacgtcatcctgttgacggttggtactcgtagaccggatatagagggtattggggtacgctggtaccaggatctacgtagtacgacatcaaggaaacaagagacaaagattatacttcaggccctttaataggtaatagccctaatccagttgatatgggattatatagagagaaccacaaattacaaaggaaataacagaactcgatgatactggcgagatcgtagttgagttgatttgactagatcacccagcgacttggctcctgcaaactccggcttcgtaggctgtggtcgctgtgttggctatgagattcgatcccttaggtcctcccggggggtcccttttatatcgcaggtcaggtggtctccaagtaggactcggaggtatcggaccctgcacgatatagtgacgacccagtcctatatgggtaggaacctttccattggtggactttgagatgaatttccttaacgtatacagagaacgtccgtacacgcgccgatgtaccgtattgccgtatagcgtacatccaagggtagagggtataccttattcgtaaccctgacagtagcccccgacttctgcttaaataaactcctataaccgatcacgacttctgatgtcggagttgttgtcgttctcgactggtcgatctcggtgtggggatcgtagagacaaggagtgatcgacaacaccaggcgaagttcaacggttatgagtgaatttaaattgaagtccgagaaaccgcctcgcgcaacggacccagaaatttccgacggccatctctctcctttccttggaattcgcaccgtcggtagtgc

SEQ ID NO: 21331 - DNA, 1269 bp, Oryza sativa
tcctccgccttctgagtttttccttctcgtcttgaacttctacggtctttctctgcttcatctgaaccccaactccatagccttccttagcattttttctcatctctgtgaggcctacattggggtagagccgtttcttgacctcttccgtttttactacgagttgcgctggatggaacctaaaaaggtatccgggtgtgttggtttttgacttcgggatggcttgaagtcgcgatacatccctttccagtgcccctcttctcgtagcaaatggcgggcgaggtggttctatcttcagatagaagattcggatccagtcttcattgttcctgaggagcaaccagacatgattccgtcttggaccaccaaacccgccttgaccccatccctacagtctttcatcgatatcatcgatgacctccgagtacgagggttgtcggggtatgaagtcgctgccgacttcattggtagacggatccagccgctccaggcttgagcctatccagcctttgactactctgggccggaggacgcgacccgggtttctcctcggggtatttttcttgtattctgggtttctctcctttgatgcgcattcctcctgacttatcgaaatttggttctcgatctacaggtttgaacagcgcaatcgtggagcgccgtgttgcctaggtgatgatcagtgatcccacgatggtgagcaacgcccccacccctctttgcgagaaagaagcggctgaacgcgaagccacaatcaacgtgagtgtaatcgatgaccctttacattttaacttttagatcgcatcgtgacttcatgttgtgcaggctctccccttgactgacatcatcgggccgctcgcggaccaccaggtggcggattcgttgaaggagggcgttgcccaggaagcgtccgacgcggccattgccgtcgctgctgctacgagcagcggcggcaaagttccaaggaaagggaggaagttttcctctgtgctcggcaaccgccggaaggcgcccaccccctcggtaagccttttgggttatcgattacatagtcgaaaaatgtcgccctcatatcgtacttggtttacttaggcctcggacgcgtctcccccgcctccatgacggtagaggctggtgacactcggcgagaagtaagtggacgagatttgaggcccttgacttgatcgggttctggcgttttgttatgatgactaacatggccgtctttcgtagggcggcgcgggcgaaggtggcgcaaaaggggtctgg

SEQ ID NO: 21332 - DNA, 6322 bp, Oryza sativa
cccagcggccctgccagcgatcttgcgcccggtcgaggcctgcctactgctgtcctcacctgggaggtgctccaagtcgagacgaggcgcctcctcgaggctggtgctcgcggcataagtcgcgagatcgcggaggcgagggcggcggcggcgtcgtcgacgaacgagcgcgacgacaaacttgcgcgtgacttggcggaggtctgcgaggacctccagaaaatgagggaactggtggccggcaacgagcggcaacgacaggggctcgagaaccgcatgtcggaactcgagaacaacctgtcggagatccgaggttcgttgcgggtcacctacaccggcctacaccagctcgccagggaatgtggtgccaaaactaccatcccggcgaaccctgacgagttctcattgacgtcttcgctcgcagaactggcgacggcgatggaggcgatcccctccaagcacgcggccaggatcggggaagagacgtccaatgggatcaacaccggggcgtgccacgtcctcgcatgcgtgaggttggcgcaccctgaactcgatctccaaaagatcttggatcagggggcggctagcgacgcgcgcaaggatgtgatggaagaagttggcgatctgggggagtccgttctcccacttttcgaaaagtagggacgccacttgcctgtaccccttaaccaatcgcgctttgtaaaactttcattggttccaactgcctttctatatgcagttatcgcctcagtttcccttagcgtcttgatttcgagtactttgtgttgcttgtagagacgttgatgtcgaggatatccagcagcgtgggcagcctgagttgcctgtaatcgctccggtactcgcacttgagccgtacgcgccgcaggacggtgtgaaccaggatatggcgacgattcctttaggttggttctttttgtctccatctcctttgctcttctatctggattggcttaaattgccgtgctctcggaaaaggagagcagcttaacttggttgtttgcttgccgagcagacctcgagagttcgctcgttgatcacgaccgtcgcatccaatactagaggacgaagttcgaggtcgccaaacttgagagggctatgttggaagtgaagaaggaccgggccgtggaggcactccgaggtcgcgaggtgtggttcaactcgtacctcaggagttgttgcacagcatggtcgtcgtctgccgggaactgcgagtacctcgcgggaatcccgaggagtcatgtcacgcccgaaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaagaaagataaacggcgcagacggctccacttcacaggcagcttgaccaaggctacacctaatcctccacaccttcagcatcattgtagaactcttcctctgatgaatgattgcaaggtgagtatatgacatactcagcaagccacgcagcaaatatgcaagtgcacaggataacaaaggatggcatagtagagtttcatttgcaaaagcagcatttagcaaacatttgagaatttaataaaacagttaagtattaaacaatattaatccaacgctatacaacataccctgttgtacaggcccaaccattctgaacaaccatcccggctgcacagttctatctccaaaccaggaatgtaccattccaaaccaggagctaatcaaattattaccaattatagcatcatttactatggtgagaagggtgagactaatcacgaaagacattgttagacccgcccataaccgctggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaatcaatcacgattgaccatcgtgaactatcattaggccatcattaaataatagtgagtcataagttatcccaatagtgagctaatgtttctaaacagggctaagcaattatatctaatatctagttgaaccaatataaataaagctcaactagttaaattataataacccaaggtatcaaggaataaagtaatcaagaacaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaattcggattaaaacacttatattgattttaattgaattatgacgcaataatgaattatttttgaaaaggaaaaagggatttattgcgtcagcgggctagggtttgcggtggaccgggcgcacgggcgacggttcacgcgaacggacggccgagatcgatcggtccacgaccggctcacaacggacggggacgatgacgtcagcgatgacgtcaccaccggcggcggcggctcggcggctcggacggcgcacgctcgccggcgaacggcggcgctttggcacgaacggagagcaccaacgggtagcggacggcacggcgaactcaccggcgaccaaagcgacggcggaagaggaacggacggcgacggcgacgaagaagaaacggcggcggtcttcgggttgacggcgacggcgatgctccggcgttcttcggcgactacgaagaggcggacgaggacggtgacgacttggcgatcccgacggtggccttcccgagcgacggcgacgaccggaacggcggcggcgcacggctggagcgacggcggcgacggcggcgctaggttgcacggcgctagagctcttccggcgacgagaggcgaaggcgagggtggcggcgggtagaggagacaccgaggagccttttaaaggggctaggaggcggcggcgaaggcccacggcggccggcgacgagaaggaaagatcggggtttgaaggaaaaagaccgatccgattcgaactcgaatcaaacacattccaaaccgatttagccgatgtttccaaaagagaaaaggtagaggagatcccgaggatcatttcccctctatcaatacggccggagaaggaaagggacggccggatttggaaaggaacggcggcggcgcgaaactagggtttcgggcggcggtggcgtgacgaagatgacgaccctgacaggtgggccccacctgtcagcgggcggacgtgtgcgcgcgcggcggcggactgggccggactgggccgaggagagagagagcggttttgggccgactttcggcccaaagccaaaagagatttttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaattatttctaaaaaattccatttaaacaacaatttatatattttgaattttcagggtgtgacaagtcagcggccggctatatctcgtggctgaacggggcatgcgctcagctcgaaggcatcggcaagcatatcgacgaggccctgaagcaggagtgccgtcgatcgagctggtttgccgaagggcacgtgctggcatgtatacgagatcatcgtccgcagttgcacctcgagttcttccacgagggattttctcgttctcggaggactcccgcggaggtagacaacctggcgaagtcgatggcgccgctggcggagaaagtcttccagtcgatggattggcgttggccttcctggtagtctttgtatatctgtgacaagcatcttagattaagtgtaatatattttggaattttttgcagcctgtaaggaatacttgtgaaatagaaaggaagtctatctaactaagctttcttactctggatgtggtgtgtacgagtgtcttctcacttcgcgacttcgatcattcacttgagttatacactcttcctagcccccagccttgtcgtcggagaattcttctcggaagataaggctcttagacctttgacttgccttagttgaataaacactgatcctagcccccagccgtgaagttggaaaatccatttccgattacacggcttggttaatacgcacggcgagaactcttacacgaccagatcttatatggtctttcgtctctgaagaatccgacaaggccttatcagctctgggcatccccagccgaagttcccttagattcctcggaggccttgtcaagacggcgtaaagggacatgtgaataggtttcaacactaggtatcatctgggtaagggatcatcgggaagggacactttgattgaaatttgcatcttaaaacaggctttattgaagttgtaaggtgtcttacaagtatggatactattgacttatacataaaatttacgcaattggtcaatcttccacgaatttgctaactcgcaaccgtcgccgtctgcaatcttgaatacgcctggccgcaagacttgtgtgatcgtatacggtccttcccatttgggtgagagtttgtttcgccctgcttggctttgaactcgccggaggacgtagtcgccgatcgaaagtatgcgtgctcggatgcgcttctcgtgatagcggtggagggcctgttggtagctagctgccctaacggcacccgttctcaatgttcctcgagttggttcacgtcatcgtttcgctattcctcctgatcctcgtcagagtacttctgtactcgtgtactctgatgtcgtaactcggtagggagcatggcttctgaaccgtacatgaggaagaagggtgtctccttgttggacattgtcggtgtggtgcgcacggcccatagtaccgaggggagttcttcgacccacttcttgtcatgtgacatgagcctgtcgtagatatgggtcttgatcccttgtagtactatgccgtttgccctctcgacctgtccgttactctgagggtgagaaaccgaggcgaagcagatattgactgtcacaccctgaaaatttaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatcgggccgttcctttccttctccggctgatttgttagaggggaaacaatctccgggatctcctctaccttttctcctttggaatctttggttaaatcgctttggaaagcgtcggagacgagttcgattcggatcgg

SEQ ID NO: 21333 - DNA, 10066 bp, Oryza sativa
taacaatgtctttcgtgattagtctcacacctctcatcatagtaaaagatgctataactggtaataatttgattagctcctggtttggaatggtacattcctggtttggagataggactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgatgaagacgagccttcaatcgacctccgatgcttagaagaactagagtgacttgttaagtcgttgtcttagatcgttgtgttagtttgcttgcttaaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagttccccgttttcccttcttgtgccctgtccatgccagatggtgaatactcgcagcaacgggaatggtcccaacaaccccaataataacaacaatggagagaatcccactctggcccaagttcttgctcaacagacacagcttatgaacatgatgatgcagcaatttcagaatcagcaaaaccaaggaaataaccatgcacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattaccctgatttccagaaattagtggataaggctattcgtcaggaggacaagtacaattgcatggagcagaggaaacgtcggattgctcacttcaaggcacaacaggggagtaatcagaagccgcgtcttactttaggaccccagtctatgccacagggaggttcttcgtctgttgttcgtccgcaacgtcagttcttcaacaacaatgttggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgacgcgtgaaggttgtccctgcccagaataactctgctgtatcagcatccaaggctcgtgtaaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggtcagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatggaaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatctaaaagatgcaattctgaaataagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggacccccggtgtctcctctacccgtcgcccccctcgccttcgcttctcgtcgccggaagagccctagcgccgtgtgccctagcttcgccgtcgccgccgccgcttcagccgtgctccgccgtcgctccagctgtcgccgtcgctcgggaagaccgccgtcatgctcgccaagtcgccgccgtcctcgtccgccccttcgcagccgtcggaacccgccggagctttgtcgccgtcgacaacccgaaggtagccgtcgcttccttctcgtcgccgtcgccgtccgttgcttctccgccgtcgttttggtcaccggtgtgttcgccgcgttgtcctctacgtgctggtgccctctgttcgtgccgtagcgccgccgttcgccggtgagtgtccgccgcccgagccgtcttcttcgccgagccgccgccgtcgtcggtgatgtcattgttgacgtcatcgggatcctctcccgtgagccggtcgtggaccgatcgatctcggccatccgatttggatcggatcaatctcggccgtccgttcgcgtgaaccgccgcccgtgcgcccggtccacccaaaccctagcccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattgattgttataacccttttgtacttgattaccttattccttgataccttggggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacattgactcccagtccgacgtagtaatcttggaaatcggcgctgatgaactgggagccgttatccgttatgatgcggtgagccaatccatatctgcaaaatatccccttgatgaatttgatggcgttgtcagccttgatttcccccgtggatgttgcctcgatctatttgttgaatttgtcgattgccacgaataggaatttgtagctgccctgtcctcgtaggaatggaccgagtatgtcgagcccccagcatgagaacggccagtgagagggatggtttgcagtgcttgcgctggtagctttgtgtgtttgctatgaaattgacaaccttcacaccgttgtaccatgtcgcaagcgtctttgagggcggttggccagaaaaatccttgtgaaaggcttttccgaccaatgtacgaccgacggc

SEQ ID NO: 21334 - DNA, 12354 bp, Oryza sativa
  unsure (1)..(12354): unsure at all n locations
acgagacgcatttgagaagtaccccatttggcgccttcttgtatagatcgttgccgatcatacagtagatttttgcttgacgggttattttctcggctcttgaatcatcctcgggtaactcgtcgctgttatgaatttaatgagtggggtccgccagtcgtccgtggtctcgatgtcggcaacatcgcgctctgcctctgtagcccccgagctgatgtcgggggtgactgggctatcttcgtcgtttgcctctttcactgatggctttgtcaggatgtccagaaaggtgctgggttcgagtggctctcgtctggacgcacgccgtgctagatcgtccgactcgatgttgttcttgtgatatacgtgtcggacctcgatcccatcaaatcttttttccagcttcctgacttctgcgagatacttagacaactcaggctagagcatttgtaatctttgtgcacctggtttgcgactagttcggaatccccttttacgattagtcgcttgaccccaagtgcggctgcagctcttatcccaacgagtagcccttcgtactcggctgtgttgttggtcgccctaaagttaaggtgaattgcatgcttgaactgatctcccgaaggtgatgtcaagatgaaccccgcacttgctccttggctgttgagcacaccatcgaacgccattgtccatgtttcgttgtcggtctgactgtctaacctgttttcaggcatagtccaatcggctacgaaatcggcgagaacctgggacttgatggctgttcgtggtacaaagtggacgtcaaactggcttagctcgactacccatttcgcaatgcggacgacaacgtctttgtttctcacgacttcgccaagagggatggcggagataactatgaccctgttggcttggaagtagtggcgtagctttcttgacgtcatgattaccgtgtagagcagtttttggatctgtgggtaccttgtcttcgcgtcgtggagagcttcgctgacgtaatagactggtctctgcaccttttctctttcaacaacaatgacagtactcacagagtagggcgtggcggcaatatagagaaataactcttcattaggttggggagcaacatgtacagggggatttgacaggtagcgcttgagtgcgatgaacgcctcttcggctgcctgtgtccatacaaatttgtcttgcttttttagcagagcgaagaaatgttgtcctcgttctcccatcctagcgacgaacctacttagtgccgccatgcatctggttagcttctgtacctccttgagtcttgtgggcgacttcatgttctcgattgcattgatcttctcggggtttgcttctattcctctgccagagacgaggaacccgagcagtttgcctaacggtaccccgaacgtgcacttcttaggattgagcatgaggcgatatcgtctgaggttatcgaaggtttcccgtagatcatcaatgaatgagtcacctgtcttggtcttgacaacaatgtcatcgacgtaggcctcaacattgttacccagctgatcgctaagtgccccttggatcgtacgctggaaggtatttcctgcggttatcagtccaaacggcattttaacatagcagaatacaccgaacggcgtgatgaatgttgtcttcttctcgtcctcttttgccatgctgatttagtggtagccggagtaagcgtcaaggaagcttaacagctcgcaaccagctgttgagtccactagttggtttattcgagggagagggaagtgatccttggggcacgccttgttgaggtcggtgaagttgatgcacatcctctatttcccgttggccttccgcaccatgactgggttagctagccactctggatggagtacctctctgatgaaaccagctttgagaagtttatcgagctcttctcgtatggcttgttttcgatctggtgcaaatctccgcagtttttactttactggcttggcatcgggtcgcaccatgagtttgtgctcaatcacctccctggggacccccggcatgtcggacggctgccaagcgaatatgtctgcattgtcgtggaggaaggtgatgagcgcgagttcctatttctcgttcagtgatgctccgatcttgactgtcttgtcggggttggcactggagagtggaacgattttgattgtgccgtctgatttcgacgtcttagtcgttctgatcactttcttgggtggctcggctgtggcgggtgggctgggcgtgtgctcgaccatgtcgaggctccgcttgtcgcattggaccgccagctttgcgttcccttgaatagtgattgttcccttcggcccgggcatcttgagtacctgatacgcgtagtgagatgcggccatgaacttcgcgagtgcagttcttccgatgatggcgttgtatgctgtgtcaaactcagcaacatcaaatgttatctgctgtgttcgtaagttgctcgcttggcggaaagtcacaggaagcgtgatcttgcccaatggcttggacgaaaactgagtgattccatggaagggttgatcggtaggtgtcaacacgctttgtggaatccccattgcgtccaaggtgctggcgaagagaaggttgatggagctgccgccatcgacgaggactcgcactaccttgttattccgaatagtgggttcaaccacgatcggatatcgtcctgggataacagtagccttggggcggtcctcatctgagaactcgatcttctgttcagaccacttcatcttgggtgcaacccctgtcacaccctgaaaattcaaaatatataaattgttgtttaaatggaatttttagaaataattttaaaagtcttgaaaagaaaatctaagtttaattaataaattccaatataaaaaggggccagataaaatttcattaaatactttgcttaattctataattcctagatttttctgggatttatttgagctaagaaagtatttttaataaatggaattgcatttaaggaataatttaaattgaaaaaggttttaaaaagtctcttttggctttgggccgaaagtcggcccaaaaccgttctctctctcggcccagtccggcccagtccgcagccgcccgcgcgagcgcgctgtcgcagacaggtggggcccacccgtcagtcgtcgtctaccttcggccgccgccgcccgaaaccctagtttcgcgccgccgccgtttcctttccaaatccggccgctcctttccttctccggccgaatcaatagaggggaaatgatcctcgggatctcctctaccttttctcctttggaatctttggttaaatcgctttggaaagctttggaatcgagttcgattcggatcggttttccctctctccaagccgaaggtttccttcgccgttgccgtcgccgtgggccttcgccgccgcctctgagcccctttaaaaggacccccggtgtctcctctacccgtcgcagccctcgccttcgcctctcgtcgccggagtagccctagcgccgtgtgccctagctttgccttcgccgccgccgctccagccgtgcgccgccgtcgttccagccgtcgccgtcgctcgggaagaccgccgtcgtcatcgccaagtcgccgccgtcctcgtccgccccttcgcagccgtcggaacccgccggagcttcgtcgccgtcgacaacccgaaggtagccgccgcttcctcctcgtcgccgtcgccgtccgttgcttctccgtcgctcttttggtcgtcggtgagttcgccgtgccgcccgcttcgtcccggtgccttccgtttgcgttctcgcgccgccgttcgccggcaagcgtgcgccgcccgagccgacccagctgccgagccgccgccgccgtcggtgacgtcatcgttgacgtcatcgggatcctctcccgtgagccggtcgtggaccgatcgatcttggccgtccgttttggattggatcaatctcggccgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaatccgatttaatctttaaaaaatcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatataattgcttagccttgcttagaaacattagtacacttatgggataactaatgactcactattatttcatgatggcttattgatagttcacgatggtcaatcgtgattagttaattaattaatgtgccaactaaaacatggtaatggtgggttgtgagcacatggttttgatggtcgtgctcatgacaattaaggaccggttcacgagtttcggttgtgaaacattatcgggccaacccacaagccagcatgggcaacggctttatcctttgtatagcatggttcattgcggggcaccagactgagaagtggcggagataagcccacgggggccgctggggagtccatgccttgtttataagggggtgattatgatccaggaaggtgcgctgcagtggattgtgttatgcgaggggttttgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagataggactgtgcagccggggtggttgttcagaatggttgggcctatacaacagggtatgttgtatagtgttggattaatattgtttaattacttaactgttttgttaaaattctcaaatgtttgctaaatgctgcttttgcaaatggaaccctattatgccatcctttgtatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaccccataccatgttgaacaaacctcacgctccacttttttgtattctcgctttgaagagtacgctgtggaacctccgaagatgtgcgagacatgaagatcggaatctaggtacgccgagtctgagtcctgagtggttgcctcagtggccttctcgactacacgtactcgcttgcccttctccaaagccagttgcttttccagcgactttttgaagatgaggcactcctccagagaatgtctgtccgacttgtgtatggggcaccatattctcttcgtatcactgccttgtgggtttgggtgtttgggtgggcgctcgtattcagatgcgaggacttccggttgagctttcctcttcctactcttgccgcttttcttcttgcttgatttgggtgcgtccttggctggcttcttctctcctctcgcctttggcttgtcgttcttgcgtctcagtgcgttgtctgcatgggcgcatcgatcgacaacttcgaacaaccttcgagtagttgtgattcgccttgttgccaactcctgggtagtatagcgatctctgacaccagttttgaaagcgcgaatcacagaagtatcggtgatatcggggaccgtatttctacactcattaaagcgccgaacatagtccctcaaagattcacccggattctatgttaacgcgtgtaaatcgtcttcgatcgcgtggcgcttgtaagttccttggaagttagcgacgaactgctgccacaaatctgcccatgaagagatcgagtagggtgggaggtgcatcagcaccaaacacgcagaacctttcaacgccgttggcaaatagtttgctaacgcgttgtcgtctgccccggcagcgtatagtaccgtggagtagacctggaggaattcttcagggtcagtgctcccatcgtacttctctattgctccgggtcagaatctcttgggccatcgaacatcacgtagagaacggttgaaagctctacacccggcgctgggggcggtgggttgtcggcgatcgtgtgtcctccgtcgatgtctatcggatgacgaagatgaagatgatgacgatgattcactcggctccggtgtgcgattccgagggcgacgttcaggttctcgagaattctgtcgtcgtccaccattgttgtcctggcgccgatccccattatcatcaccgtcatgttgacggcctcgaccagcatcgtctggtgtccgctgttcgcgattgtcgtggtcgcggcggttgtgacgattatggtggtgttggtcttcgttcgagcggcctcctcgctcttcgttctcgcgatgtcgtgaagaaacacgatgtcgggaacgattctcgttgtctcgcgcgcgtcgtgcttctcggcggccattcagatggtcgcaaagatcgctggtgccgcgaggtggaggggtagctcgtctaggcgacgtccgctgctccggtggttcgccgtcggcaccgtcagttgtcggtcgttctggttgtgctctggttgcggcctcctcgaacgcgttactgagattagctaccgattcccgtagtcgttctgtccatcgtgcgagatcatcgttaagcacggggtcatagggagcttctctcagtattgcgttgacggtgccaaggtgttgggccggtgtgaccgtctggttctccgcctctgcgttagcgtgtgcagacgtgctagtcccatcgatggcaaacacgtcgcgtggtgtactgtcagatgacgagccatagtcttcgagcaagtgtaggactgatggctcgtggggatcgatgtcgattactccaatgaatcgatccgaggtcaacgtcgctccttgttccttgtctgtatccttaagggaggttcctgactgctggaccttaggaagcgtcgttttcatggcgcggagaaagaccttgcagcttaagaagtcgtgattcttcgtcttgtgaataggacaatagacatcacgagttagagaagtacgctggattccatgctccttgcaagcacgaatttcagcttgtacgttgagaaaaacccagcaagcttgcaagttgtacttcctggacttgtggataggacaccagaactttgttacctcggaagttgtccttgtcggctcgcggttcttgtcggaaggacaaggtttggccgcactaggaaccttctcgggctcgtatgacgtcgatgttccgttctccgctacagcgggaggatccttcgacatgggatcggtcattgatggatcagccgagattggtaccgtggtgtaaaccgggaagacgatttcgccgacttgagtccacaacagcattgttgaagtagggactccttgaatggggccggtgttgatgatgttgtcgatgaagcttgatgtcatagtagtagaatcttgagcaccaagtccccctacctggcacgccactgtcgacggtgggtacccgtagaccggatatagagggtattggggtacgctggtacgaggatctacgtagcatgacatcaaggaaacaagagataaagattatactggttcaagccccttaataggtaatagccctaatccaattgatatgggattatatggagagaaccacaaattacaaaggaaataacagaactcgatgatactgacgagatcgtagtcgagttgattcgactagatcacccggtgacttggctcctgcaaactctggcttcgtaggttgtggtcactgtgttggctatgagattcgatcccttaggtcctcccggggggtcccttttatatcgcaggtcaggtggtctccaagtaggactcagagacatcggactctgcacgatatattgacgacccagtcttatacgggtaggaacctttgcattggtggacttcgagatgaatttccttaacgtatacagagaatgtccgtacacgcgccgatgtacaatattgtcgtatagcgtacatccaagggtagagggtatatcttatccgtaaccctgacacatccaaatataagtcggtttttaagttcgttcgcttttgggaatacatatccgtatttgagtcgggttttaagttcattcgcttttgaaaatacaaaaagagtcgtataagaaattcttttaaaaaaaactcgcatgctaacttaacatgattttttagaaaaatatatatctaaatgaattctcacagtgaatttcagtgaaaaaatagtttcacctgttgcaaagcacgggcattttttctagtaatttaaaaaaatcactaaacatattttattttatcatgacttgataacttaagtattaattgtattatatggactaaatttttatataggacagatcggtaaaaataaatcagcttaatctctactattataaaaattgaagatatttttgccggtactttggtacgccatccgtctatgagtcagtttttaaattcattcgcttttggaaacacagatccgtatttaagcccgtttttaagttcgttcacttttgtaaatacaaaagaaatcgtataagaaatctcattaaaaaaagctcgtatgtcaacttaagacgatcggactcctaattgtaactcatgattttctaacaaaatatatatccaagcgattttaacacaataaatttcatcctacctaaaccatataacaataacaagattaaaatagccttcacttgttgcaacgcacgggtatttttgtagcctatttaaaaaagaaagaaagagctactccagtatgctctccgattgcaatccaaagtggtttcaaattagaaaatgcctttgcctcccactcttaaaaatgctcttggctttataccagctagcacttccaaaaattgcagatctcggcgtgaccacgagatagatttgcggctcagcgtcaacagtcaacagtcaacagtcaacacacacaggcgcacatgcaaacatgcaatgcgcgtcattctttctgatatgaagcctgtgctgaacattttcttttactcgtctggttgactccccctaattcagtttcagtcttcacttcttgcatatctggactacttttttgtcggccatgtactggactatgcagcattctcatagtgccaaattcaaaacccatttgatgatttgaagttggcatcattgtatcgcatcgcgtggtcatgcttttgcccaaattgtgaacatcatgaaattgatttcgnntnnanaaaagaatatcagattgatctcatcagtgcttaaatctttggcatggattaagttttccctttggagataaaagcatgatatattggtccaaaaaatggaagaagtctccaacaagcaggcccattgcattgatgtcgtgaaagaacttccactgaactgcaaagttttaaaaaaaaggggttctctaaaagattaactcaactggaagttgctggaagagatgtcaaacatatttcttgaatagtttgcacatattattacgcagtcaaaacgatgcattgtttaggtctgaccaatgagaagattattaagatcgaggttaacccactgtcagttcttaatacagactgattaggacgtgcacccacaccatgacgttgacctggattctgagagctgaacacagaactgatattgtctaaaaaatcacagaactgatcatagaactgatattgtctaaataaaaaacacagaactggtctggcttcgaaacattgcatcacagtcgtcagaatcgatcatattccttacaaattccagtcctccactaaccttccctttcttcactgtcctgtccatcatgtctgtccttcttggcttcctcctcctactctccctgcaccctccgacgagctatgccactacggacacggtgtcacccggccaaacactggccggcggtgacaggcttatctccaacaacagcaagttcgctctcggcttcttcaagatggacagtaagaactcctcctacaccagccgcaactcttacctttgcatatggtacaacaagctccccatgataactccactgtggtccgccaatggcgaaaacccagtggtggaccccgcttcaccggagctaacaatatccggcgacggaaacatggtcatcatggaccaggctaccaagtccatcatatggtctacccgtgttaacaccacaaccaacggcaccgttgttgtgctgttgaacgatggtaatcttgtgctgcagagttcatcaaactcatccatggttttctggcagagctttgactacccaacagatagcctttttgccgatgcgaagatcggctggaacaaggtgactggcctgaaccgccgccttgtttctaggaagaattcaattgaccaggctgctggtttgtactctttggaatttgatatcaatggtgttggtcatttggtatggaactcaactgtaacatattggtccagtggggattggaatgggcaattttttggctcagcaccagagatgtttggtgccaccatacccaatttcacatttgtcaacaatgacagagaggtttacctcacatatactctgaacaatgagaaggcaattacgcatgccgcaatagatgtcaatgggcaaggtttggcaggtgtatggttggacagcttgcaggattggttgatcaattacaggatgcccttacttcattgcgatgtttacgcaatctgtggaccttttacagtctgcaatgacaacaatgatccgttctgcgactgtatgaagggcttctctataagatcacccaaggattgggagatagaagatcgaacaggagggtgtatgaggaatactccattaaattgtggtagtactatgaacaagacaggtttcagcgataagttctactatgtgcaaaacattatattgccccgtaatgccatgcatgtgcaggaagctgcaagtaaagatgaatgctcagatgtttgcttgagcaactgctcctgtactgcatattcctatgggaaaggtggatgctctgtttggcatgatgagctgtataacgtaaggcaacagtctgatgcttctgctgtcggaaatggtgataacttttacattcgccttgctgcaaatgaggtgcatgaggtgcaaagtgcggaaaggaagaaaaagagtggagtcatcattggtgttgccattggtgcaagcactgctgctttctgtttgatgatccttctactgatgttttggaggagaaaagggaaactgtttgctcgcggagcggaaatgatcaaggcagcattggtattactgcatttcgatatattgatctgcagcgtgcaactaaaaacttttcagaaaagttgggaggaggcagttttggttctgtatttaagggatacctaaatgagtcaactcccattgcagcgaaaaggcttgacggcacatgccaaggggagaaacaattcagagccgaagtggattcaattggaatgatccagcacatcaatttagttaaattgattgggctttgttgtgaaggtgataagaagttacttgtgtatgaatacatgccaaatggctcccttgatgtgcaactatttaaggataatgataaagttttggattggaatcttagata

SEQ ID NO: 21335 - DNA, 5995 bp, Oryza sativa
aaatgtactgacaacctgcaagtcatactgatatatgcacagatgacatgcatgtgaagcagtaatggatatagactaacaaaaatatgcagcctaactgctgatccaaggaaataagcacattctacgggctaggatgaacactaacatagcaattgcaagtgaatgtgcacaacttcatatgacttactgtttttgcatattctgcaaagttcaatccagtgctgtaccctttctacaaggcccaaacaaaaccatttggagtagattggacctccttatatgggataactaacttttttatgttttccaacatatatactgacacaacctatcgcccctaagcaagtgaagggtttcatctttaatcatgatatgagtgaagtgatgattcgaaataactgtaggatgatatgattactcctgctacgatggatgatataactacataatggatcactcaaatcctgcactgctgagtattagtagaactctacagaggcaccatcaacgggaacactggccaattttaatgagaaaaattgccacataagacagtgagtacaaagtacaaagcaaatttcctggccagctttcattgtgcaggatctgatatgttatattatgattggtaattaacatagcagacaacttatgcaaaacaaactcaagatattttaattgaaaatgttactggctggccagatagcatgacgaatgccctctgtcagagcaatttggacataagatgtcttcataaagctaacaaaacaatcacacattacctaggactaggtgcaatttcctgtctgaaactctgaaccaagtagataacaccagcagtataaaagatttcgttcatttactcacattatggtcagcaatacctcttttatttccagaatctagaatccagaggctgctactgtccgtattggaatcgccattgccttgtgaagcagcgtggtttctctcggttgcctcaagtgaaactttgaagaattgaagccactcttcttttatccataccttcactcagctcaaagggatcaatccctttgccattgatgataataggatcggcggcattgtagtacggagagacgtgggggcaccctttgggcttatccagcctctcctcaccttttaatttagtgctgctggccatattcatagatccatgtcaaaatctatcaccaaagagcacaaaagaacacatcttagcgtccaaagtacgataagtagtagtaggacgcaccgtattaatttgaactcaattttgatatttgattccaaattgtgattctatccaaacagaatatttttaatttcgaccaatacaaatacccatttttgtggactcgtcgaaatttaaagtatctcgcaatccactctcaaaattaacattagcaaacaaccagcctcacctaattaagaaagcttccccaaaatctaaagctcgttcaatgccgacctaaacaaaaattaccaggtcgtgtatggttctcacaaattatctacgggaggttccaagcaacaagcgaaggaaaactttaggcatcacagatgaggaacacacctctcggatcagggcctagatatcggctgggagaagccagcatcccgccgccgccgcacagccggaggccatcggcgaggtggcgagggcgaggggcagggagagaggccgcgcggtgcgcgagaggggcggcggcccagatggagagaggagcgacctcgaagtcccagtggtagcctctacggcgatggcgcgcggtggcggggggcacgccggcgtgaggaacaatcttgttggacggctccggactccgttggccgggaattttatttaggaaataattaaaaaaaatcactcaagatctgtgagtaggaatagatttttgtcatttataaataaaataaaactacgaatcttatcttatatagggaaagcagagctttttggtacgaggatgtgccacatcatcaaaaatatattagccgtcagaagcaacaagctttctggtaccaggatgcgccacatcatcaaaaatatattagccgtcagataaagagttcagataaataatggccattggatcgaaagattgcatgtattaaaacaaaatcacaaatgggctaaccatataaaaattttcggaggtttctagccaagtatagatactttataaacaaaataacttatatcaaaaccttattaagagctaaggtaaactaataaaccatcttaaacatgatcaaatttatggctagtttaaatgaatgtaacagaaaactacataatacctttattttgtattatttgtattatacgtcgcttttactttttttttctaatcaaatttcttttggtttgatcaaatctaacctacttaaaaagtttgcaattttccgatcgtcaccaagcgctctcgtccatcgctataaggttttttgcacctcgattagtggcatgagattccaattgagatttcattatatacattttagatcaatcccaatgactcgacgcaatgcgagggaacaaaacatgtgacagatctgccatgcgaggcacattgattttttttcatccttcattaattcgtccggtctccgctcaatccatccaacacggatagtcaatcctggaatcctagactcggctaggagcaagtgaaacagagccagtggcgacagtttgttgtgttcttctcgctaacaacttgagaagtgcactaaatgcaacatgcttatacgatagaaagattttatatgaagggactctagtaaaacccttgatttaccatgtccgcactataagtcttgtaacaaacttgcaaaaatcagttgcctgccaattcttccacagttgtgtatgaattagcaaacatttcaccaagtaaacatcggacaaacacacacagtcaaaataaacacatgacaaactgtctcctctaaggtttttgcatacttatatgtgagacctccttacaactattattggttagttctatgaaaaaaaaacttcatcaccgcgtgctagcccatagcatgggtagtctatgatgaatttcaccgtacaatctcatacttacaaatgggattagcttgctatgggcctatgtggatcttgcctaccaattctcctatgacacaatactttttcgcatgtgatatccctgattctaatgatgaatttcacggtatttgtgatgaccacgtttgcctccgtgaccaatttttatgatcacacttgagtcatcactagaatcagttgaggcggaactttatgccgacttcttttaatatttgtcaaacatcaatgacatattccctatttgtcaaaggcaatccgtcaaggaaggccgaatatgttgtagtgtgggaaagaactcttgttagtcccaaaaggcgattgtgagcgatcctgatacccactccgcaacttcctattcgaccactctcctctctagtctaggcaccccttttacaccatctcgctgccataccatcgtctcggcgtgtaacagctccatggttaactaaaataaaaaaatgcaaaaaccatcccaaatatctccttgagtttaagattcccccctataaaatgatttattgctaatacgccctactatttagctttgtgtgagtcctccccaattgccgttgtccatgcattcattaacctttgtctgcatgtattctatgacttcttttctcaccagtctactaacagtgacctaagtgttgcaccaagctcatctttatcatcttgaatctaccaaagaaatcatccaccaccgaaccccatgaagtaagcacaacaattcatcatgtagtgcccccaatgttttagaagaagactcgtgaccactaccgcccaacgacgtgccgggcttcctgaattgggatgccacgatcatgtcatagggcatggccgacatgactaacgatcatggctcttcacctattagtattcactagcaaaaatgcatgtgtgtagcaacaggtgaagacaatttttacaattgataaaaactcaaccaatttaaaagacaaactgaaataagactaacaaaacaatggcaaaaaaaagtcagaaatcatatataacattgaacccgatagcgctcacctcatgcgtcatcacacgaagaataccttatatacaccattccatagcctcgcaaatcgatcggatgtctattccataaattgatgaatgggtattttgctatatcatattgaccaaagattaaaattttgattattcaattagtgaaagtcttttttactatagatgaaaagtatttgcaatgtaacaaacttgcaccatacacaccttaaactatagatggccgttgacggtcgttatcgatcagttttgaccgtcaatattaccaaaatagaggagaactagtgatgattgcaatgcatatatctgttagaataataaacttccactagtattaggtatactaacctcttgaagggaatgacactaaagtggaggagaatcgacatcaactcaggtgataaatcaatcggacgatgtcgagaaccagacttgtgtatgaataggccaagaactcagaactgacacgatgaattgggccaaaattcacaagtctgcagagtggagcaatagaggaagccaccagccaaaattgggctggattgggccagccccaggtttggccgaaccaatcctagtgcagttggatccaggttttggcgtggatgtccaggattgcatcccaatgacggttggagggcactttggataattccccttccacaaccatcataactacctctatataaggagctcactctcttcactcaacacacacctcaagcaagagctctctcatttctctcaagtttagtttagtagtatctagctggtgaaatagaaatagaacaggaatcaggagttcggaagccttcagaagagttcgggtatggctttagcagctttcctttcctcttttgtaagctttgtacttttattagaatactcttctatatacatttatggtattgaaatactttctaagtatatgagtacctactttacattatgttcatgttatactgaatatacggctagcttatctgggagatgctttggtgcggtataatgtttgcatatgcaattactctatgtcatgacgatgatattagagtagtatctggtagtttaggcgtggtgtctagattacgggatatcattatttggggttatatattgcggatgagaggtgggccgctgatggtgacagctcagtacgggtattcctccgcgcctatatataatcctaagttaattccctggggagggtattcctccgtatttagccccggttgtatggtcatgacgtgctgtcgtaaggaattcgacagtcaggggtagcttctcgaagtaccaggagggcatcggatagagggtatttgctagtatatcagttaactagaatatatgtatattatgtatattagaggtataggaatagattctctttctcttttctttccacctagcttagatcatttattatgagaatgagttgttaatgcttgtgtgtcactctatgcttgtgtgtcactctacccttggattatcttaacccctgtttagaatatgattatcacaaggaatatataaactattagtcaatctctctctacatgatcttcccacgggataaaataaatacgatacccttggaatactctcgggtgaaatggtacaatggtatatccatgcgcttgcggatacactctgtaaccataatataccagaagtatttctgcgccattgcggggaattatatttctagtaatgtcgttaagaaatcccaacaatggccatatggcccgcccaaggcccgataaatttggcccggcccaagcacggcacggtccgactccggtcgtgcccatgccggctcggcccaacagccgtgccatgcttgggctgcttcctcgg

SEQ ID NO: 21336 - DNA, 3031 bp, Oryza sativa
ctgcagccctcatttttttataataacagagatattagtacatgtggtgttgcctccatggtaatggatgagcaacggctttttttttttgggggggggggggggttgtggggatctcaaggtgaattagaagaggcatttgcaacaaatcgtcttacatggaggaatatcaaattcagagtgacattggactgagttttgcaattttcctttattagaaattagaaaaaagctcacacgttgttgtgggaatttgtataaaacaaataaataagttgagcaaatatctagaataaattacattggtgatacacaaactctacgatctagtgtttgaacatgtaaaatgctcattttagagcacaaacttatccggtgcatgttaaccaaggtcaaaatggtacaacaaggttaatcttgctgattttgttgtttttgaatgctgtgtaaacatgcctacctccttcccataatttattacgttggtttgtcaaattgaactaaccaacatcgtagaaaaaagaacagagggagtatctcagaaggatatcaagtagacatatttattcagcaaaacataggcataacaatcgcataaagaaagagatacaaaactaaattagaaatttgcatatgtgccattctttggaactggcttcgtaaaaatgctatcgttaaaatgagattcgctacacatccaatcttaagccatgggcattagctacaatgccattttcgctatttcttacaattgtaaaataattttcatccaaataattttttgttggatgtttttgcccctagctgtggttgaaccaaaccacatcttctttctttttctggtgaccgcgtttttcacgaaccgagagagaagcggcgccaggggtgacaacgccgatggcacccaccatctgccgcgcgctcgacggggaggcgacgtggctcggcagcaggtgacaccggcgcagttggggaaggaggctcggctcggcagggggcggctggggacagcgtcgtcgtcgtctctctcactctgcgccaccgcccgtgaacacatgccgctgcctctccccaccatctgcgccgcctccacccgccatctgcgccgccaccttccctgaccgcgtcgccttcccccgccatctgccgatcttgtgcccgtcgaagaagcgctcggtggtgagctcgatgttgtcggtagtggaagtcgtggctggagatggcctcctggacacgcaccttctcatcggcctacttgcgggcgcgcaccttcccgtcagcctcccggcgggcgcgcaccttcttgtcgccctcctggcgggtgcgcacctcggaacttggtcttctccatctcggcgagcgctagcgcctcctcctctgcgtgttgtgcctcctctagctgcagcgccccctccagtttcagcaactgcagctccttagtctggctcagatggtggggggggggggaagcggcggcgtggaattgggggcaaatggatggcatgcaaggcggcgcggatggtggggagaggtggcacagctcggttggggaaggcggcagcgtgtctggcgggcggcggcgccggagtggtcgcccttctctcctctcgcctggtcctgagaagcttgaggtagaagatgtagtttggttcaaccatagtcaggggcaaaagtgtctgagaaaaaaaatatttggatgaaaaatgttttgcaaatgaaagatacaacgaaaatggcattttagcgaatgcccatgacttgagaatggtatccgagagaatcatattttaacgatggcatatattgtagcgaaaccaccttttaagtatcacacatatgcaaatttctcaaactaaataataatgcaaggggtagaaatgaagaaggataaagtagaaaccaaaagcattccacctcatataacatgtcatgtactcctttgtggtcaacttattataatttgccttatcatgccattatatgtcttgggtcgcacatacgagacaagttcatacaacaaaataagcgttttacaagttcatgaactagattgcactcttttataagtttataccagtaatgcattttacttcaatatctataatataggtggcaatgaacaggaaccatcgaaataaaaaaaatattggctcaacttcttgacatggaatcgcacacatatgctcccttagggcaagcgcaatgtttgttgctgagttcggcaatactgtgggcgcaggggtcaggcggtattaagccatcgcaccctccacattgtttctgcgcgtcggaggggaataaggtggggccagcaaaaaaaaatcaccgatagtaaaattccgtgactgccgcgtgattccttcctgcaagttctcgacccccaatttctctctcgagtccgtcgcactctcttgccgccggcgacacgattctcgtccccatcccgtcgcactctcttgccgtcgtcgacaccaccccaatgtgtcttacatttcacgactgtccttttgcgatcattacgacgtgtattgttgttatactctgcagctacagccctccaatagtactctgacttcttgtcattgctatctattggatccactgaattgttcaaccaagaactaaggagccgtagattttcttcttcagtccagttgacccatgtccctttcctcccagcttcttcattgttgccactagactcttcaatgttaacaacacttttggcttgcgatgttgcagggcatggagaagttgattcagatccatgagaagaagcagatccacccacctgatttggtgagtgcatccaactttcttgatgacgaaaaccttgaaagcttaatgctgcagattttaaccaattgccttgctgctgaaaaccatgaaaacttggaggaggattgccatataattgatagtttgctggaggaccaaaagggtggaagttatgaaaatttagtgcttgcgattgtggaaactgtggggattggggatactgtgattgggtgaagttgaggggaattgagta

SEQ ID NO: 21337 - DNA, 23369 bp, Oryza sativa
  unsure (1)..(23369): unsure at all n locations
ttgattcaacaagtttgtgaaaactctgttggagggatccatctcaactatctggtagaatgtatctgtgttgttcaacaatctatatatattgtgtgttatttctgtagtatgagactgaagaatggcacaatgcagtgactaagcaacgggtagcaagcaacggttgaaaagcaacggcaactttcattttttttaaagtactgtcagaaacactgtacaaataatattctttatctcttcttcatcggtagtagaggtatggccgggttttaactctgtgccactctcacaatgcttcctacccagtaggaagagagcattaaatgcttcttactggctaaaaagcaacattgtggatgcccttacaaggagccggtctgtggttgctgctagtgggctatagaaacagaagacttggcacatagagcttatagagcagtgatctaatattgatctttggcgttgaaagaattctaggattggcatcacaccatgatctgccaatatagatcaactgggcaggacacttcaccaatctggaattaataattgaaaggaggtccaaatcagagaccaagtgatttgcgtctcagcacgtcaacagtaaacatacatattacaattgactcctgttaattcagggtaattttacagttcttagtagattatctacagataccaaattttttagaatttcagaaaactccaagttttgagatacatctaatgcaaaaccttatgtattatgttttgtttcaatgaatatcagattttgggggtaaagtgtttcaataaaccacatgtttatcacatactcataattttattattatatataatatttttagtatatatttacattagtaggctcaaaatacatacccctctcgtgcacttcatctttttccctactcttacattgcacgattgaaaaacattagacaaccttactaatagtgatgtattaattggtaattacttgtatagataaacattaatcatactaccaataattgatgcaaagataatcgtttaaaagaggctaaggtatatatactccggaatatctcatattattttttacaaatattatgcataaatatattaaaatatatatgtgtaacgctccgcttttcgtgagacgtttaaaactaattcggcaaaatcctaattacgaaaattttcgttctttgtgtgagagtctaagtcgtgccaggatctcaattcaatccccttgttccctctcatcaaaatcaaaatcctccacctcgaaattcctccttcgactcaaatctccaaatcaaattccgaaattcaatcgcatcctttgaatcctcggcaaatactcgctcccaattccgaaaaatatcaaaccctaccttgagtcttccttgattcctccctgaaccctcgagttcgaatatcgaatttgaatccaaatacaaactccaattgtgggccgttttccccccttagcccacctccctctttcagccgtttctcctccctcagcctcgcacgtgcgttgcacgcgccgagccgagccgagagagagctctctcgctctctcgttctttctctctcccgtcttcgctctctctctatgctctctcccctcccggcgccgattcccgccgccgcctctgaattccgccgcgccctcgcgtcgcgcacgcgctcgcccgcgcgtggcagaccgctcggtcgccgccgcgtcagccctggccgcctgcgccgcgcagccgcccatgccgccctgccgctcgcccccaccctgtgcgcgcgtgcgtccaagacatataggcagcgcgactctctgcctcacgcgctcttctctccctctcccattccccgtttcggcaagaacagagctccctttgccccccccccctttttccattttgcccgacaccgcccgtgaccgcctaccgccgcctggaccacgggcgtgaccgccagctcctctccttgaccgcctctcccgagtcagttccttcccctcgaagctcctcacccggccacctataaaacccgagcccctcccatcgaatcctcctctcgtttcacttccaacaccgccgcgctattgttgttgctcgctccgctctcgccgtcgccgttcgtcgccaagcaccggggaggccggtgcgtgcgaggacgcgtgacgcgggactccgagcaccctccttcttccccttccccggtctgagaacggagaactcactccgcgccgtcggccactcgtcaccgtgccgtcctaactcggtagagactccctccgttctccttcctcgttcttcctcgccctctctagcttgtgtggtagctctactagcccctcgaacgcgcgtagacgccgccccgagctccgccgccgctcggcatggcctcgccgccattgccacccgcttccggagcccgccgccatcgctagccctcctcggtgctcctccaccccatccgatgccggaaacggatttcttgaaccccggacacgctcccaccgccttgaattgaatccccgtcacccctccgccgtttcccccttttctcgccgccggcgtgcgccgccgcgattcgtcgtcgtcggcccctcttcgaaggatccgagccattggctcaacccctctcgtgctcccctttgtaccggtgaactccctctcgatcgaatcgccacgtcgtgctccggtgaaaccccgccgtcggccaccgttggttggagctcctgttcttcttcctcctctcgcccggcccgcgtggctgccacgtagctgccacgtcggcgccacctcgacgcgaccaggtcaaagctgacctcggtcagccacctccctccgtcccccaccctcgcgcacggtccacggagagccaacaggctgcgcgtgggcccgccgcacaccgcgtccacccgcgcgccgcgcgtggaccgcttctccccccccccgaaccctagcgccaccctcgcgtgcgtccatcccaccgtgggccgtatcaccgacaagcgggccccacccgggaccccgcgcggtggaatcggtccaccgggccgtctctctctcccccgcgccccctctgttgggccgcctccccgtggccgcgcccggcccaatggctcggccgagcctccttcaaccctttgggccgcaccaatgccacccgagataagtccaaatcacatccctcatccctttaattttccaagggatttaataaatctttttcctttgttccataaataaaattctttattccaaaattccatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttctatttccagtaattccgtaaaaattgagatctatttaatggcactattatttagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccttttgaccaattgctcctataattggaaaatcattattgttttgtttgcaacttgcattattagagtcacacacttaacttgcttggcctcggtttgcgtgccaaaccgacggacctacccagtagtcgcactaattcctataggttgtactaccctgattccttgtcgctccacccttgtgggacttcggtatccgtgctctttgagcgcgtatatcaaatatcccacatacactgttgattgtccaaaaattgggaaatgggtttgagaagccttgaaaacccaacctgtggtgtcggtgtgtttaaaaataaaatgaattgtgataactcgcgatgcgggggttgtgcctgtgtggcactgtcccgtattcgcatataaggaccgattcctgtgggaaattcatcaagcataacaaagtgcaaccacaaggtggaatgggacaccctagctaagtaactagtcggttcagggaaacctcgcatgccaatagttggggaatgccggggcagggtcggttggagccaacccgggttcctggtaaggcaagaacgcgaagcttgccagattaccgatcgaggtggttggagtttgatttgtgaaaactaaaatggcctatatttatatgaggatttgatccttctacgtggcatgaggtaaccctgggtcggcttaggaaaggctttgttgcgaacctccgataccgacgggtgttcagaataagttcgtatcttgtgggtaaagtgtacccctctgtagaggttaactaactgttcaaacagccgtgcccacggtcatgggcggatgtgaggtggttcctgttgcgtagatttgtttgcctgtgctttgtgaaaagttgttgtgggatgggaatcgtaaccagatcagcctatgtggcagatggatgacctgagtggtcagaaacgaatctgtgtgattcgggatgtctgcgggcattatagactaggcttcccgagaggaagcggattgctttgctgctgggcagctggactctgggagtccgagaaaatgaaaaaggctctgggagccgattaatcaagtgaaatggctcttggagccgagaagtaatgatctgacccgggaggtcggtacattaccaattgagttattgaaaagcatctcttaagtcaaatcgagacgcaagtctcttttcgacccaaacttagaaagaaataaatcacttagtgatttcaaaagatttcaaacaaaggatttgcaaaacaaccttgcctctcttccaagcttgcattaaacacctaaatccccgtgacttgctgagtacaaaactactcacccttgctctatataaatatatatatagttcctccgtcctgaagctgaagatgaagtgaagtgaagaatagggttttgtcctggttcccagccgtcgcctgtggtgttgggtgttagtccgttggttccgctgctgctgctgttgttggtgttttccttgtccgcgtcgtcggttgcattctcgggctgttctgagctgcaacgtaagttaaggtaaataagtcctttatttattttaaggatttgcgatggttcatatttgtcaccgtgggtaccagcactatgtcctgggactggtactgtaatcgcggtttcgtaggaagcggttcgcgccgtttttcctacgacacgctcctgtcaggtgccgttgtacggcggtgccggatcggggtgtgataatatgcttaaacgtgaggtttcttgaaacattttggcccaaaaccttgggttctttgaaacaaattatagtacctggggttttataaaatttactcaatttttctgtaaaatgatggtatctcaagatagataatttctgaagattttatataaacaatgtggtacaaggatagtaaaattactattacttcattccgcagtgactaattgcatatctgcacttttattttgtttgccatggactggattatgcatcattctgatagtgccaaaatcaaaacccattttaagttgccatcaattatctcacatcgcttggtaatgctttgcccaaatctgtgatcattatgacattgatttcctgctggacaagtaatatcagattgatctcatcagttgtgaaactgagctttcattttggctaaagttttcactttggaaataaatccatgattggtcgacaaaaaaggggaagaatcgaaagagtctccaacaagcagcgccaattgcattgagaagtcaacctaattgcaatgttttaaaaaaaagagtcctcttaaaagaatacctcaactggaagttgctggaagagatgccaaacagatttctcttgaatatgcacaaaccacagatcattacgcagtcaaaacgctccatttgttgatgtctgatcaatgagggaagatttattaagatcgaggtcagcacactatcagttgttaatacagactgattaggacgttttacccgcaccaccacgttgacctgagattctgcgagctctacagacaactgatcagtggtctggcttctaaaccattggacctgatgtttgcattgcgttcgtgagcatcaatcgttttccttacaaattccactcctccacttagcttctcttcactgtattctctacatgtctctccttctttgcttcctcctattctccctgtaccctccgagaatctctgccgccacagacaccgtgtcacctggccatgcactcaccggaagcgataggcttgtctccaacaacagcaagttcgtgctcggcttcttcaagacggagagtaagaactcctcctatgccagccacaactcttacctttgcatatggtacagcaagctccctatgataactcctctgtggtccgccaatggcgaaaacccggtcgtggaccccgcttcgccggagctggcaatatcaagtgatggaaacatggtcatcttggatcaggttaccaagaacatcatatggtccacccatgtgaacaccagaaccaaccacaccattgtagtgttgttgaacaacgggaatcttgtactgcagagctcctcaaactcatccaaggttttctggcagagctttgactacccgacagatagccttttcgctggcgcaaagattttcaggaacaaagtgactggccagaagaaccgtcttgtttctaggaaaaattcgattgaccaggctgctggtttatactcggtggagtttgatatcaatggtactggtcatttgttatggaactcaactgtagtatattggtccactggggattggaatgggcatttcttcggcttagcgccagagatgattggcgcaaccatacccaatttcacttatgtcaacaatgacagagaggtttacctctcatataccctgacgaaggagaagattacacatgctggaatagatgtcaatggtcgaggtttggcaggtatatggttggacagcttgcagaattggttgatcaactacaggatgcccatacttcactgcgatgtttacgcaatctgtggacctttctcagtctgcaatgacagtaacaatccattctgtgactgcttgaagggtttctctataagatcacccaagaattgggatctagaagatcgatcaggaggttgtatgaggaatactcctttaaattgtggcagtaccatgaacaagaaagggttcacagataagttctactgtgtgcaaaacattatattgccccataatgccatgagtgtgcagacagctggcagtaaagatcaatgctcagaagtttgcttgagcaattgctcctgtactgcatattcctatgggaaaggaggatgctctgtttggcatgacgcgctgtataatgtaaggcaacaatctgatggatctgctgatggaaatggggaaactctttacattcgcgttgctgcaaatgaggtgcaaagtgtggaaaggaagaaaaagagcggaaccgtcattggtgtcaccattgctgcaagcatgagtgctttgtgtttgatgatatttgtactggtgttttggatgagaaaacagaaatggttttctcgtggagtggaaaatgctcaggaaggcattgggatcagggcatttcgatataccgatttgcaatgcgcaaccaaaaatttttcagagaagttggggggaggaagttttggttctgtgtttaagggatacctaaatgactcaattatcattgcagtgaaaaggcttgacggtgcctgccaaggagtgaagcaattcagagctgaagtaaattcaattgggataatccagcatatcaatttagttaaactgatagggttttgctgtgaagatggtaagaagttacttgtgtatgaatacatgacaaaccgctccctcgatgtgcatctatttaaggataatgataaagttttggagtggaatattaggtaccaaatagctattggagttgccaaaggccttgcttacttgcacgatagttgtcgagattgcattatacattgtgatatcaagccagagaatatacttcttgatgcatcttttgttcccaaaatagcagattttggaatggcaaaggttttggggagagaatttagtcatgctcttactacagtaagaggaactattggatatcttgcccctgaatggattagcgggactgttgttacatctaaagtagatgtttacagctatgggatggttttgtttgaaataatatcaggaaggaggaactcaaatcaagaatattgtaggggtcattcggcctattttcctatgcaagttgcccgccagcttatcaatggagggattgaaaatttggtggatgcaaaattacatggtgatgtgaatctcgaggaggttgaacgagtttgcaaagttgcttgttggtgtattcaagacagtgagtttgaccgcccgacaatgggcgaggtggtgcaattcctagagggtctactagaactcaaaatgccaccattgccaagactactgaatgctatcacgggaggttcacattcaacgtcactgctacctatagatttacaataaatttgtttgctggtttgtaattaacagtactccattaaaacattataacatatcatgccttttaaggaagtaaggcgtggcatatagcatgtaaaatttctatgaatttggtgtttctgatatgtaatacttacataccatagacttgtcaaattgtcaattgagatgcttttaagcaacacaaggatgattgccttgtatgttcaaagatgttgtagagggtggtaaattggaatcctatacgtagggcctgtttgggggagctttagattctgagaagcagctgtttggtagccagcttctgagaatttggaaaagctctgaaacctagcttctccagcttctgacttcttagttcatttttcagaatctgtaactacaaattctcagaagctatggactgtttgggcagcttctagcagaagcagcttttgggaaaagctgcagctgggacaagcttaagtgtaagcatactagcttaagtgtctaggtttaaagagtgtagcccaagttttacaacctatagcctttccttgcaattctacaaattatagttgatgaaaagcaagaagcaataataataagaacacagtggagctttttccgaggtatcggagattggtaatctccattaatcctcgctggagcactcatacaagaaaaatcttacatagacgtacttttgtagagaatatttaatttgccactaaaatcaggagttctacagtttacagtttagagacactttcaaaatctcctagaatacttttaatctataagcacttcaaaggcatttataacacattttgttaaatttatgctgtagagacattttttttggcactttaaatattgcctcatttgtaaaggcattttaacctagctatgtagaggcacttttccaaatcttaatgtatgctaagaaactagatataactaatacaagacatatattcacaaataatgatttgaggttgagatggttagtatattgaagataaaagttatgaactcaagaggtcatgaattccaagattggcatggtatgatattttttcttttttttttcacattgatttgctatagttcctgcacaacgaagtgcatctagaaagtgtctctattttcttatagatataaaaatgtatgtacaaaaatgccgcaaggcatagagatattatataaaatgcattttcgtttatagagataattcactaaaaaaagtcacctatgaggcattctttaaaatgtctctaaaacatcgtaaaggcattttaaaaatgcctacatagtattaggaaaatgtccctataaggcaatttgtagtgactctacacaaatagtgttgctctctcctttggtctggaagtccaaacgcgctcccatagtggtgattttgttgcatgcgggaaaggaaaaactcaaaccatgcacagcaacaccgggtctctggatcaaggcagaggaagcctgcacttctcgctctcgcgtcgccctccaccaggggcagcacgggaggagacgagctccgaccacaccctccccccatcttcctccttcgcctcgccgccgcctgagcggccgccggccaagccgcgtggccgcaaggatagtggtggcggtgaccgccagatccacgccgctctggccggatctgcccgaggaggggggggtggctggcggcggggatggcgacgacgacggtagaggcatggctgggtcgacggaggcagggatgtaaacggcgcgccggatccggccccccggaggcggatctggccacccggcggtcagattgggcgagctcgcagcgggggcagcggagctcgcggcgatgggtcggcgatagcgggcgagctctcagtaggagcgcccatcgcggcaggtcgatggcggcgtgaggcctacggcgacagcggcggccggccgttggtagtagcggctggaggcgctgctggcggcggttgtggctggcgacggcggtggctgacggcggcaacggctgtgaatgcggcgtcggttgccggtggcagcatgtagaggcgaggaaggtgtggatgcggtgtcgacgtctggaaacgggctacgacgattgtgagaggaggcaaggacggcctcgggcggctagccagggtggcgtggcagatgacagcatttggccggcgcggcagcggcgggaggagtgctcagaggctagcttggtgcatagaggttccgccggtggcagcggaggtcggcacggcgcaaggaggcgtagccagcggtagtgcggccggtggcgggagaccgacctggcgcgaagaggcgtggccggcagtggacgaggccagtagtgacacaggcgggcacggtgcaaggagaaggaactgccggtgagtgcggtgcagtcttcggcgcacgaaggctggccggtgggggatgctagtgtagtggacccacatgccggcagaggatggatggtggtggagcatcggggcgccagccgtggactcgcaggtggtgagcggtcggtgaaaacccagctcaacctcggtcgggctggcaacgatgacgctcgaagtgtcattcccctcccgagggcgttgtcgtgccgtctcatccctcatgtgtagatgtcgggtgaaagcccagtctcggttctctttgagaccttgacggacggcggcggcggcgttttccgtcgtttctctccttggagacgtcgtttaggcatcccctagttgaaacccccaaccaattggtgcaagcccactctagatttcattctcttgtggcggcatcctagtctctacaagttggctgcgtcggagggcctaggggggagaggagttccgttctctctctcaccctctctccctaactcctgaagactggatagagcgaggctttgtgttgattgtaagggttgggttttgtgcgatctcggctatgtttctttgttggcctaccggcggttggtcgcgcttagcggcggtcagtcgcgcttagcggcgtccggtccgttgctagccttctcctaatgttgaaggtcgttagcgatcagttttgtccgtcaatactaccaaaataaaggagaactagtcatgcttgcaaagcatacttatgttaaaataataaatattccactagaactaggattactatcctcttgcagagaatgaacacaaaatggaggagaatcgacatcaaaacaggcgatcaatcaatcggacgatgtcgagaatcagacttatcaatgaacgggccaagaactcaaaaatgacacgaccaattgttccaaatttcacaagtctacgaagagaagaagtccaggaggccacctggcaagttgtgggctggttgggccagcctagggttcagccgaaccagcaccagctccgttggattcagggttttaagggaatggtcgagattcactccctatggcggttggagggtattaccgacctttccaaccaccataactgtcattacctgcttatttaaggccatcactctctctatttcaagacacacctcaagcaagaagcttcatacatctctcaagtttagtatagtttatagagtatagtggaatagaaatagaatagaatcttcaatcctcggagtcttcggaagaattcgggtatagctctagtagcttttccttcttttgtaagacttgtacttttattaaaatatttctttatactattttggtattgtattactatccgagtatatgaataccaactttattatatgcccgagttacatttatcatgatgctagcttatctggaagatgcgatggtgtgggtataatgatcgtatttatgatgactctatgtcatgacgatgatattagagtagcatttggtaatttaagcatggtgtttagattactacatatcattatttgaggttatatgctgcagaagcgaggtgggccgctgatggtgatggctcagtacgggtattcctccgcgcgtgtatatagtactaagttaatttcctggggcgggtactcctccgtatttagccacagttggatggtcatgacggattgttgtaaggaactcggcaatcaagggtggcttctcgaagcaccaggagggcatcggaaagagggtattagttaagtaataatataactaggatgtatgtataatatgtatgtatactacaaccattcacccccatttggttggcttagttcttgttgttcgatccttcagctggcgtcaccgacgaaccggccggaggctatcagagtcacggagcacgaggatggagccgcgcatcagccgggagaccggtgcccgccatagcatgcggccatctacttcggtgagcgcgagctggccgtctaccgtgacgctgagcacggaatgcatagtgccaacggttgtctcgccggacaacgactgcttcgcgaaccacaccacggactgcgtcaccggctgcgacgcattgctgctggcgccgaaggggaaccacgtggtgaggatgaatttaactacgttgttgtcggacaagttgaagcctcgaaggcggagtcgcgggatgggctggtgatatagagaagatcgtgcaacatccgccacagtccaccctacccccgccgttcgctgctagagaagaggaaggccgagcgccgtccctgccccgccgtccaccgcgctagagaagaggaagacaagcaccgcccctaactccgtccgctgacatgtggagcccaggtaggtcccactcaccatatcagccaaaagcggccgctataccgccaggatcaaagttgatacgttattataaattgggggatgagttatatcgtattttggtttagggatgaatttcaaactcgacgataaattaagggacctaaagtgaacttatttctctcccagccgacagaggtggagacctcttcgctgggctcaggtgctacggtgtcccctgcttgttccgatgtggctggctcgtgggcctctcccaagtcccctgcgtcgctacccagaggaataagttcatctgaggtcccttaacttgtcaacaaatccgatttcatccctcaaccggaaaaccagacacaacgggtccctcaactatcaaaaccggtgcagattaggtccctcgacggttttgagggcggttttgactgacgtggcgccaacgtggctaatttgactcggtcttcatctaacgtggcattgacgtggcacttacgtggtaattcgagctggaaaaataataaaatctgcgggacccacatatcaatctcacacaaaaaataataaaaaagtggtgggacccacatgggccccacaagttagtctcacacagaaaataataaaaaaatggtgggacccacgtgggccccatatgtcatccatctcaccctcctcttcttcctcctctctttctcccctcttctctctatcccctctctctccccgaccgatggagcggggcaagtggcagccggcaggcgagcgagtctctatcccctctccaccgactcctgtccatcgcagcatgccggcgtccccggattgagctccccaccgtgtcgaacctttcccctcctctccattcctaccgccacgcggagtcggccgacgctcagccgagcacggctgcgccggctcgcccgcggcagctctcctcgtgtcgcccttccccaccacgccggtccatcctctccatccccaccttcgctggccatcctctctatccccaccgccgccggcctcctcttctccacaccgccgcgccggccttcccaatccaccgccaccccgtgaagctccccttccctccctcctttgcccggcgccgcccgattccttcccaaaatctttcttgagttttgggccaaaagccttccttacatttcaatcctatgccagttcgctacctccctccgtttggccttcttgtttccacccagccacgagtgaagcagttttcagccctaggctggtccgctacctccctcatttggcatgtttcgttcgacccatcaaatccggtcgaatctttcttaatcacccaaaattggttgttttacccaaaatcagagcgtaaaactcaggataaaaacaattggggaagatcgctgtcatcatcggcaaccattagattaaatccggcgaaataaagcccagaaaatcatggagaaaatgacgagggatgagtgggaatcgatttctttttgcaatcaaattgaagtaaaaacgcacgattaatatggcgccagcgtgacgccaaggttcaactcggtagacgtgccacgaataaatcggattaaaaaatcgtacaagaaaaaccaaaaacgcatgggataaaaacccggtgataaaaaaattgatgaaaaaaccaaaagcaccagggagatgcgtggtgaacagatcggatttaaaaaaccagacgaaaaaaccaatagcgcgtgcgtacggtaaaactatttcgcgtgaaaaaagtcaccgatgaaaaaaaaagggacttttctttgtcttttttactggcgagacccttttttacctgagtcggacaatttttttcacgacagaagttttttttatcggtttttgagtcggacttttttttccctttttttacctttttagtcggactttttttcctttttaccgattatggaaatttcttgttcttttaggtagagatagagattaaaaataaaacataaaattacaaccgattcaaacacggatgacgtatcaaagtatcagcaaaaacatcttcaatttttataatagtagatccatccaagaaaataaatttgcacgggaccgctccaatgcttctactttgaaggattcatgcatgcatacaggccgtacaataagaggaaatctactatatatatgccactaagatcaagtttgcaccggtgggacaacttgccatggacgagtagattctctcttacagtaaacaaccagtttttgcttcgaattagtgattgaattgttcccttttctagagcttagtcaacgtttgcggacataataatatgaagatgaaacctagtgtttgcatgctcaaataatagtatggactaattgttgctgcacaccagctgcaattaatttcttttgcagaagagcaagaatatagcaacaagcaagcaggccttcatcttgatactccaaggaatgccatatcgaccacttcccactagacctctcagcaatggcatgaagcacagcaccagccacccacaggagatgaattcactgataccagggccaccgggcaagccttccgttgtcaccaaaaccaccctccatgctcctacagcgattgcaatgacacttaacattgcaagtgctgtcacgggaatgaacaccgtcgattcgtcgaaggtgaacctccctggctcaggctcatcggtgttggaatcaccatctgatgtgctcttgtctttgcgggtgacctcgaacacagtctcggagaagcctaaggtcttgaggatgacggtaagaaatgccagtagccaagcagaagctgaggtgatccgttgcatcctgtggttgttccaacatgcacgtgcagactgcccacactctatgaactccatgaacatgtatgtgttataggcaatgaatagagctaatgcgatgtagaaaccgtcttctgatgtctgcaatagtagagttaatagttcatatatacctcactctctagccattcaattggaaagatttttttatctttgaatatgcaaatgaggtgcaacactgtgttaagaaggcaaggagagtacagaagattataaccgatgcattggttagtgatgcagtagtacctttggcaagaaggattggtttgatagtaagcaataaggccccaacaatgcatagcacaattcgaaaggtgccctcacaggccacacatagctgtgcaggtatgcaaggcattgtcggaattggagactcttaaatgtggttgtgaggattgggttattccgactgatgagtatttctaaaaaacctgatgcccatctcttcaactgggttaggcaggcgggccctccatttggtgcacaacccatgaatgctggtggttcgatttccatcagcgtggatctccaacccgctgcatggatccgttgtccggtcaacacgtcttctgtcagtgatccatagacccaaccaacctgtgaatatatggaatgacatttatgaaacatatagaatagtaaattaaactgcatagtaacatcctatagacatgtggcaatggctgtacctcctgaccccaacatgtgccaatctcgtagttgcaggcagctacttctttggcaacatcaacgcaacttgatatatctactattggctctgttgacaagttcccataaatgacatccctggctgattccttaaaattatttgaacttccgaatttactatggagctccttgttagatgaataacctgaagaattaaatttgaattctcttactagtttaggctgacatgaaaactaatactaataattgttgttgtttgtgtttacataccaaattatgattagataattataattattatcatttctaacgtagataattaaaaagaaaagcggttggccaactgccaaacgtcaaaaaacatttgcagcaaacgtgattattatgatctaccgcaataccaaatggagccctaatgtatgacaatcacatcagtgtttgcccaatttcacctgtggtgccttctcgccctgtctcatgccgtaaatgactttctgcggtgaaagcagcctgttccacaataaaatatgccctgaagccctgcaatcccacgtccaactttctgaaaatcacacaagatcatcaacctagtttagttggatcatcaactaaattaaataaattatcgtacaagcaagagctagttgtgtaccatcaaactaacttccagctggttcccgaaaggatcatccttcaaggcaccgtagaatttctgcggcgtctgaacaaacgcgcagctgatctcatcgtcaaaacctaacagaaggcacatggcatggaggacgacccgggggttgtttacaaacatgtcgcagtctaggtttagcatgaatggggcgttggtcatcagtgctgacacccttgtctgacaaaaaatcatggtaagaacaatcaaatatctgaacttccccaatcatgagtaacacaaacagtgtctgaacttgccgtgttggtgagtaacaaacattgtctgaactttccatgttgtttagtaacaaatagtgtaccgagaggtaccatattttctggtgtaaaacttagtacctcgatgtattaaaatttgtgttgcaaaatttcggtatctacatatactctctcaataaccgtaaaatttctctagtaacaaaaagagctatgtagcactgaccagggcattcatggcgccagccttgtagtgatggtgtaggttggggctcttctcccttgagacgtatatcagacgagggaagccatctcctgtcctgctcctgttgttatcccacagaacctaaatcatccagcagagaaccaaaccaagttaagcacagaagttcagggtcatggtgagaaatgagttgagaaactctgtgcaagggacacactttggagttggagggaccagaatccatatttgaaagtttttatatagtcaggtggggatcgatacctttatgatagtagggtggttccccctctcaacatccagaaactctgcgaactcaccaccgccgtgccgcagaagggaaggctcatcggcgtcctcgatccggtggaccaacttctcatactcgctctgaaatgtttgcacataaacaagatggccatgaacgaattaagatcaggaaccatgactactcaatgataacttcgggtccattcagattgatgccaaaataaaccttatcaaaatttggcaatgctaaaattttgataaattggcaacgttgccaaaattttggtaggattggcttaatagtattgccaaaattctatacacattgccaatatttggttacaaactaaacgtagccacataattatacattttaccaaataacggtatagttgaaaatgccatcaatctgaataggcccttcctttcgcttgtgctgttttggactccaagataaaagcgtgcatcctgtaaccacggttctacataccggtttgcatatatttctaccggggaaccgatagaaacaaatttcaggaaattgtcaaaatttcagaccgaaataagttgaaatttgaacaaattttgattaaacttaaataagatatgtgtaattaaaaaactatttcttttgccaacataatattctatcagggaccagtagacctggaatttcggaaattttggaaattttgcagtggaacattaataaattaatccctactagcaacgagatatgtgtatttaaggagcagcagctaaaagatactaaactcctcctcagaggcaagggtggttaacactggtttggctaaacaaggaagctcacagaatagctaaagaagacatatcgaaacgctgcatttctgcttacgaaaaagtgtggaaaatgacggccgttccaatcgattataaggccaactgtactggtacagtggtacacggaagacaaaccgatacgactctgccattcgtgacgagttgtggcgacgtggacgccaaaatggccgggctggcccaattaatcaggctgattcgcgactaatcgtccgatctactaattgactccagcagcagccgaactaaagctcgttacactgagcatatatggcaatggcattcaattctagatcaatcgacgatttaactctggcaatatgaccggtttacgtactccctcccggttacataattattgaagttacgaacgatctcaaaaatatatatttaattatttttattataatatataataaataaatacatttttacactttgtaaaataaatctgtacatgttgttttagaaactttaaattaaatattttaaagtacttaagggtactaatgtgcttaaatatcacccaaggtggacggccaagcaaatatatttatttgttttatgaacgttgaaattccgtataattctgactaataatccatattaggattaatcacttgacggtatcctacccattcgacgcttcttttataagactgacttaaatatcggtatcccggatttcatctaatcgattttaatttagagcacgagtcaaatcatgtttccttatatttttaaatttgttagtacttccaaattggaaaaaaaaaaggaaagaaactgagacgtgctgtggttatcatgttttccttatatttttaaatttgttagtacttccaaaatggattaaaaaaagagaaagaaactgagacgtgttgtggttatcatgtttccttatatttttaaattcgttagtacttccaaaatggaaaaaaaaaagagagagaaagaaactgagaggtgttgcggttgccatagctaaccttcatgaatgtccagtcctccaagaacttgccatccgccgggccgaactccggcgtggaggagaagtaccggaagggcgccctgacggcgacgccgtgccgccggcagaagggcacccacgtcctggcgaaccgggcggcctcccgcagcgcgtagcacgtcagcggcgagcacccgtcgtcggagacgtagcacgccagcttctcgccggcggccgggtagtcgagggcgagcagcgacagcaccgtgttcacggtcaccagcggcggctccagcaccgggtccgccgtcgtcacgaacatgtccaccgccgggagctcgtcgatcctaacaacaagaaagagatgcaaaaccaaccagctcgtcagaatcatcttcttttttctggatgttggcttgaatcattcctgattaattcttgggcaccttacctttcggcgaggttctccgggaacgtgtcgaaacggacggggctccacttggcgttcacgttgagcagccacatgaaggtgaaccacgcctcgcaggcgagcgcggcgcgccgccatggcgcgccgctgtcgtggaggacgcggtggaggaggagggcgaggaggaggaagaggatggcgaggtcggcgagcctccacgcggtgcgccggatgggcaccctctcctgcagcttcttgttgcctctagccgccgcctccattattgccggcgccagagcacttgcccccacagttttatcgctctctgaagttctgaactgaaaagatcacgggcataacagacagaacgatccaaacgaaacactgtagttgtctccctccccatcccaaaataaattataacttccaaagataaaaactttatctaaaaaaatatattaattcctaccctcctatagctgtttttgttgtacaaatcaaagaaatttaatctatttaatgccgcttagtacctaccagtaaaagattatttgttttagggaccaaagtagtagtaatgagggatattttagtcttatgtccttctccctgtctttttattgggatatgatttttttttctacgacaaagggagcgaatgtaaaattattcacacatttaagtcacttttagatagaccagattacacaaagaattctgatgctatgatgttaaccttcttcatgttttcttccttccactctcttccccactaacgcataacaccagatcgaccgatcatatcgtcactaagtcatatcatcacgaccttcctgcctaggtctctcttcctctccccatccctccatcccaatcttaaacatctattcttctactccgcccccaagccgagtggtggcaagatacccatgtcccataatctttcccatccttcgaggctcaggcaacgagatatgccactattgacttccataccctgtcctagaccctactcaccctccttcaaccctacaatcatgtgccactactaccttcctatccattaatagtggcggattcagaaagaaatagcagtaggtctgagcaaactagatatagttacagtcctccctcctatctatatatggtaaaaaattttagtggggtctttgtggggctctcatagtcttcacgccagtagtggaccgtcaatgtccgccgctcaccatcattcctccaccaccaccactatatccgtctaagtggagagaatatcccaccaccaccatatccgtctaagcagagagaatatcaggtgctactgcacaataatgtgctaccgtgctaccaacctcgaaaaatacatccaaaaaagtcacaaaaaatgtaaacaaattatgatatgtgcaacacttggcatacaccaccactaaaaaaaatcagttcacaatacgacgtacacagtgagagaataaaaagataaatctcaggtgaatagtaacataatctgtttgaatattactggagtacaaatttgtttttttttctcattgggtacatcatattttgagctgattttttgtgtggtggtacatgtcatattgttgcatatctcagatttcttttttcacatttgttgcaaccttttggatgttaattccagaccgccggcgagggtcaaaggagggacctggccaccccccgtactagtttagttaggtcggttctttgttgtgaagtattcactgcagcttgggttcttcccgagttgggcttttgctagcatggtctcatggatgctggagtagacggcggtggcagcggttggtggcgatggagaagtgggaatcgatgatttgcggcggaatcggacattgaaattgtctcctctaagcagcgccggcttgctcatctggatgggtggggagggaacagctccccgtagctctgatttgatgttccggcgcgacaacatcgtcttcagcttgctagtcgactgcctcgtcttccggacagcagttcattcgccaccattcatgttcttgggtctttatgggtggctagatttgggtatcttctacctattgtttccttgaagcagtgtgcatgcaagatttgtcgttcgggttaagctcaaactcctctgattcagcggtgaactccgtggcgaattcctattgagcctggtgaaacccacaccaaaatttacagctcagcaacaaacctccaattatgtcatttctgtgaaggcaaccgaaggtgattacatgttatcaagcagtgtgtacgtcaaaggaggcctaaggatacacaatcgtcatggcaacgccacagttccctatcgatttgcacctctacatcttggtttcaataaaaagtttgcaaccttggtgcagtttcccattctttggaatcggatggctagtaactttcggccaaccaatttggtgatgtactaggattaccattgaaaaaaaggattacctggtgatgtactaggatttccacataatcattgaaaaaaaagtggctcccagaaaagaaatgtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21338 - DNA, 728 bp, Oryza sativa
tcctgcagccccgccaagtggcaggtttgagctgggctacatccgatttaatactaggtggctggtgaaacgatgggattttggtttgactcgttttaagtttcttggattgcttgggatgagggggattgcgcggaagaattggaaagattcgaagtagtttggtttagaattaggatgtgagaataacccaaagtatagtttgtccgtcttctaagcttaaggttccagttattcttgaaaaaagtactaaagctttgactttgatgcatgtgcttcgttgctttctacctttttggttcttctattagagcatttgttcataacgatggcttgcttttcgttgacaagatggactatgcgttgatttgtttagacttcagatatgggcttgacaccaattcggtatgccatggcatccctgtcgtacttgaaagcttgcttttggtacttatgcataagtagaaaacggacaatcgggtcttttctttcttgcaaataaaggtgtcattttacttgtgaaattttctgctaaaggggaacacctagtaccagtaacaaaccattgatttgagatgacctatgaaaatatgaggtctgaattttagtgctgattgtggttttgttttcttttgtcagcttgatgagttgcagcgggctattaaatcaaattatagtgttgtgttagctggcaaagatactagagctcggcatgatgactttgtttc

SEQ ID NO: 21339 - DNA, 6535 bp, Oryza sativa
atggcagcgatgaacaatcatttgatgatctgcccaaggtacctttggttaagagccctagctcttctgtattaatgaatgccttccaatcaaagacaagaatgaagacaaagaatggagccaagaagttggctggagctgaccaacaggatgttgtggaaactcttcctctgacaaattctcgctcgtgccaggtgtgggaaaaaaaatctgaattgcatttttcttttccaacgcattatttgtatactattaattacgtacatagcaatgttctaagccaatgttggcttattattttaggggtttgatgggttgtttcaaagaagcaaaagttgcttgagcacctctgatgatgaggataactgcaataagaaactttatggttgccttggtgcattccgtcggctacttcagaggtctcagtatcaagttcaatatggacgtcctattcagttacttatcctagcaattgttgttttactagtctgtaagttacttttcctatttccttcataatgttaatttgatgggacctttatcaaatagaggtgaaatacagattgtttcaagcgtctgattatacattacaatgcctttactttgctagtatctttaacatattgtattgttcatggaatttgctaatctaatgttttcgtaatttaattggtctgctagggcttgtcgccatggtgctatataacataagttttgttttgcaccagattgaatctgtaattgacaacacctacttattaaggacacggattttgacattttgtttccattatgttgaattttgacccataaattgttatgccattaattgatcactttttcaattttatctcatttatatcttatgtactgtagtatttttctatctgtcccaaatgtttcagttcctagttcaaccaagtattttgagtttgttatatgattgatgagctcattgaactcactatgatttgttttgtgtttgtttcagtaatttatgccatgaaggcaattttgtgacttttttgatcaactagtgtctcacgattgacttgcacttcttcatcagcagtctgtaaggtatgcttatgatttgtttaatgtaatttgcaagacaatgactgctaattagattttttactgtgttcaactgatattttttttaacttgccaaatttctgcagttgttttttgtatatgttttcttaagttgatctttttctgcgcataaaatattcggaaatttctaaactctttggataagaaaaacatgttactactatatagtagggcaatacgaagctaggtgtacgctttgataaatctataattcaaaaatatgttcatagtgttagccctactgagtcctttgtgatgaaagttgcttatacttatcagtcatattgaggaatttctaagactagcactgttcagcagatttatgaacatcttttccttataatgcaggtgtatgacaattcatagctgatgaaactaaaaggggaagtggtattgtttctctagctagttgaatgccagtgacagtgaacactgttttgtatgttcgaagggattctatcataactcgcaagattgtcttggctatgaagaaacaacctgacatgggaagcacaacatttagcaacccaatatagcaaaatcagtgaaggattgattgtatggaccggcagatcatttcgtgtgccttaagcccagaggaactgaacaatcatcttcatataccagttttgctgatgctgcatctgcaacattttaaacagtctggtgcagtactgcagccttgttaacctgtgcaattcagcagtacatagagctagaatgctgatgctacaactggcaaacaacagttttgtgcacgcagctgtggggtttgcctggataattgagtggcatctccatgtactgtattccaattactgatgtctcaagtatagtgctaggtggcatgaactttgcggaagaatttgagtacctatattttgatgctatagattggcttggagaaggctgaaaattcatctattaacacaagtatcgcaagagctgcaggactacaggtcttgcagcctgtacagatggttgtgttttgtacactagaggtgcagtttagaagaacagaaaaattcttctgttcttagacattggagtaacttttaccacacgattggcttgtaacctgtaaataactactgcttcaaatgagcacctgttcttacaaatttgataatgttgggtgtcggtctgcactgcaacatccaaaaaacctttgtaagtaagcacatgtcaacagcttgaaattcaacatacttctgataaaacgcactggttcatgttgcgttaaattcacatggttacctagttctcggaagagctactatcctgacactaatgatgcaaaatgtgaactgcatatttctcgggaatgaagatcacatcagaataataaaatgacataacaaatcggcacgttgagctctgtgttttcagatcacaaaaagcttcttacaagaaacatgccgttttcaaaaaaaaaaaaattgcagagcttcacaaccaccctcttgcagaacaaactatcccctattttgtacaaacaattcgacaccaaatttcattacacaggcattcatcaacttggtcgtagtataattagctgcactacgttttctcctggctgttgcaccgagtgatctggctgacaaacagcccaaaattatgtctaaatacaagctgtgtcctcatctggaggccatcgaccagaagttcaagacgcaggacggtgcaagtgcaaaccagctgatgaaagccatcgcggttgcagtttcgaaacttgcacagtgattgtttgcgcatatgttcaggtcattgccaatgagcacggtgatgcctgctgatgcacatgctgcacctagggttagtgtccctgtgatctacaaaaatcaataacgttgttcaataggtattctatttatgcaaaaagtaaaaaaggaatcttagcaaaaatggccccttatttatagaaagataaaacactaaccccatctccgatggtaaatatacacacagcctgtggattccgcaaagaacgcttcacaagaagtgcataaatatcaacaacggctagtgaaaggctccacaagcattgcaagatggctgctgcaacaaggtaactggaccaaaaatagaaccacattagtaaatttagtgacttactgaagaaagctttggatctttatggtaccgaagtatgtcacaatgaagataaatgaacatactattaagactaaacatgacccctgatgttaaaaaacagtttcaacatgctcccttcagaagcatgtaatggttttatattagttcattatgatcagtacattatgaattatgatagcaaagatgctaaacagagttcgcaatttaaatagcgaaatgcaaccagcaaacaagatgaagttaaagttaatgcatcaaggaaaatggcttgactgaattggaaaggaggcaaaaataaatgcgaaataacatgcacaattttgagttcctctttcaggttgccaaattaagtaaaaaaaggcatacaacatttaatcccatagaaagatatcaacactttgtcccttttttcctggaaaaataacacttctcaacataaatcataagtaatcaagcaacaataatggtttcttctagaattaattccaatatcatcaatagagagtcaacaaaaatcgttgattgtcatgccaggaacaaaaaccacaagggaataccacagaaaatccacaacataggcacctagcatggggtgacaaagagtctaactttgggcataacatgcatcgacaaggagtcaaactttggtcgctagtgacaaatttaaagagccatatcagttggattatccaatagttggcgattgtttagattatccctgttctcatgtagttgtcattttccctctaactaaagcataacgggattaacggcaagtctcaggcctgaacctcttatcatctccgctgcctccaatcagtgcctgagtgcccactgaaggcgaaaattgttgtcttgaaccactaacctctaacatgcatggttgtagtttagttgacgtaaagttggacagtcaccacatatatctcgattatatgccacccaaatgcgcagcagaataacatgaatgcaccttacacattagaattgatgctctaagaaaaagctattctacaatgctattacaagagtaaatgttaatttgctcggccaacaaggggctcgcttaaagttgatcgataggcaagataaacaaaaaaaaatcagaaccaacatatctttgtgtgcattcagctgaggtagtttgacctaagcagtgggttgtggtagaacttacaaacggtattcttaagttccatttcttcatataaacatgttttgttctcatgtttcgtaagtactccgtaatatatatataagaccaggatgtaactgaacagaacaaattaagtgcaaagtaggcgactaaatttgttggactaattgagccgcgtgattcgagggatccgcctagccaagaacatgctaaattagtagtactaccatttcggttccaaagaccaaactaacaacacacaccaatttcaatcctaaaagggcaaagatttggtaggagagggggaccagacaaaggggggtaaacagaatccaaggaagctcgagcgggcgcaccagaaggcggagacggaggggaagtcgtcggtggaggccatgacggcgagcgcggcggcggcgaagaaggcctgcacgaggcggaggccgaggccgccgggcgtcccgggcgccccgggggggtccttcatccgcacccctcgtggctgcgcgttctccccgccatgcgccgccgctccacctcctgctccaaccccggcctccaccgccaccgccgccgccgccaccgccaaagctgccggcggcggcgcctccaccgggtgcaccaccggccggctcgcccgcatctgctcccctccccctcctcgtcgatccaagatcccctcggcgcggcgggcggagaggattagtagcgcctcctcctcctcctcagcggcatccgatctcgccgaggcgaggtgcgaatcggaggagatttagaggaggagggcgtacggccggcgtctctctctctctctctctccttctctcctcttctttggcttcccatggaagggaggatgaggaagagttggtcactacagtggctggacagtggggcccacaggtgggattgtggagagtgggccccacctgtcagtaactcaatgggggatggctttttctttttttttactaaatgggtttggtcgtttggagaacggtttggtgaagcaaaacagcggattgtctattcaggttgagaaactttgagagagggagagaaatagaaattgcattcaacatctagaggatcataacgattccttcaatcttttgaaaaaaatgaaactctatttagtttatctcaatgtctatactggtaaagtctaactaaatttttagttgggataagatggttctactttattataaatcttttatagtttatatggaggttcacaatttcctagtgaacatattctggtgtatggacactaatttatttgcatgactatgttagaataatttgcaagtgatctataacagtgtactttggtgactagggatttatctttgtgggtgtgtggatataatatacatatttgggatttttatgtaatcgaataaaaaaactatagcattccgtttgtgcttagaaaaggtgttttgcaatttgacattcggtaacgaatgaggagatgttcgataaaaaagagcgaggagattattgtatctatttaaatttaaattataggagattgtatctatttaaatttaaattatagttatcacagggttatatcgaaaacaaattagttaccatggaactttcgcttttgaactaagttattattttcacaggaaattaaggagaggaaattcattttggtgcatgtggcccatgacttttgaggctttggtgcacgtcagctcatcaaccgtagcaactaattatggatgaagatcttgcagctctaaggtacatcgtgtactcgtggtgcgtaatgtttcgtcgtgatttgtatatgctcttaattaccatctccaagattatagtcatcccttggctggcagttggcacgaaagatgtggatatcacataagctacaagcattaattaggagtaatctgtgacacatttggcatcgtcgtcctggaactagcagctaaaatatttctctcagaaaatgatttgaagtagaaaaaacactacgtttgcttgatcaaaaagtttaccgccacgtaacgaactaacgattaatttcttttgagaaagtcagtacattaatttgttgatgatgttgatgatttttttattgattaggaaaaaatgttatagaaaatttatagcatgggctgcaggaat

SEQ ID NO: 21340 - DNA, 409 bp, Oryza sativa
tcctgcttgcatccatagagataaaagagtggcagggaaagggtgagaggagggaagaggacaactgaacatttctgtttaacagagtatttattctatccttaaaaaaatcaattgtttatatatcttgttttaagctatttattaagttttatttctaaaatatttaacttatccttttattttacaaaatccacatcaataatatttttaaaaatctaaattaaattgggccttaggtgacttgagaagaggagagacggagacactagtggtggcggtaataggaaagcaataccaacgagtgacaacaagtctagaggcggtagtgcataggaaggtgggggtgtcactactctagcagggagaaaaggaatccgtcaacaggctataccccatatatggtatt

SEQ ID NO: 21341 - DNA, 230 bp, Oryza sativa
agcaattcaaacaactaccacaacttacttccaaacattttttgtggcaatccaaacaacaaacggattgattttgtcacaccttagttgcgaaacaaacaatctaattttgcaaaaaaaatatggctagccacaacttagctaatacttaaccttagacatggaaatacatatctcaaaatcaaaatgacccgatattcgagaggtgggtgtaatatttttttatttaa

SEQ ID NO: 21342 - DNA, 551 bp, Oryza sativa
cgtcgtcgtcgagcagcttgatggtgctctgcttcttggccatcgccgcagcctcctgcatctgcctctggtactcgctgaccccggcgtcgtcgccgccgccgccgcaactgcggggcaccctcccgtacacgtcctcggcgaacgcggcggtgtcgggggaaggcgggaacccggcgaggtcgacgagccgcgccgcgaggtcacccgcggaggcgcactcccgcgcgaggcggacgacaagccgcgccacgaggccctgggagtatccgaggagcgccatgaggcggtcggagacccacgtcctgagctggccatcatcgctcgccgccatggcctcggcctccgtagcctcgtttgcggcggcggcgcggcggtgccgcgagaggcggtatcgaagggggttacgggcttgggctttgtggtcgccggtcggtggtgcggccaaggccgctttatccgtgcgtgaccgtgtttgtgtttgacgtattcgacgtggaggtggctccgctatggcggttcgtgtcagtgctgggaaaccgggaaccgac

SEQ ID NO: 21343 - DNA, 222 bp, Oryza sativa
agctcccgcaggcgcgacagcacggcggcgctctcgtcgcagacgtccccgatcttgatgtagctgtagtcggccggcggcaagccagctcggccgggcgcccgcagcttctccctccacctcgccagggccttcgcgaggttctcctccggcgtctggccggccgggtagctgacgcccagtgcctccacctgcgccgcgttcgccggcgtctggccggcc

SEQ ID NO: 21344 - DNA, 979 bp, Oryza sativa
ttatccggcctcagtgcatcggcaaaaccagccatagtaaaatcacagtgcctataataaggtttttggattgttgagattatagacatataacgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccatcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtatgaggcaaaccctagattgattttgcgtatatattgcgtgaagacggcggatcggtttatatagagaagggtcgcttgatcagggcgcccgcacgatctctactgcgcgtaaccgaaccggataagtcgcgcgtaacttatccggactccacgctgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgtacgcgcgccgcctgccctgccctgctaggccaggccaggcgaggcgagagagcgcgcgcgtgtgtttcccctcttctctccaccacacatgcttcaagcgactgggagggcatcctcccttttaaggaggtccccctctcctagaataagcaaggtggtactaaactccacatgcatgccatcccatgagg

SEQ ID NO: 21345 - DNA, 622 bp, Oryza sativa
acaagatagcactaggaacaactcatgcacaactctgatatatgaagtttagctcaaacataacagtattttctcttttctttctttcttctttcttcttttcttttttttccttttcttttctgttttttttttgtgtggctttttttttctttttttttgcacctttcttcctttttttcacttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaagggaactgatttttaaccaatccaatctactatatctttccaaaacaatcttgactacttccaaaatcagatatggtaattcaccttcctcctctcgtgcacgaca

SEQ ID NO: 21346 - DNA, 309 bp, Oryza sativa
aataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattg

SEQ ID NO: 21347 - DNA, 617 bp, Oryza sativa
tgatttaatggaattgtctcttttgcatgggaaattatcacccaaaatggccctgcaagtgcagtatatttaggtaagaaatctttggtgttaactgtaaaatgtgcaattgtataaacttctttatccacatcaattcaatgcgcaaatacacaggtgcatatgatgatgaagaggctgcagcaagagcttatgaccttgctgcattgaaatactggggagctgggacacaaataaactttcctgtgagtcatctatacttgctaattataattggtttcttagcttccatttagttcttctacaattattaaccacacactgccttttcttcaagaccttcatttggttaaatttaatcatttatattttgcatcacctgagctcaatttcgaagactgattctcttaagatgcaaattgaaaaccaaaagatatcttagagagtgttgtaccaaactttggatcatactagtccaaacatatcctatgcaactattgtgtgatgtttgaaaaatctgaatactcttgactattatattatgttcttttgtatgcaaaggttagggatttattcagtttacacttgacgattcggagatggatgtttgtgtcctt

SEQ ID NO: 21348 - DNA, 706 bp, Oryza sativa
ctgccgaatctgcatacgacctccgttttcggcccgtgagtacttgatggaaagctcttggagtcctctttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagttaggtaccccttcagggtttcttgggttttgttagattaaagtttagccattgctatttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccgcggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaagatctagtgggaaatcgagggaatcgatgatggggcgaaa

SEQ ID NO: 21349 - DNA, 427 bp, Oryza sativa
taacgcagagaagagtaaatctgatggtgctgccagcggtgcaactggctcgtaaccagcttataccttttgtaaaccgttgcggacattgctgtagctgcgaacctacattaggatacgtactcttgcgaaatagaaattgtggctagtttgaatcggactgtgcggatgatggtgttatggtacatgtgagatttttcctactgatctgggcctccagccatatactttagttgacagtttctgttttgaagatctgtgctagtaacatgggtacccatagaccagtgatctcctttcagtaggtgttgatttctctaaacaccacaattatacatttactcaatgattgggagaccaaaaatagtgcaaatgcaataattatccactgaaagaaaggtgcaccagaaggctatcatgtctttgg

SEQ ID NO: 21350 - DNA, 607 bp, Oryza sativa
ccccctccccctccccctccgctgccccttcccattccccttactcgcctcgtcgccgccggacgccgacgccgacgccgacgccgacgacgaagatgacgccgacgaggcgccggccttgctgcttccagatcccatctcgcgccaccacaccaccaccaccaccaaccccactcccacctctactacagatgagcggatcggggcaggccgcgcgccatcaccatcggcattgctcggatttcacgcctcgctcgcgcgtgcgcgcatggatggccgcgaaagggaagctagtaggagtagctccgctccgcctcgctcctgctgctagcctagcaaccactctctccttccttcctagcgaggcgaggcgaggcttgcgaggcagtcagagagagagagagagagaggagaagagagggttcggtaaaattaactaatgcctctctctcttcgatttgattggattggatagttaccaataatggcgtcctcgtggacttcagccttacgatgagtgtgcaataatgcactctcctctctctccgagacaactcctcgcttcctttcaccgagaatttccatttttctactctcaaatttactc

SEQ ID NO: 21351 - DNA, 720 bp, Oryza sativa
cacatatatatacatatatatatatatatatacatacacacacacacacatatcatgatagtaagttacttggctagagaatttgttttgaatacatcattcgcattgaggtacgactaattgattgtattagtactttcaaaaactaaaattctatcttttcagttttatatgtaataacaagttgtgcattctacagttttatcatgagttcgtatgcaaaattgattaatcacttcgatttatcatcacacatggtatttagaaaatctcacttgacgatggccatccgatctaaagatacttcgactatagatttaatgtaatacctcatcaaaagtgctatttgctgcagagtttacgataacatccactatcaagatccgaccgccatcttcaaaaggaactccgaataatactaagtggatctgaataatatgaaatgcatcgatcgattaaaaccttgcttttttaaagtaatcaacatatacaaaattactagcacacgtaatcctgaaactaatacctagcacacgtttttagtacctttccacgggtaccttcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggc

SEQ ID NO: 21352 - DNA, 9890 bp, Oryza sativa
tatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacataactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaaaaaaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaagaaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaagccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtctacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccacgacctggcaaggatatgacataaatggatacacctttcacacggtaaagcaagacagcaaatgcacagtgcagaacagtgggttacgcatcgaggctgctagtgacggtggtcgtcgtgatcaatactatggtaaagttgagcaaatattggagctagattacttgaagttaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccacgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataaaataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgttgggcccgtcacaggtggtcttacctgtgacggctccacggttggcgcccgtcacaggtgacctcacctgtgacggccacatagttggcgcccgtcacaggtgagtttgactagggttgacctagggttggacatcttctagatcgatccagatctggcacccactctcactcactcactctctcgaccgccgcctcgcctctctctctctcgatccagaccctcctcgccgccgcctcgacctctccaccgccctcctcgccgccgccctctctgccgccatctccgccctctctgccgccatctccgcccttctccaccgccgcctcctcactcactctctcgaccgccgccgtcctctccaccgccatctccaccgtcgccgcctcaacctctcctccgccctctccgccgccatctccgctgccctctctgccgccatctccgccgccctctccaccgtcgtctccaccgtcgccgcctcaacctctcctcctccctctccgccgccatctccgctgccctctctgccgccatctccgccctctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacaccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctaaattattgtgggctgttttattatctacacttgccccttgctgtctatgtttgcccatgctgttgcctatggttgcaactgttagttaaaacttgaatgtgtagctagtttgcaacttggatgtggatttaagtgccatttggacatatacctctacacttgttctttatggataagaacagagtatctacacttgttctttttttatgcataagaacagattttctgcacttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggacatataatcattcatggagtgtgtactgctatatatgttgctagacctattgaattttgtggacttgcatttatactcctcctgctgctgttttatgtcaatcatgcaaattctgtacccttgctgctgctgttttttaaatttgcatgattgattcagtggttatatacctctacacttgttttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgttgtttatgtgaatttccaccctgctgttgctgtttatgtgaatctccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttatttgggttgcttttttctcctagtagctgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattatgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatataagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccgtcacaggtgacccacctgtgacgggcttttactttcgggcccgtcacaggtgggtcaccctgtgacggctactat

SEQ ID NO: 21353 - DNA, 3445 bp, Oryza sativa
aacctagataccatagtggctaccgcacacactcatagggacatgtaagcatttgcactattatgtttttctacctgatttcctcactcactcaaaccaaaaccatcttgttatcctgtatgataattaatcttcatcccatattttttctcaacacaatcagaggaacttgtagctcgaatcatattatcatttaacacaaataatggactttattatctcaaccttatcatgaactgatatcaattatcgaaaagtcattgttgataatgtgtgttgagtgcttgcaggtgcccgataaagcaatacattggaacagaaactaattagtttttatacaactctttgttagatatcatatgacaagacatatataggtgcattatttttcaatagaggatttgcagatagcttttgaagtatcactgtcatttctcttacaaacatcatgcaagaggcgaaatattacataatcagaagaaataatctcaattataccatactattggatcaaagaaaaatgttctaagaaaattctcacagtaatagatcctagatatatcttggtttgtaagtcgagatttgacatagaaagttttcataaagtaattttgatttattccccatgattggtgcaagcatatatatatgcttcaccattacaagtctaaaacataggctagtaataggaatcacacttcaaatcgtccatcgaagcagctgcaagagtcaccacaaccctggacactggacatcatgtgctagatcccggaaaatcagcatttgcgggtgtgacagcctgctcttcaaatagaaattgtgattgacatgctatttcaatatgtggctgtggcaatggcattctagtaccctttgcatcttgcagtacctggtagaactttgcaatggaagtgtaaggtagagctgagagtttgttgtgcagctcctccaattcatcctgccccaggagattaacttcagaagtcagtgattgcataagatgtcctgccctctccttctccattgcctcctgaaccctcttcttcttttccgacttttccaatgacttttggagctccacatattcaattttctgctgttgcgctatgtttgtcacctcaccgctatcatggtacccaccacccaaggaatggttattgggaatgcccatggccatggaggccaagcggtcagcaacatcatcaacagagggatgggcaaaggagaaacccctaccagcaggagaaatcacaacagcagctatatttgcattacatagcaatgaaagctcaccagctttattaaatagggtttggcgacgcttcgagaagcaaacgtcacgtgcatcctttttttcgatgcgcttgatctcaacctttttcctgccagcccttccctttcccttcaccatcacttattggataaggtgtggttctcctttggctatatttttcctaatgatggatataacatgctgtcgtggaacgtctgtttatatagagatttttgtaaggatataactagaagcacggatttacattgatgaaaagatatctagatttttgtatgtttggagggtatattaggtagcattcagtgcattaaaaaacagccaaaagaaatttatacactacttagagaattagtaactgtgcacatatggagagacttatctattgtgatgtatccaaatataaactcaatggaattaaaattggaatacgaaaaatgcataccatatattcgccaccatcaagataagaagtgataacaaaagggaaattgtaagggaaggaagaagacccatataagtgtgtcatctcgagtaaaatcttcaccatattgtttgtgtcactagatcaatataaaccattatttgtgttactaatgtaaatgacttatagattagttttatacattgtaataagattgaacactatagttcaatttactgaatatctattaaaagagaggttggtagaatagttggttggagataatgcacccatccttctagtgttcgactccagatgtgatgtcccatttttcttaattaattaacgattaggtcatctttggttctccaacatcttcaattgactaaataactactatatttagcaaagatacaaatggaaaatttatggacctcaataaaggaccctagcaagattgagacactttaattttgcaaagatacacgccacaagcatttttagtgttgtgttatatctatttatgttcattcttttatttcctttccaagcacttcgctgccaatacaaacctttgactgtgctagtgaactctctagttctcatatataaataaaaaatgaattcattcagtgatgatgtatgcaggggcagagaaagctcccggaccagtcgggaggctgcctgggctccgtcattgccgcctccactatcgaatgccgtcaacgtttgcagaagttgctagattgctatgaaacactattattcacccaggctcgacgatgcacctcctccgccactatctgtaaggataagtggaaggagaaagaatagataaattcatggaaagaaacaacttgtccattccagagccttctgccccataatagaaccactgttcaatttcttgacaatcacctataattttgttgtgtgacttgtccaatggttgtgtaccaatgtagaaatattatttctgttttgtttaagtgagatttctctaggatttttcattatgccgtgcagaacatcagccattaatgcatggttggtcatatgccatacacaacatcatcgattcttgttacttgctctctagtattgatccaacataaacctgatcaactgaaccatcctagtatttgcatatgaactcctagcctctagccacctagtcctatatgagtcatattcaataaatgttatgtaccatggaaggttacatatcataacaagttgaaccatcttcctttctgctactaaaactagcttaagtctattcttgcgtaaataaccatatatatcatgcctttgttgtttttactgaatatcatgcttttttgatgttggagttcattgttaaatcattaacttaggttatgcatgatcactgtcacaccctgaagttcttctcccaagcctaaattgaatttataaatggtctcaagaaaatatcggtgtaaaagcaaaagagaaaccctaaaggaattaatgtaaataataatcggaattggcatgtggaatttttcttgagttctacatgtcgaaatatgctaacatgatttttagtggaattttcagagctctagaaataatttttaaccaattaaaaatgagcacaagcaatatttaatccctagaaattcattttctcctttttctttttctttttccctccttttttcgaatgggccgccggcccattctcttcccctccccctccccgctgg

SEQ ID NO: 21354 - DNA, 11678 bp, Oryza sativa
ccatgcgcgccggccacgcgcttccgcggccgtccgatctaccggggccgtccgttcggccgcccgcgtggctgccgcgtggccgccgcgtcggcgccacgtcagctccacatggtgcgccgccccttttccggtccgtggacccggtccaccgcagaccgccccccccgagtcactgccatgtgaggctcgtatgtcggcgccgcccactctctctcccagggtttatttattgcgcaacaaatcaattaaggatttttctgtttatagtaaaaacacagtgaactttctaaaattcatagaaaattcatccgagctccgtttaagcccattcaagtctcagtaaatcaagaaaaatgcatagaatccattaaaaatggttttgttctctgtttcagtagtcttatagcctgtttgtattgtttactttgtatatcgcttagattccggctctcccaacgctccggtgtactttgaattagtcgccgaggttcctccagcagcagagcaaggcaagtcattcttgtcacttgaatatgttgatcctatattgcaaatgttctattgttttccttcaaatattgcattgtttcacaataataccatgggatgtttacctactgttatagccatgctatttttgtaccatgctcctttgttagcttgggatataacatgactagatattggtctagggattgcttagccatgcttagttcaactagcacacaatgggggaaatcatattaatgtatagacctcaggttctagtgttgatgttggattagagccaccgtcctggtgttgcttaattaaaataaatcatatagtgggctgtgggtgcatggttttgctagtcacgcccatggcacttaaggaccggttcgcgggaaaccctgaaagaatttctcgtacttaccacaagccagcgtgggcaacggctgggcttgtagtgtagctttcctctagctgacgcatccaggcaagggtgggtgtgatggagcggggcgggccttgcgacggcctctgtcgcttccggattcacctaggcacgagaggggactacccgttgcccgctggggataggggtgaaacctgaggtgtggtgtgcttggctagagggggttatgtgaacggtcctgtcacagcctctttccggtatgtcgtggtggcatgtcggcgcacggaaacgtgtcatggggctgtgtcttgtgggtacagttgtacacctctgatcagagtaaaactattcgaatagccatgcccgcggttatgggcggtcaaccagattcaccgtgattagattcaccctagactagtctaatggaattgaatagtctaggtggatggttgggcctgttgcaatgtggtgtagcgttggacagtggatggttaatattgattaattattacaactgtttctttgctttcaactactgtttataaatgctcgctttatgcaaatgaaccactctagctctcctttgatatttccctgcatcatacccctattccggtatgacttgctgagtatagtgggtagtactcaatcttgctctattttccccaaaccccagagtttgagtatacgttagatggtggtttttccgaggagtaggcttcgtccgtgccgtcgaggatgcctgtggagtggtgttcccgctgcagtccaagtcaaggcttagctccagttatctttgttttttttccgctgcatttatgtaagacttttataatgtttgtaagtcgtggatctgtatgtcaactttgtcgtttgtgtaccccggccggtcctggacgggggttttaatgcacattctgcttggaattctactcgggaatttctgggcgtgacaatcacctaatattttatgcagaattcagtgaaacatgaagcagcctttagtccccgttggtattgtagttgacgagcgggtgccggtgatgggatcaccctgcggcggtggtgataggaatgccgtgctgcggcgatggtgatgaaattcaatctttggtcccttcaacgcgcattaggatcagcaggcttatggttttgggaaaatcttaccgtacatgagttctcacccgtgtacaagaccgaaattcccttttatagtgtgttgaggggattgagggtgattccttttgaggaaactgctattgggggtgattattttcgacaaaacagcgagtcgtcgacattggtcatccaattccggtcatacaactcagatcgatcgagcccagaacaaaatctgcgccaggtggaaacccttgctccattaccctttctttccctaatatttctagcgtgagctgagtggtggcagtgatggtgatgccgagcaaagcggaggagacgacaatgccgagcaaagcgtaggtgatggtgacaaccggcacattggtagcgagctaattccatgagtctctcctcctcagttctcctccaaggtgtggccggagccacaccatggcaagcctcagtctcgcgctactgcctgatgcggcaatgggaccagttcgagatggtggaggcgaatgcacggtggcggtgatgccgcgcatcacacgcaagaaggcgacggaggagtagggtgcacgagcacggcatgagctgatgtgacacacgacgggctcttccgagttgaaacatgaggtcgatgaagacacgcgcatggcttgggtcatgccatatgtagccaactcttgcgagtggaggtggtgaggcgggcaagacgggcccccaatgagctgatgtaggtgcacatctcgctaataatgagttctcttgagccggtgagtgcttagtcccaaatttattagggtttgctttaattgggatttgttgggttcaagattttcttaatttggggatttgaggttcttaatttgcgatgcttcaagattagggttttgaattaaggaaatttcgaaattaggggttcggttaggacagaattggtggttttgggatttgttaacttcaactcaaaattcgtaattccctcctaatttctacccaatccaggaaatttgacttaaacaagcaacttaaacatcaattaaaccctaatagcacttgaacagaacatgatccataaaatttgacttggatgcaacatgaaccctaaaacatgaacaagatgatgctaggttacttgacatggcttaatggcttcattactggagtgatgggaacatgcaaatgcctaagaaggctctaataccacagtgttggagcacattcttaaatcattaacttagcccatgcatgatcactagatttcttatgtggaattcggtgaaagtactgaccagtgaaagatgaagctatgagcgctgcctttagtcgttgttggtattgtagttagccaagctggcatcggtgaagggatcaccatgcggaggccgataggaacgccatggtgcaacaatggtgatggaattcgccattcgatccccttcaacatgcattaggatcagtagactcatggatctagaagcgatgacgatggtgtcagcggatagcttctttataaaggtgggaggactaccaagagggtccaagagtcgtgctctaccagattggggcgcaccccacatgggccccacttgggccggggtcccagacgtagttacaagcccataggcctattattggtgatgcaataccttgcttctgtgattgcggccaaatgagatggaattccaagatgaggctggatccgttggaaagaggactttgagagctttccatcaagtactcacgggcccaaaacggagcacgtgtgtagatttggcggccgtttgaagtcagcaacgtaacacgtggccgaatcagattgcagcacatggaggacttgatcttgatgtcttcttgttgattcatgatgtgagcaacggttgtatcgatagtagccatggtcacatcagtggcttgggggttcataatttggaaatacaaaataaatgtctcttgagtaaatggttgtttaagttaataaatgaaaaagggggtgtggcaagacttattgaagagaaagtatctttataataaatctataactcgagttgataagaaacaaggtgatttccatttttggtaaggtcttataaaagttaagagtactttcttaagtattggttcgtggattgtgaatagtggggaacaaataagattttgggaagataaatggttaggtaacttggcctttaaagataagtatctttctttatatgctattgtcctgaggaaaaattcttcaattgctagtgttatacgatctgttccacttaatgtttcttttaggagagctttagttggtcagaaacttcttttttggcatgatttatgtgcttctattgtacatgtgcagttgaatctctcttctgattgttttagatggaactttaatcagaatggacggttctcagtgaggtcaatgtatctggctttaatcaataatggccatactgagagaaataaaataatttggaaacttaagatgccacttaagattaagatatttatgtggtacggtgttgttctaaccaaagacaatttggtaagacggaattggaatggtagtttaagatgttactgaagaatgagactattcattatctctttatggaatgtcattatgcaaagtttgtatggagaaccgttcaattttcttttggtttataccttcctaatagtatatcacatattttttatggttggcttttggggatagacaagaaaaagagcaagcttatacttgtaggagcttccgccttatgttggactctgtggctaagcaggaatgatatggtttttgataaatcaccttctatttcatatatgcaggtaattttcagggcaacatattggctccggttctgggctcagctacaaaggtgtgaggaagatggtgagcttttaaaagttgcatgtcatatgcttgcgacaacagttatacaactttttgcaaattatggatggagattctcaaatagacttcaatagatgtctactccttatcttagtttggttatttgttttttttttaatttcttatgttttgtttaacttaactctttttttagtgctactttgtaataattggctgtagctctttttgagcaaagtccgagatgttttattccattatctgaaaaaaatgtagaccctactctgtgacttatatctgggctccatagattcttttgaaattttttaaacatctaatgatatatgggtcccatttagatttatttttcttaaagtttttttggctgactttaattccacgtaaacatcaagtagaatgaagattagttcaatatgccacataaatgctgcgtcagcaatattcaccgttaatattgtcgagagagaattttattctccacgtaagagagagagaggactttaatatagagtcattataaccaattttacggttgaggactgaggatacgaatcatattcaaatcaaacttttttttcccaagttaaaagaactgggcggcttggggtgttgctgcgcgtaggaaaagaaggctccgcgggccagattataaattaataatggaagtcggtgttgaggcccaaggtctcttttcctcattttatagttttcttttgagcgtcagggattccatccgtcgctccgccgccgcgcatctgatcttccctgaaccccgctcatcatcgcctagccctagccctagtgccgcgagcttctccttctcctctcctatagttctaggctgggaacggtgaggatggccccgcccaggattcgggggaagctgaaacgcatcagccagttcaattctgcaaaaactgggaggaagaagaagatttccaagaagcgacctgcgcagcaaggtgtttaattccttcttctcttgaatgaagattgtttgcttcctttttgacggatttgcagacctatgcaattacccctcttgagtattttttttcttcctggggctgggatgcccaatttcagcacttattttggttttctagatatgagtattcagtacttttatctatcaaaggaacgtgcagtgagtgtgcatcatgtgcattctgccatcagcatgtctttagtttttgcaagttagcatctgcccctctaattgtttaaatctagtttgtttttaattttggctgtttagtttatgcatgcatctttgaagttcccaaacccaaatcataccacttagtttttgttccgttagttgttatttcagtgggaaactgcttgtgaaccatgcagaaagcaattccatatttgatgtagtagataggcaacaccaagtaaccaacaacgctaccagagtatgcaacagagtatgaagcaatcagagtatacaaagactgaaatttccagtgagcagaaacttgatagatgagcagaaacataaaactactcgttgcacatactagcaagacattttaattgtggacaactgcacaaggtaattaatttccttttaacatgtgtccacaagtctaacgcatatattttcttgctgacattaacagagccagaacggaggcttggcatgatccgattcagaatcatggcctgcgcaaagtccccagagcaagacatctgctacatctgcggagacgacgatcacatggagcacttctgcccttacaactacatgttcgggcgatacttcagcgacacctgcagaggagagtgccctccccaggagcacaggatcacctccagggatcatcgagagttcctgcggcgtttcgtgcgcgtgacgaacctgccgccggggttcggggtgtgggatctcgaggacctcttcagcccgttcggagctctgctcatgtggaatgttcccaagttcaggaactacctgtgtggatgcacgactggaatccacatgagcttcggcttcgtcgtcttcaagagacgcgaggatggggagagggccgtcgacgagctcaatggctatcaggccggtgaccggaggctgcgagttgattgggtttacccttcttgtgtgtagctcaaagatcaaactttctatttacccttcttgtctgtagctcaaagatcaaaactttccattacccttcttgttccatttacccttcttgtgtgtagctaaatatcaaactttccatttaccattcttgtgtagctcaaaaatcaaacttcccatttacccttcttgtgtgtagctaaacatcaaactttccacacgcactagcagagactaaagactagagagacatttgcattttctgttctcccatatgtataggggtggcaacagggcagagcggggttgggttggattgccccagcccccgaccccacaaaggaagtcgggtgaaaaacatcacctgttgcagcccccacaggggacccggtgggtgaccggggccccgcatcacccgcatacatgtatcattttgattcactctattgtttatccagactcttttaatagccaatatgtttttttatgatgtagcatatccttgtgcaagaaagcttgttgctttcactatataagatgttatgagtgtgtgagtttgtcttgcgtatctgtttgtctcgtaacgctgtcagatgggatcaacttgtgagtttgttcttttgagactgttgcttattataacttttttttattaaaagacaagttatttccttgatatcccttgtttatatagttttaaaaaataagtgaacgcataggtttgcaatttttttcaaagtgaaaacggagcttatgaaaaggaccagaatgcatacatcaataaagttggaccagaatagtgcatacaagcaagaagatatagaaaacttgtatgcctcacttcgatactgttcctcatacgacaacactgggtcgtttcaactaggaatgtatctggcgtacctggtaccgcacaaatttacaaatgattttatcgtggctatatcgcagttcagcaatggaaaggacaaacaatgtgggacggatagagctcgatacaagatagatgcccgttgtgtttttggcttgattaggatgctgggcatttatattttatctaatgtatgtaactacccaaaatcatactagagtttcacgcaatgggaagacggaattattggtctaaccaaatgcaagggatttctttgccaagattttcattcctatggtgactttcatatggtgcctctgaattgaaacaattcagccaaaactcctaagctgtaccaagtcaaggcaaaactcatactcgtagttatcaagtgagaatgagcctgcactcaactcactgcacccattcgtaattccacactgaaccatttaccaaaacccatcactaattgaactttcaacatagaaaaaaaaatccagatcattctactactactatttcttagacctttttgaaggaaacatcatttttgttttttcgattttgactgaatcggtcggaacatagacgagcgagcagagccatcagtttagacaagggtaagcccaatcgactcgcagcttgcggccaccgaattcccagcagttgagcgcctccacggcctcctccgcgtgccgatgtcgctggaacacgacgcagccgaatcccttgcatgtccccccggagcctcgcgtcgggacgtaccacatccacagcggcccgaaccggccgaacagctcaacgagctgctccggtgggcacaactccgacaggttgttcacgcggacgaggcaccgcaggaacccgagacgcctcgcgttcgcttcgtcgtgcatcgggggctcgctttgctcttcctctctgtgccgcgagcacttgtaacggagcgtggttgtgtagttgccccagagagcgagccgcgctctgcatgggaagtacgcagccggggaaagatagttgtaggggcacatcagctccagatggtttcccttgtcgtctccacagatgttgcagaactcagtatccggatccctccaaaagcgtgtagtggagcctgcatccagagatcatctcagtgtcccatgcatattttcacagggcagtataaaacaactatctattgctctctctaatcacaaacctatcactaagggaaagaacatggacaaacatagtgatctctgaccaatataatacttttgagaattttgattgtcacacaaaaatagcatggggcagaaatagttcacaatattgttcttcatctaaattattgcgttacctgcagctatattatgtgttagtatcacaagttcacaactaatttgttgcatgaggtagcaataactcggtaattagtggcgaagccaggatctgatcacaaggggggccaacctagatatgtgagaaaaaatagagaaaaatatacacaaatttgaaggttcccataaacaatatttatatcatatcaacaattcaaaagataggcatatagctataatgcatatatttatttattttaatttggctttatgagtagacatatcataagcagtgataatggtcgagctaaaagtctaaataaaaaggaaaatacaataaagctagattatggtaaaatgagtgatcaactatctaccttttgcaattattaactactccctccattctaaaatataagacataaccactactaatataaatatcaagaaaaaaatattattaaccctttgtttgaattatcccaataaatacgatgtatgaacccaatagaattagagatcttgagagttaggaactaaaaagaaaaactattttagagatggaagatgataattaactgcatgcatgcttgcgtgccttgtattgtaaagcattcaagaaaaatatttgcgccctatattttgaaatggagggtgcattttagaaattgaaagtaaaaatgttagccatatgtaaacaatacatacgattattacatagtctaaaaggaaaaatatgactgtatgactacgataaagacctttggtgcttttgattaaggattggtgtagcatttttgctaaacatctgtacgtacgtgcccatgccaggataatacggtgtcatctgaaactaacctacctaatctaatggcagattatttggggcgttcggtggggtgggggtcagtggctgttgggggaggccaggcctcctcccgcccctgtcgttaatcctgcactcttgcttccttgaatctaaaaaagtgttttagatatgggtctactaggctatgtagctctacttgccttccgcgcaatggagtcagtcctataatcagtagttcagtatgaagaggtcgacgaacacaccttcctgcctttttacaaaaatggactgaacaacagatgtatacggtcagaatgacaaatctttgtccaattccattcaatgcgtattttcaggctcagtcagcaacttaggccactaaacaaaactttttttatagaaatatgcacgcataaaccattgtgagataattgtgcacatgttgatatactagctgcctattatttaccccaactttatggtatatatagaatcagtattccgaacgatgaccatatggcatcagcacccgaaaaagaagctaatctccagtatgtttctgtcacagtatcactggtgtgaacatcaatcaaacagcggtatctaccacgtctagagtagatggccatatggcatggcaccaagggattggcatactgaatgagagccgtataataacattgaaatgaaataacgagagagatttaagtgagagcaagtagaagatagtactttcttcttccccgcttaatatgtactcacaaactctatctcagcccatctatgcgcccaagcccaagcatgctctagggtccatgtgttagtatggtaagatcgatggcaagcggtcacatggtatatgcaccatgatcattgccacgaccgtgcaagattatgatacctcttcatcgacacctggatgcctcagcagataatgcaatgaatattgaatctgtttcatcacacttctgtggcagcagatagctaccttgattgctgttttcttccactgaggtcattgtttcaggcagttttaggaagggttttaaaaggaaacaaaaccatgactagcgaaaacaagttgtgttagcatgagcaagctgagaacagattcaaagacaaaagaacttgtgcatcacttgtctgaactgcattgttttcaattcatacgttttcaccctaacagcccaacacagagactacataaataagtatttcaaataattaaacacaacaaaatcaattgctgtgtggtcagagttgaacacaacaacattcgtttctacttcctaggctagttgcagtgcgaccagttttatggttacaatgttttatgtaacttactctatttttagacatgaaaatgaaaagcgagcacgcaattaagttacttacattcctcctcttctgagaacaattctacctcctcctgttgttgctcccatttactctttcttcgacgcagaaagagcatctcttggagagtaaagagcctcataaacttgtggaacttgaagagttgaggtacaaccaaaggctgatttacacctcctgaaatcaacacagcacaactgatgtgtactggtaactggaaattttagtctttgcatactctatatatgcagaaagccattctatcaaatgtaga

SEQ ID NO: 21355 - DNA, 7684 bp, Oryza sativa
gcaaagaagagtgctgaatactcatatgcagaaaaccaaaattaagtgctgaattgaagctgggcatccagggaaaagaaaaaaaaattgctgcagaggggtaagtggggaagtccgcagatccgcgagaacagtagaaaggaaagcaccttgctgcgcagattgcttcttcgaaatcttcttcctccacgttttattacagctgttcttgccgatgccttcgtctccccttatccgggcaggggccatcctcgctgttccagccctccaccccctcgcggcgtagcaaagcaggagagagagaagtgggcgacgaagtcagcggccctagggctaggcgatgatcagcggggtacagggaagatcggaagcaagcaagggcgggatgcggcggcagagcgacggatgggatccctgatgctcaagagaaaaagaaaaaaaaaatccacggaggaggtgaggccgtgagggtcgagagggagagagagagaatagcttgggccgccggactgtatgacttccattatgatcggacccgctgaaattttgatcattttataccttttacagcccgaaaaacttattgctctccgagttgcatcgttttgataaagacacggaggtgagtagagatcgggcgtctgatcgggggaaaaaaaaaatctggcgtccgtgccagccatctgatcgggaagaaaaaaatcagaggccccacagctactatatgcatgcacataaatactataatctgtagtcactgcatgcacagaacatgcagccatgcatgtgtcaagttttttaaataaaatttaaactattttttctctcaaattacttatccaattcacgatccgattgcactattgaatttgttgcaattaaatctttaaaacaagaccacacattgatataatccgatgaaaaaaatttagcttattattgaattatttttaaatattgcacgttgttccaccaagtatataggaattgtttcactaagtagatagtaattatttcactaagcagatcgaaaatgtttcaatcgtttaaaaagctgaaacacaaccaaattacctcatgaaatattttgctacaacgtttgaaacaatggtttctcaaaaaattgagcgttgtttcaccttatataaaaacaatatttcagcaaatagcgaaagaatgtttagtcactgcaacatttgattcatgcacagtgaaacatcacgggtacactaggtgaaacattttggtggaacaaaaaatgaaacagattcccttaatagagggttttcgtaatatgtgggtgatttgttgcaaaagaatatttcaattcaacgcaacattagatatatacatagtgaaacattgtgagtatattatgtaaaacattttttgtggaaaaaaaatgaaacggattctcttaatagagggtttccgtagtatgtgggtaatttgttgtaacggagtatacgtagggacacgtgactagggcggtatgggataggtggcggggcggtgcgcgcgcgtacggtgggaggcgccagggcgcgggcgcccggcgcccaattttttgcagccgcgccgggcgcctaacgtggaggattttcgtaaagatacaaccttaaaaaaaagataaatttgaccaccatattttattgtaatctatatagatatatcaacagatatataatttttattaaaatacgtattaatattaatcggcaaatattttcaacgttatttatagtcaaagcttgtaatgtttaaccatgtccaaaacgataggtactattagtccggaaagagtataagaataagggtaattttaccattggtacctctagatagcaaaaattttagttcagaatttaagtagttcaaggtactttctcaagaactgaaaattcctgtaagaataaacactaaacactgctaataattttggggggtttggggattcagagtggtagcctagcttggggaggggggggggagggggttatgtacaatattaccgtcacactgtgatgcgaaggtggatgaatgcaaaattattgcttatgtgaagcgtcacgtctacggtcaggtctagtaaaacaagctttggacatactatggttcactaaatcaacatcatgtatctgaacatataattttcaacttgagagacctaagcaatagctctgctcaagtttaaggattggtcatatatttgtcgacgtttgatgtcgcgattccgatatttgcatagtatggggatcgttggtactaggatatatgcgagattgaggtaaaatagatggggacgaagatttttatacaggttcaggcccctgaattgtcaggtaataaccctactcctattggccgaagccggtagttgctcttattcaccataatcacaccagtacaatatttggggtagtctatctatctgttgtcgacttggaggccataaaaccatcccgtagtcgacaatagaatagtcttcctcctcgaatccgtgtccggcgagatctctcctgacagtatccgtagacaccgtaggggactagccatgcttatctctcaagtcgatatctgacgtcttgtcttggcgtatgttggcttgtatgttgatcttgtgtcttgatctattgttccgtatcccctctcctactagggggccttgtatttatacccacaggtgtccccttgtccaagtagaactaaggaaaccaatatggatacaatccgaatagtccttgtcgtttccatgtagaactctaaactcttcctatatccgaaggttgtttccatataagacatggtatgtggtgggtcctgccgagatttagtcaactactattaggtatgtggtatctataacactgacagtagcccccgacttcaatgcaaatgaacgagttcatattctcaatccgaagacctcggaataactgttatcgagctcacgtgaccgttctcggtgagttcagagataacgttagacttcccttatcagcctcatgcgggcaccttatagggtttgtctgagtcaatctccgacgtcaaccaagaaagtacagagcatacgactaagtctctcgtcttgctgtaatcgagaatttggattgaagtcaagaaattttatctcggcgagtacaccatctcttcattccgtattccttgttgagatccaccaactgttctcgagtgatcgagaaggcgcagagtctgcgacggagccttgtcaatatttgtcgtactcgccttagtcgatcttggtatagaaccatagagacatggagtcttcgacaatgtcgaatagaattttcctgaaatcaatacttagaaaagaatattagatagaaatagcccccgagcgaacactcaaagggtgacatgttataatatgtatggaaaactgaaaataaactaaatttacagaccaatgttttgtgtacgggcgtcttctcttttaccgacttcgatcagtcaacttgttgagtcatacactctcccttgcccctagccttgtcgtcggagaatcgttctcggaggataaggctcttggacccttgacctgccttggttgaaaaagcgcttaccctagcccccagccgtgaagttggaaaacccaatttccgattacacggcttggttaatacgcacggcgagaactcttacatgaccaggtcttacatggtcgtttgtctctacatgatccgacaaggccttatccgctctgggcatccccagccaaagttcccttaggttcctcagaggccttgtcaggacggcgtaaagagacatgaggataggtttcaaatctaggtgtcgtcgtggtaagggatctctgggtaaaacacttggcgatattgtgtacctgatatcaattttgctggagtagaggtaatgggaggatcgctacactgctgatcgaaaatcagttgtagccccaacttgaccacttgaagtaaaggtagtgggagaatcgctacaccattggtcgaggaccatgtagtagtcataactcaaccactggaagtggatgtagtgggaagaattgctacaccactggtggagaaccaggtgtagccttaactcgaccacgagaagtaaagctagcaggagtgtcgctacaccgctggtcgaaaaccaggtgtagctttaactcaaccacgagaagtaaagctagtgggagtatcgctacaccgctggtcgaaaaccaggtgtaaccttaactcaaccatgaaaagtaaagctagtggaagtatcggtacaccgctggtcgaaaatcaggtgtagccttaactcgaccacgcgaagtagaggtgcgagagatcgctacagcttactggtccgagaaccaggagtagcctcatctctcggccgattgatgtcgaggtacgagagatcgctacggcctactggtccgagaaccaggagtagccttatctctcgcctgattgaagtcgtggtgcgaagaccactacactgttggttgaagaccagccgtagtcctacctcgaccatctgaagtcgtggtgcgaggaccgctacgctattgccgtagtcgtacctcgaccatctgaagttaaggcgcgagagattgctacgatttactggttcgagaaccagcgagtagaattatctctcgaacggcaatggaagttacggtgcgagaaattgctacgatttactggttcgagaaccagcgagtagaattatctctcgaacaccaatggaagttgcggtgtgagagattgctacgatttactggttcgagaaccagcgagtagaattatccctcgaacaccaatggaagttgcggtgcgagagattgctacgatttactggttcgagaaccagcgagtagaattatctctcgaacaccaatggaagttgcggtgcgagagattgctacgatttactggttcgagaaccagcgagtagaagtatccctcgaacaccaatggaagttgcggtgcgagagattgctacgatttactggttcgagaaccagcgagtagaactatccctcgaacaccaatggaagttgcggtgcgagagattgctacgatttactggttcgagaaccagcgagtagaattatccctcaaacaccaatggaagttactaaagttggtttattacatgtgcatcttatgtggccaggatgactcacatacccaacttgtagcatatccggatgtccgttcgcaatcatgtcaggtgatcaagccgacatcgttcgcgagcaattatccgttaacaacccttttctcaaatagcccagccatagccggtgctatgagataggtcgtcggtcttcgttggtaggttgggtgcgacaactctgcatttgtcgagaatgttctcgataatggggtgtactcgaccacaacctactcgagtgctcaattgtccctgaaaaatatttttctagaaggcaaggcatatagcagagcatatcgagtatgtaatcaaaaaactgcatatatcttctagtattatcaggatataacgagcagattaaatatgagggattatgtaaaccgtaaacaagcatgatttatacagaataaaatagatcaagcccccagcgttagactgtagttggcctaacataggaagcactcgcacaatagatattgtattaaaaacatgctctaggtaaacataataaattattgatctgacaatattgtatgatctgaaaagtataggtacgataaattgcctataaaatatcacgtatctctacgaaattagtagattaattaaaaatcgatcttgctaattaccttggtctacctgtctcgtataagaattttggaggcaagcagatagttgcttttggtgctatgggcatcccgatgatcatatagtgcatgtccagagcaaggctatccagttgcatgtagctatgccggctggtcgcatgtccgagtaggtgggaaaggtccaactagtcagaacttgcaggcgcgcattgtccgagtaggactcgtagtatatgcaaagaaaggtacatattactctattactccctccattccaaattgatctattatatatttcataggtacaccaagaccaaaaaaagctaataactctctcatactatatttactctagcaacaaactcaatgcatgtaccatccccactattttctagccaatagcaaatcaaggtattgcatgtgggttataaatacatatgtgcatggatgcatgcatcaatgtccatttactccaatgcacaaataacgaatagacctaataaatgaacacaaatatgtagatcatttaggaataacctcaaaaatactatatgtagatcaatttggaatggagggagtattaccgatctacagtaaacaagaataatctattcacagaaatttgggacgacgaacctgatgtcattgtagatcagtagcgcgttttgtcgtggtcggccgatttgatccggttagaattctggtggtggaagtccgctcagaggttgtaggacaatccatctcttgaacccatctcgtcggaaccttgaagcaccaaaaatcccctatctgacgcaccactgtcgacgtttgatgtcgcgattccagtatttgcatagtatggggatcgttggtactaggatatatgcgagattgaggtaaaagagatggggacgaggatttttatacaggttcgggcccctgaattgtcatgtaataaccctactcctgttggccgaagccggtagttgctcttattcaccataatcacaccagtacaatatttggggtagcctatctatctgttgtcaacttggtggccataaaatcatcccgtagtcgacaacagagtagtctttctcctcgaatccgtgtccggcgatatcagagacaacgctatgtctctcctgacagtatccttagacaccgtaggggactagccatacttatctctgatgtcgatacccggcgtcttgtcttggcgtatgttggcttgtatgttgatcttgtgtcttatctattgttccgtgtcccctctcctactagggggccttgaatttatacctacaagtgtctccttgtccaagtagaactagggaaaccaatatggatacaatccgaatagtccttgtcgttttcatgtagaactctattcatcctttcttatgcggaactcctcctatatccgaaggttgtttccgtataagacatggtatgtggtgggtcctgccgagatttagtcaactactattaggtatgtggtatccataaccctgacagtattttactttaattatattataagatgaaattacagtattatatgtgttgtgatatgtataggactatgataattttggttaggttcgctatgtcccaatggaaaaaaggaacatctccgtatgagtagacatgattggaaaattcgtatcatcttttactataatttgtgatagttttggcacatacggtgagtgcggtgacactaataaaaaaccctcatagggatcggcttataagtgctggtttatttaaaaccggcacctatagacaatttcccacctccctatgatggaaaaatacaaaaccgatacctttaaacactataggtgtcggttctagcgaaaaaaccggtacatatactattggtgtcggttttttaaaagaatcggcacctataatatattataggtgccgat

SEQ ID NO: 21356 - DNA, 16475 bp, Oryza sativa
gatccgacgccaggggagctagtggggaggtggcgggctcctgcctgccagaggcggcggcggcgcaactaggcggcggcagcggccgcaccctccccatgcggcgacgacggcgagcgtggaggacggcggtggcgcgggcgatgtggcggccggcgacatgtgctcccttttgaaacccctgtggcatgtgttcttgagtttctctttttgatttcttgttgagttctagtcccaaacttgagttcttaatgatttgtactattcgctagttcttggtgagctagttcttgatgaatatactagtttgttgttgagtttatctcggatccaagaggcggtgacgaaggggagtagggatgggctcgagggaggaacggctgtggaatgtggatggtgagttcggctcaattcgagccagctcgctctttttttttttggctcgagcaaagttaaaggtgccggttctattttggcatgggtgtcggcttttcttattggtgccgaccaataggtagccgatttccaaccggcaccaatggcggtctctgtactagtgtgaacatgctcaaatctgaatccttttgttgttatgcatgagaaaagagcagatcacatcaagtgctacatagcagtattatttttaatcatgttgcttcgagtttctttagttatgattctaagaaacatattgattgcgaaatgagtgtagctcaagtgattagatttattatggtagaacccacccattcaagtttaagttctacacttgatgtgggtgttcacatttacggatatatatattctttcagtgatcgtcggtagtgagaagcaagatgagcgtttgtattgtgtttgtaaaaagaaaaagaaacatgttgattttaaagaatgtgagcaatcggatcaatcgatgttgtcaccatacaccaaggtagttgtgccatatgagttctttctaaagaggagtaagatgaacgtttgtattgtgtttgtaaaaaagaaaagaaaaatgttgattttaaaaatacgggagtgctgggaccaacgttgttgcgctatatgagtgttctttctaaagaggagaagcaagaggaacaaacaaatccaatatccatatcctttaatttgccgcgcatcctaatgttaggtacttgtttcattggaagataaatttatttgctaacgaaataatgatatagttacatgatggaagtgtattgtgttcttctacacagttcaaatttatgaccaaaatcatgcactatttgaggtgctacacattttttttagataaaggattatcaaacacggcctctacacctttgtggggtgtacacagccaaaaatccgaacacgagtacataagactctccataataaaagggtacaaaatgcatcaactgacctctcccattacataagagatgacagcacaaaggttttaagaacaacaaatgaagaaaagactaggcttccaatcttcttctcaggttccagccatacacggagaagaattccaccacacgctttctccagcactttgcaatagttcttaactatttcttcatcggttcccttaagaagcaaagaccaagtccttgcccaatgtgttcccatgaaaatgacctgcaagaaagatgtaggattggagccattaaagaccacaacattcctatataaccaaattgcccaaagaaatgcagctatgcccacaaacaatattctcttgagcctaaattcaacacaattcagccaattcccaaacatttgagacatgctacacggttgcctaatcccaaatgtaaaaaggagcgcactccaaatatacctagccattgagcaatcaaagaaaagatgttgtattgtttccttagagttacaaaaacagcaacttaggctacccttccaccttctctttgctagattatccttagtgagaattaccccttccttgaggtaccacaagaaaattttgattttaagtggaattttgagcttccaaatgaaattcttcctaggtaccagcccttcatacatgagcaacttgtacatagattttactgtgaaaatgtcttctttattgtttttccaaaagaagcgatctttctgatctgtcaatacagtgtaaacaactttcgacactagctcataccaggcttccaagtttcttcccactattgatcttctgaaagacacatttaatggtattccactcattaccttggccaccacctcatttttatttctaactagattgtagaggttaggatactccttctcaaaggattgaactcctatccaacaatcctcccaaaatcttatttgtgagccatcttgtaataagaaggaaccaaacctttgaaaagactctttggctaacatgagactagcccaaaaatgtgagtcccctagtcttttttggacttgcaaaatggttttctttgtcaaatattttttcctaagcaaactttgccaaattccgtcttcattgatcaacctgaaaatccatttactaagcatacacttgttctgcatttctaggttttggatccccaaccccccacattccttaggtctgcacaacacattccatttagctaacctatacttctttttgtgctcatcacattgccaaaaaaatctggatctgtaaaaatccagcttctttaaaattcctttagggatttcaaagaaagaaagcatgaatgttgacagactactcaacactgaattaatgagcaccagccttcctcctgacgacaaaaacttgcctttccaacaactgggtttcttctggaatttatcttctagatccttctaatctttgtttgacaatcttttgaaatgcataggaaggcctaggtatctgaatggaaaagtacccatcttacaaccaaacaaagtggtgtaatccttttccacctccttagctttcccaaaacaaaacatctcacttttatgaaaattaattttcaagcccaataacttttcaaaggcagctagtaccaattttaggttcttggctttaaccaaatcatggtccataaacaagatggtatcatctgcatattgcaagattgagagaccattgtctaccaagtgaggaattactccatttagagtctcaaggtctcgagccctattgatgagaatggcaagcatatccgctaccaaattaaataaaattggtgagaggggatccccctgtctcaaaccctttttcgtctggaaaatgtggcctatctcatcgttaaccttcacagctacactaccccccgacacaacttgatcaatccacttgcaccaaatgtccgagaaacctttcattctcaacgcttgttgaagaaaattccaatttaccttatcataagctttctcgaaatcgagtttcagaataactccatttgactttttcttatgcatctcatgcaatgtctcatgcagaattatggccccttccataatatttctaccttttaaaaaagcagtttgcgaaggtcttatgactttctgtgctactagagcaattctgtttgccatgacctttgtgaatacttgaagcttacattaagtaagcaaatgggcctgtattgttggatctattttgcctctttattcttcggaagcaaggtaatgataccaaaattcagtctatgtaggggtaactcgccactatgaaaatctctaaagacggacattaagtcttctttaattacttcccagaacacttgatagaactccgctgggaaaccatcaggccccggagctttgttatgttccatttgaaaaacaacatgtttcacttcttcttctgtaaattcttttgttaagaaagtattttcctccattgacacttgagggatatcatccttttgggattcacacatggagaaacaatttctatccggagctccaaaaagacccctataataattggtgacatatttcttgagttgtgcatctcccttaatcaccccttcttcttgttctaattgaaaaatctttgtctttctgtgttttccattcgcgatcatatggtagtacttggtgttcctatctccttctactattctttttgtttttgctctttgataccatttaacttcttcttctcttaacaactgggctaaggcatttttataggaattttttagaatcagttcttgactagtcaagatcctggtctcagctaatttgtccaactcatctgcctttgctataagtcgagctttctcttttttatacacaccacttaaattcttcgcccatactctcaggaattgacgaagcctgcgtatcttattttgccatctttctatatttgttgccccttgaatatccttttgaatatcctttgaccaaatttctaccaaaagattttgaaagtcatcccttaataaccatcccaattcaaatttaaacaaaggttgagaatttctatgtgtcccttttcctgtgtctagcaccaagggtgtgtgatccgaaaggtctctacaaagagcatgaactgtcactaacggattttttgtttcccactcggtactcaccaaaactctatccaacttttcataagttgggttcggcatagagttggcccaagtaaatttgcgtcctgagagcaagatctccctcaaattaagactgtctatgacagcattaaataagaagggccatctatcattgtatcgctcgttgttcttttccattggatttctaataatattaaaatctccaccaattaccattggtaaagcttccttactacaagaattgaccagctctaaaaggaaatcttgcttaaattcatcttgtgcagccccataaactgccaccaggttccataggaacgcatcttctttatttcttaagtgaaacttaatatagaactctccttcatcgatactagcgacatcaaagagttctaaatttatcccaagtaagatacctccacttctcccttttggtctagtccaatgccaaagaaaatatttccctccacagatgttatttaaccatgaatcagcaaacttatctttacctgtttctaggagagcaataaagtctagcttttgctctttagataactcagaaagaaacctatgacatgctaaagaacgaagaatgatgtgaacgttgcaattgtagatggaactcgcccccacatcatatatattagataacaatcatgaagctcatataattatctttctatatgtactgtatatcatgcaactattagaactacgtgttattatacatatcaaatattagacttgtggtcgtaaaaaaaattactatctcaacatccggggcccgtccctgatgtgttgtctcatatagttaaatcaactaattttgctccgagttgagaatggaatacccgataagcttggcatcaccaccatcgtgttccatgccgtccatctgaacagggctttcctggtacagcgtgagacgcaaacggttatccaggtaaaacgccgcgtcgcagctgcggctctcgtcgtctgacatggaggccaccctgtggagcacggccgcttccgggtcgtaaacatgcgcctcatgagccgtcgtcgccagcaggacggccttcctacgctgccccccagttgaggcgggatcaccaccgacgtaagctagcggcatgacaagccatggcgtgacaagtcgctctgcggccctgtaccctcggggtaggtctatccggtagtccagcgaccactccccggtctcgtaggtcccgagcttccatatctcgaacatggtggtctcgttcaagtccatgttgcggcggtggcggaggtcccgcaccatgcacaggcagccgtcgagctcggccaggaccgtgccggccggcgcaaagatttccttgttctttggaagcaacttgctcggccgaacatgctcaaggtacacatttgtcgcaacgcagacgctgctgctacacacgtctaagtcagccgatgcgaatggtggcaaggggaccgtcacgaaggattcgtcaccgatcgagaatgcgaggatgccctgaggtgtgtcacacaccaggaactttggggtgagcgtccagtggaggcgcccgttcgcgaaaaccgggtcgacatcggcgatgcagcctccttctttagcgtggtcctcctggaggattgtgcaggcctcgcccaagggctcccgccagcccaaagggtcgtcgccaacggtgagcacacggcattgtgtccccactactttcggggaacttggatctacgagctgcaccaccttgtacttcccggtcgccgagtcgaagccgatccccgcgctgctcatgtaccactctgagtgacacgggggaaggtgtagcacgccgccggtggaagggttgcacacggagtaggtcaaggcgcacgggcggcagaagaggacgagtccgcggcacggcctcgcgccaatgatcctagggcagtctctgcagcacatgggggcgtggaagctcctggcatgtcgttttgacaggggcgtgagcaccaacttagcgggggcgctgtgccgagccgccgcattttgcaggtagcgatcgacgaagccacccgaggagatgagctcgttccaagaccggcaggtgcaccggagcctggcaagcgacctggacgggagccacatgaggatctcctcgacgaggtcgatgggcagtgagaacaatccggaagatgtcgtctcgaccgtcttcatcttcttggagtgcctcgtgttgtcgcccgaagtcggtggtacattacagttactagccgtcaacccgtgccttgcacgggttattggtattggtagtataaagatcaaaattttaaccatacgttcactacgttggccatattcgaattgtagcatgttagattgaaataatagttaactactcccttcgtcccagaatataagcatttttagagttagacaacggttattaagaaagttggtacaattaaataggggagtattgtggctgaaggagaagtggagataactggaaaaattaaatggtggaggattatgattcgttaagaagagaatgttggtggtaaattgttatactttgggacaaattctaaaggctagaagttgttatattttggtacagaatgaatactacttgttaattattaattttgaatcaaacaaatgctaaatttgtgatacatccaacttttttatttgatattgtggaattctggaattaattaagtatttagttgtgtctgtggtcgagtttaaatttaagtacaccctgtaatttaataatttttacattaaaaaaaatagttatactcagtatggaccctagaagatataagatatatgtaattagcttttttgttttatcattcccaaaactcataataataattagtgatctatagtctcttgtctatttgtaccggttaagtacaaattaaagagtccacgatattgccaattgcatgttttattttttcacaaaccctaaataaaacctaatgttgtgattttgcgattttgccacgatacatgctatttaacgtgaatttggtcacgtctatcagatcaagcctagattgtttactcttgctgcaagtaatactcatatgaacctacgtagtacatgataaatatttgtttacatgcatgattattcgcttagtaggtttctagctagttcaaatggataaaccgtgtgtatgattaattctgaatttcgttctctttacgtcgcatgatttattatcgagaagaatatttatcccaaagagtcaggattactaaaattatgggggtcttagtttcagtcacgtcatgtatcctatatgatactctagtaagtatgcttctctctctctctcatttcctcttccaagtagataataattaaattaattttactcctaatttttataaactgtgtactaaaaaacaaaaggtaaatattaaaacttataatgtaattatagtttatgttttgaaatttagcgtgtaattaactacaatgcaagtgtatgcaatatatagaagttacccttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagtaagctgcaaactacatgtacatatgcattgcatacgggatataccgggcatatggaaaattaaatatagttgattgcattcagagaattatagatcaatatatttttatctgcttctactgtcattaaacaacttgtcaaaatcagaattgacaacttagaacttgcaagtttaatggaataaaaaaacacattcaatatgtaaaagatgatcagcaaatagttgatcatcccaatcaaaaccataaattgagtgcgtcctaattaaataaactgctaaatatgtattgcaaattgaacatgcaaaccatgcaaattcaaaggaatacgtatatatgtatattgtagatgcagcaatagatctgtagcagatgcagtgacggatgtgcaagtaattttttattttgtagcaaacttttttctcccaaaattcatttggttaaatttcgtttcaggttaaaatttattcaatctttatggagtaaaaacagtacgtcaaaccagagacttaacagggatgaatgatacctctggagcgatcactgattcactggaaacttttaacttctcctcatgattgaggcaaattgtcgctgatcgggaccacagtctgggatcaaggtcgactgcagcctatgcatatctcgtcgccctcgctcacgttcttctcgatcgcgttcgccgtttctttatcgcttcttaatttccaatctgatttcttacgatggaacttggagataaattagatgggttctgtccttccatcgataactggatagataggatttgcaaggagcccactgagtttaagattgattggctcacgatgttaaagtattgcaggatctacggtgtagattaaacgacttatctaattgacgctcagatctttctggttaacgtgagagctccaaaaaagtgcccgattagtataggtatagattattgcgtttcgccattaggctaggattaatagtttctttggaaagaaaatcgtatgggcactcttcatatatatgatagatatgacgatcggctgatctctcgacgtaaacaagtccaatcctacatagacgggagatattaaatccgatccaacgaagagcgcatgcagttatctatagacattgccgaagcatattcagatactgatcccatcaaatggatggccctaatccggttcggacaggaaaaatcagggatctcttaaaacctaaagggtcaaacaatttccaaaccaaatctctacctctactattataaaaattgaagatgtttttaccggtattttgatacgtcatccgtatatgagtcggattttaaattcgcttgcttttggaaatacatatccgtatttaagtcggttttaagatcgttcacttttggtaatacataaggaatcatataagaaatctgtttaaaagaaactcacatgctaacttgagacgatcggactcctaactgcagctcatgatttcatcttaactaaatcatataacaataataagattaaaataaattttacccgttataacacacggacattttttctagtttaatttaaaaataaagtagtgcaaatctagtggtatctacctatatctctatctttatctctactgttaacaaaattaaaaatattatttctgccgaaattttgatacgcgtctagttaagttcgatgcctttgagctctacgcgtgctttgtttcaaggcatagcccagacgaggctcaccaccagtgtctgagtgtcttcccccaaaccgatcacactgctagatatccatctcgatcggtttccatctagccaaaatttaagggagacgactgcgcgtcgggtgccccatggggaggtggaaaactcgtgcgctgacatcagcatgacgtatgcgtgcaaaaccactttaaactatttttttttaattatttatctaaatcatgatccgattgcaccattaaattcgctccaattaaatctttaaaacgagaccacacatggatatattccgacgaattttttttagcttattattgaattatttttaaatgttgcacgatgttacactaagtatattggaattgtttcactaaatagatcgaaaatgttatttcgtaaatagacccctgaaaaaaattggatttttcacaatttagtctttttgaaaaaattatttcgtaaatagacccctagaaaatccggggagtaaatagaaccctgagttccactcgacactcaaggctgttgtttggtctgatctttcggtgagttcagataactatgatttgggataaacgttgacgactcaactacaactgtacaagacgttatgttgcgccttagcgatcgatgcacctctccgtgggttgttgatcttgccattgcagatcaactctattcctgcaagcaaatcgaagaaacaagtaagaacaagataaaaacaatatctaaattgcaaataggaatgaatacacaagataagttggggatccgaagaacaagcagacggacggtctagccgacacgcgtgctgcaagcaagtagcaatggctaaacttaatataacaaaacccaagaaaccatgaagggatacatagctatttaaggaggtcagaggacgatctaggggtgcctagggtcgtgctcaaactggttggggtgcaccccacatgggccctatttgggccggagtcccagacgaagttacaagcccattggcccattacaggtgacgcatcaccttgtttttgcaattgctgtcgactgtgatagaattttggaacaaggctagatccgttggaaagaggacttcgtgagctttctatcaagtactcatggacccaaaatggagctcgtatgctcatttggcggccatttgaatttagcacagtagcaggtggccgaattggattccagaatttggacggcttgatcttgaagtgttcttcttgatccatgatgtgagcaatggttggttgtatctaaggtagccatggtcacatcacagtcgttagcacctacacctcccttcacctgaatataggcacattttgatctggattgggggtatggtggtaggttttggtactaattaaataggtttcaaattcctttattttatttttttctaaaaaacaacaaagatgttatacagtgttaagaatcaacggagcggctatatattgcatgtgtactctcctggaatgcatatgtgcattatcaccaaggcaatttcagaactttcattgtcttcttgttgaataattatcgcagctaaaatttgaattttaaaattagttaaattttaagttattctgaagttttttcatcatagttcttctacccatagttttgaatctctagtaacacgtacaaaaattgggatttgctatatctataaattattttttgtttgtttcgttccaggcttattagcctataactgaatctttcgattccgaaagtatgctgaaatatggtgcaaatggccatgcattttatgatattacttattttaggagatcggtagaatatattccctccgtttttaacggatggcgccattgattcgtcttgtccaaatattttatgcaaatgtataagatataaatcatgcttaaaaatactttgagtgataaaacaacttacaaaaaatatattaatttttttgaataatacaaatagtcaaacgtgtgacaaaaaatcaacggcgttatctacagaaaaacagaggcgatcgcagcggtgatggtccagaccggcggatcccttgacggagacgaggaggggaagcagagttctccagtgaggatccgcactaccgccgcccgctctcaccccacgaatttgtcgaccggcacatcctccaccagtccacccgcgcctatcgaccgacgaaggatccagccctagtagtgccttcggatgcggccgacgatgagtgccctctagccggtgggcggcacatagatcaagctccattgacttcgtcgtcttcccctactgcaaacaatgaccggttgagatggtggtgggactgccacacgcgcgcgctgggctgggcgtggcttgcgttgctgctgctctctctaactatatgcaatggacgagaattaaaggaattgattcggttgttaaaggatgaacgtttcaatactgatttgatgaatcgtattgatttgggcgttaatcctcaaatggaaagaatccaactctgacttgatttttccagaacattactctctcacgcacaatataaatggcaccaccaggggtagacagagacacaccactctgctctgttctcctctcactgttcttcttccttggtagtctctgttcttctattatattttagcactagcctttgcttcctcggttctgagcacctggttgttaaaggatgaacattctaataccgatttgatgaatcatattgattcgggtgttaatcctctaacgggaaaaattcaactctgacttgatttcttcggaacgttactctctcgcgcactatataaacttcaccactagggatagacagagatacaccactctgctatgttgtcctctcgcagttcttttttcttggtagtctatgttcttctgtttctgtgccagcctctgcttccccggttctgagcgtgcatgggtgctcgggacaagcaggcctccagaactccatccacatgtgtacctgcataagtcggcaggcgatcaagtttttggggagcgctcactagtgcgattgctctacaacgtcttcttcctcggcatcggttctacactgcgtcatctacttccactacatcgtgatgtcttccaccagcaccggcgatactggaacaggagggaatgacggcactactggaaaaggagggaactatggcactggaggaggcggaaccgagaatgtcaacatcaacggaggcaataccaatgcctcatcatctactagagcgttctctgggtattttactactctaatcttggtgttaaacatgttgctagatgcttttgttcatgttagcatattcatgtttatcaccatgctaggatcactgccatttgcaaatgtcatgtttattacattaattttctggattaaaatataccaaattatgaccatattttcaacaaattatagaccaaaaggactctaaggctgtgttcgtttaggatggcttggaaccaaactcctccgcacgaaaaacagagcaatccattagcacgtgattaattaagtattagcttatttttttcaaaaatggaacaatatgattttttaaacaactttcgtatagaaactttttgcaaaaaacgcaccaaaatagcagtttgaaaagcgtgcgcacgaaaaacgagaaagaggagttgggaacagggggagtgtaagaagatacagaggaacatacattaatttgactcgaaattgaatcattttctactcactgtgaaactttctgcataaaataattgaagttttctacttctgacgaattctgcacaaaatagtatgcatgttatcctccgcacctgcacttggagaagctatggggacctgttgaagaccaaatttggtagatcatgcatcaaattcgaagctgagatcgaagtggatttggtggaggaaacagagtaagcattggctacggaaggcatcggctagcgattacatcggctgatattggattggatagaaaatagccgatgtaatcgatttcgctaaggtggttctaaaatcatcttcgggattgatcaacgtgctgcataagtattgccatgattaggataagctcaaggataggcaattgtatctattaattaggatattttgaataagctcaaggataggcaattgtatctattaattaggatattttgaatagtttccttagagatatttatcggcaagagttcgcctaaaagacttgttcgtatcttaacggttgtaacagatttagagtcgtgtccggcaaggatacattatgtattttgggtataaatatgacccaagaccatgtataacactttcggcgcatcgccaccttttcctactttcattgtttggacgagttcttgctttcgagttgggctgcatcgggttaattcgatctccgacaagaggtaaaacttgtcatgacggcttgtgttctcaggattagtgcttacatcttcatgacactctaatcttgtttatgtgaatcgtcgagttatcgtatgtgctatataatctttatcaatatttctatctaaccttagatcggtcaacatctatcattggaggatagctgatagggctaaatatcaacgttgatctagattatatagtatatttaccatctcatagaggttttcatcaatttgcttagatcttatgtttctctttatgcttaatgctgcatcagttgagttcgatctattaagtaatatctagaactataatatctagcttgttttgtgattatcgatagagatagcatcggaatttagttatctgggggtgcctagttcgtgcagacgtgcaaggaggagaagtagcgcacactttttccgtctcgactccccagtgctcaggcacacccacgaattaagtaattagcattaattgccatcattagcactattttaaagaaaaaccatatatacataatttagttacaacttttaaaatagtttagttacaacttttaaaatagttgaaagttctaaatttgtagtggaaggatttcgaaatttgagtaaaaagtttccaattcaaaattcaagttgaaaattttgaattttgatatgaaattttccaatttgagatgaaaattttcaattttgagttgaaagttttgaaatttgatatgaaagttttcagttttgatatgaaaattttgaactgtgagttgaatgtttttcaaatttgagtagaaagttttcaaaatcgagtagaaagttttcaaaatcgagtagaaagttttcaaatacgagttgaaagtttttaaatctcgagttgaaagttttcaaatccgagttgaaagttttcaaatctcaagttgagagttttcaaatccgagttgaaaattttcaagtccgagatgataagttgaaagttttcaaattttgacttcaaaaaaattcaaatttcgagttgaaagttttcaaatctaggttgaaatttttcagaatttgacttcacgtataaatttattttcaatctactacttaaaaaaatcttgaaaaaaacaaatcttatcttaattatcatcattatcttgatggattagttactctacgttcgtgtgcacgtgattaaaaaaattcacgctgagaaaaaaattgtgaaaaaaaaaatcatgcgcgtgtgattgagaaatccatggaaaaaaagtcaaaacacgtcccgctagttgcatgggccttacgtagtcacgtgggcttgtcggaagagtgcgcaccggcaacacgtacgcgccaattagcaaaagtgtcgttatctcgttctctatacattactttatatgctaaatctgccctctatattaagatcttagtgcattgttctctatacattactttatatcctaaatctgccctctatattaagcttattgtttggtatatcttacttgttttaatatcttaatatagagtagtatcggagtactagccgatacatattagatttacttcatcggctatgctatgaatatatataatctttgtcttaacgcatctttgaacataagtgatttatactgtctcggcttactgtccgatctatccgaatcacttggtttaaggatatttttaaaaatagattatatatcattgatgtctacagctgatcgagtagaccttactttgtcacgcttcacaccacattgccgatctaatgtaaataccatcagcttaatgattaacgatatgtcatcggcccttagccgatcggctatcgtttatggatttaactttgttttcttgttttccttcttgttgattgcgatcaaatcaactggtacacctttaagcccgaaagtaagatttaagacttacactagagctaagcagatctcccaggccagtgtgtgtttttcacatcaacaggaccatgacttgcacttggctacctccctccgcgacctcgccactgcacttggtgatgaggaatgttaggtcccgatcttccgataggtattgataaatagtcgattcgggcggagtctcgacacaactcgatccggcttctgaacgaacacgctactgagctccgcaatcgcagcaccacatctcgtctggttatcaactg

SEQ ID NO: 21357 - DNA, 602 bp, Oryza sativa
tccccactgccagccagccgccgccgccacctctgccagccagccactggccaagggaggggtgctcgtcgctgccgccacctctgcccgccagcgcccggccatgggaggggagcgacgcgagagagagggagggagagagacgcgagaagggatgtgatcgatgtagataaggaccgtgtggtgtggacgactagataaggacgtttggtgggtgtggaccatgtggtgctgctgagccgctgatggctcggcttaagctataggtgccggttctttcaaaaaactggcacctataatatattataggtgccagttttttgaaagaaccggcacctatagcttaagccgagccatcagcggctcagcagcaccacatggtccacacccaccaaacgtccttatctagtcgtccacaccacacggtccttatctacatcgatcacatcccttctcgcgtctctctccctccctctctctcgcgtcgctcccctcccatggccgggcgctggcgggcagaggtggcggcagcgacgagcacccctcccttggccagtggctggctggcagaggtggcggcggcggctggctggcagtgggga

SEQ ID NO: 21358 - DNA, 16844 bp, Oryza sativa
ctgacgttgaagggtcagcaccaacctctttagcactaaggacctattcggtgctctttggcactatggatctatttgtaagaaaaatatttatattttgacccttttcataaatttatgttaaaacataggccctcgatacaaggatcattggcgccgagggtccattccgagaataagtttgtccaaggatctatttgtaaaataaattttaaaaagaaccaaatgtaaaatctagacctacaacaaacaatagcgagcatatacttagcgcaacgtcatcaagaaaggcacttatgcaagaacagggataataccaaatgttgttaagtgtattctccatgttcttgagtaagtgtattctccctgtggttacttacagaagaatgagatcgacctaagtaacttttagttctagattattatgagtcaacttctgatggtatgtctctgatggtatgtcatatttattgggcctgttcggctgcactcatttagccgtgttgcagccagcctaaacagtgttttgtgtcatcagctgcgacaatgacgtcgcaacacagtggcttcaccttgcagccgaacaggccccattgaatatgacttgtgcatgactaggttgccagaggccaggatctaccaccatgtcagttgatcaagatgtttttgttggacctatagtatagaactagtgtgttgtgtatggaatatgaccaaccattactagtatatgttgtgtatggcatactagcagggacatactagagaagtctcaaataaaactagaattgaaatagagaacaaagatacaacactgatgtttctactttggtgcacagccgaaagaagaaaatctcatttaatgaacagaaaatgttttttcgcttcctcattgagccacgtatacttatatagcttgagacattgaatttggtcaggatggttggattgatggagattaggggaagagtcagaaaacttccatgggaaggatcaatgagtgacatggtggttataaatatcctagtcgtcggtagtaactttgggtagggaaaggaacaaacaatgcaatcaaaataaaagtttctaaatgacagtaaaaggagcaactataataactcaaaatgcataatcgtattctttgatcacctaaagctcttaaatatctttcacatactgtgataacatcttagttcccaacattatcatagctcttgttggtcgtttagtacaaaataccatgcaaacctcactcttttgaaaaacataaattatactcactccagattagaaataattatcgttttagacaaggacatggtctctaaaaaataattttaaccactattttctattacaatatatatagaaatatcaacaaatgtattattttattgaagagctcttaaagattaatccatacatatggtctctatgtttctaaggtaaatattttagaagttatatatagttcaagttttaaaattttgacatcagtattgtcctaaatgacaattatttttaacctgaagcctgaaggaataccaattatagctgtcattatacccaactaaattttaacatatataattattataaattacactttgcacataaatatgcaagtcatagccttgcaattgcatgacttaattggctagttataggtgattgccaaacaattgaatagtgctgctattatggggtagaaggctatggaatggacaaggccattcttgccatgattttttccattctttttcctttcacttatctttacagcttcattctgttggcagagaagtgtttctcaactaaatttcagctcaaagaatatggaaaggaaataaaagaatgaacaaaaaatatatcccaataaatgcttgcagcgtgctaaattttccaggttttgcaaaagtgtctcaatcttgctaggttccattcgttgaggtccttaaatttccctatgcatgctcaatagagtaattatttagtcaattgaaatgttggagaaccaaagaggatttaagtgtcgattaattaagaaaaatgggacagcacatctggagttgaaagctagcagggtgggtgcatgagagcttccccagaaaactattctaccacagctctctatttagtcacttaagcgataatattaaatccagttggagtgtatgaaactaaagtataagtcatttacgttagtaacatgaacaagaaaaatactatggtttagattgatgtagtgacacaaacaatatggggaagattttactcgagatgatacacttatatgggttttcttgcttacccttaccatgacctttttttatcacatcttatcttgacgatgggaactatatggtatgcatttttcatattccaattttaattacattgagtttatatttggatacataacaatagataagtatctcaatatgtgcatagttactagtggtctcaatagtacataaactcatttgtttagttttattgcattgaatgccacctaattaataccctccaaacatataaaaatctagagatgtttgcatcaatgtaaatccatgcttctagttatatcttttccacaacaccatattatacccatcatttaagaaaaatatgtcaaacaatcacaccttatccaataagaaaaatttacctcttgcatatgttttgttcccattctcattcctccggcgaaatattttttttgagggaataatgttcatctacttcaaacactcaatcctgaatcctaagctccaacaaatctgctcgaccaaagacaaacaagactagatattgtctagcaaatcttccatgcacttctcttttgaacattatatacatttggcaatagtgtggttgactgtttgcataatattttttactcccccgagtcaaaaaaaacaatattttgcactccctccattccacattaaaaaatgttttggcggtttggcctctccatccctcgtctagattcactaacatccatatgaatttagacacatatatgatatcatgtattaatctattcatactcaaacatcttataatgtgaaacaaaaggaagtactcaacaacagttgccaagaaccgaacaagtttactcaacaagccattaacgtatgcatactccccttctctcatgttggcatggatgccagggctcactcactttgcgagggtgctatccacattgttgatagcggattaatcacaccaattgtaccatgcataagcacctactgtgcccccaccccagcatgatgtgcacgttcccgatcttccgagaagttctgataaacaacgatttgggcggagtcgcgacacaaatcgatccggcttcttgaacgcgcacgctcttgagctccgcaatcacagcaccacgtctcctctggttatcacctgtgtcgaaacgcggatgacctcgccgagaaggctaatccctgtttgccaatcgaagaacactaacaagaacgagatagaatacaaccaaaattgcatatgaatgattaagctcacaagttggggtcttacaaaccgatctagcggcgaaactgttctcgacagaataatctaagcaaaacccaaaccctaaagatgacggcgactactgatatatagagtttagggtcgtgcaaccaacccttgacgcaaccctaataggttccaacacgatacacggcccaaaggcccaaatacgatgacacagcgccggaacagattatggacgtcaacttgttcggtcgattcccattgactcggaaagaatttggacgtgggaccaaaaccaatggaaatcttcttagctttccatccatataaagaacaccccaatacaagcacgtatgcgacctgggcgcccgttttagtgcagactagtcctggactccgagttgcactcgaggtcgacttggtttaggcctccaccttgacttggacgtattcgatgatattccatgactctaagtccttctccaagtgtctccttgtcccctccattgttcctaatcacaatataataattaggtagcaatctattctcaaattcatacaaagaagaacataggaacgagctcacctctgaattcaattgtcgcgcgcgagctcgtgttatcggtccttgaatgaccgttggaggattgttgtgtgtatccgaaggagtgatgtccgcaacacagcatacacgtgcactccggtcactcatttgtatgatcactatgtacggtgaaattattattgcaggtctgacccaagcaggctaggaaaaatcattctcggtgcacacaaaaatacaagtggaaactataaaaaaaacttgatcccccttgacttagctttaaataaggggccaccaaaaccttgcgctcgaatgtgggcacaaatgcaaaacccacaataaaaagtaaatgctacgaaaagtttagggacgaataatacctggttttatctccaagaaagtcattttattgcaaaagaggagtaagacaaggggaccctttatctcctcttccttttgttttgggagaagacttgttgcaatttcattaacaaggccaatcagaacaaccttatatccatgcctatcctaacactagagaatgaattcccaattgtacagtacgctaatgacacactgcttttcctgacagcatcttcaaaggaactcttttgtctaaaggctattctaaatacttcttcctcttcaacaggtttaaaaataaattttagtaagtcttgtatgattcctctgaatgtgcagccagacaaagttgagcatttatccaagatgtttggctgtttggtaggagacctacctttcacttattggggctgccaatgggtataagtagacctaaggtaattgatttcagccctcttgtggatagaattgaaacaagattgcctgctacttcttccctactctcttatggtgacagattgactatggttaattcagtgctttcttctttgccgatattttacacgtgcactctttccttgccaaaatctgtcatcctttctattaatagagcaaggaggcattgtttatggagaggttcagacataaattccagtaggaaatccttgatcctttgggatagagtttgccaacccaagtctaaagggggtttaggagtaattgatcttagacttcaaaacaatgccttgctaatgaaaaatcttcataaattttataataggcatcttgttccttgggttaaattgacatggtcctcttattatagtgataaagtcccacatgctttatctctaaaaggttctttttggtggaaagatgctctacagtttgttgatatctttagaggtcttttaaagtgcacaattggtgatggcagaacctgtttgttttggtctgatctatggaatgataagattaggcaaaggagttatcctagagctttctcttttgcaaggaaccaaaaagactcgagaaaatcccttgtatacccctgaattttaagctaatcccttctatgcctctgaattttgcttacttccttgtatacctccaaaatttaattttgatccctttcatacccctgccatcagttgaccgtctaatttctaaaaatgattattttaccctctggatgaacatagaaatttattaattatattactaaaaatgtaaaagtttgtcgcatgagactattatagttatgagtttgttgtgtgatgcattatttatcacaaaatttatttttagatatgaaataaaaaatatgtatttatttttgaaacaaagtcatcaaaaagaggagcattcctacaaacataggactaccaatgctcacaataatttttttatgaatgctcccgataaaaaaatccattatcctattaaaatttcaaatagaaattttaatttattacatttgtttttattttcaaaatttagtctcattagtttcataaaatgcacatattgtgcactcaaacaaaaatttcaatttttttcaagcttatattcaaacctaaagcatcaagggcaaaaaagacatttgcaatcaaacgtaatagtgaaatgaatgaaaatgtagcggtaggggcataaaagggatcaagttgaaatttcaggggtatataagggatcgggtaaatttcaggggcatgaaagggatagagtgagttttcagggggtacatagggaatttactcaaaagactcagttcatctgacttccttaatggacttgtcttagacttttaccctccctttgtctaaacaggcttttcaagagtatctttcaatgctttctacagataccttagatcagctgtcggatgaatttgataaatggtcttatgtttggggtaatgataagtattcatcccagaaagtttgtgctacaaatttcatgcatgtgcaggcacctgcctacttaaagtggagctggaagagtaactatactatgaaagtttaggtttttggttggctttttatgattgataggttaaacacttgggatatgcttgacaaaaagttttgtgcccttgttggaagtaatttaaattgtgtgttatgttcatctggagaaagggaaaccccttatcatcttttttcaagtgctctttcagtacagagtgttgggtgcagtttggtattgtatgggatctctctttgtcctttaaaaatatgttgaaccatgcaaatacatcttatcgatcttcacattttctggagaaggttttatatgcggcctagaacatttggaagcaacgaaatggatttatttgttataatgtttcgccctttgttccttcttggatgacattctttaggaacgatctatcccttctagtttttcgcttaaattagatgagagatcaactttactctcctggttgaaccagttgtaatctatttatttatttttaataaaactatataactgtgggggcttcccctacagtgctttccctcaaaaaaaaataatacctggttttgaaatttatagatgaattttacattttattttgtgataggttaagaatgtaaattaaatggacttttcgctttcatgaaacacgtctaatctagctagcatcacgtctagtcacggaaatgggtcattttggatattagtatcgtgtattatattagtgttcgcctagaacatggtatagatggtctagaccacatctagacattagaccatgggttaccatctagttagggcctaaaccgtgaattagactgtttgatcgtctactcggtcaaagattggtctagaccgtctagaccaggcaattagacaacacaaagacgagtagatcataaaattgttgtttagaccatggtctaggaaataaaccaatgcgctatcacatgtcaggagataaaacctggtggcctgcccaaggaccatatagcaaagggttttgatcccaactaaaacacttctctactattcttagacacgtcattgccatgaagtcacgtcacctctcctcagttagttgccaacatggaccttgctcccacctttctctggctcatgacgatgccggttgcttcccttattagcgtcgctagttcttcgatattttatggaacatgttaagtctatctacataagtatcaaaaaaaatgctgattgtatatagtacattatatcatctagacttggattttcttgttccctttcttgttttctttgtgttcctcagttttaaggatttacagtctacgaactcatgtaaccttttagctgtgtatatccacatgtggatatagtggtcgaattttcatccattattaaaagaatatatagtctgcaattttcttgtccgtgtgaaattatagtattgtcaaaagataaatcactaatagaaacccctggcattacattaacacatatgaaatactgcgaactaaatgaagaggtggatacaacaaatatgttaagggaaaacatagtattattgtttgactactactacggtagaggatagataacatgggtttagacacctacaatgtgagccatataaactaaaaaaacacatgctacaatggtttgacattcgcaaggttggtgtgcttcagagcgaagcctaacatgtcttaggcagttcaccaggttgtgcattattagatcctacctgagtacaacatgtataattccccttgcaaatagcttatggtccaagtgtccaacatgcttagcacgtacggcatgtctgcccccacggtcacgcttcctgtctttatcagcgtcatgaatccccgtggcctgacattccttgtcctctttcatctggattgttgttcctctagaaacatttctcctcctgctcttcctcgtagttgttcatacccacctcgtttataatgtattattggccctcgtttgattgctcaatcacgagaagaaatcgatcacacgaatgtgggagactgttccagtaattttaaggctatgatagtttaaaacctatgtgagcacaaataagatcttaagctactatactgacgtgttgtagcaaattaaattgtgagtgtttgacttcctagaacgcacttggcccgcatcttggatgctaccctttttttttttttggagaagggtacaacataggacgcacactaacacacaccacattcacaccacaacacacgcacacacacgcgtgcgcgtccctaacacacgctagaaatgagattggaggcactaggcctcagtgcacgggaaacgtgcagtcccactgaacgcgcacgcgtatgtgtaccctattacctagacgggaccaaccgaagtcagtcccgggtaaagaggggaaaaatccccccggacgagggacgagcgtcaagtttgggactcgaacgctggtcggcacggagcgagccactggctcctgccacccgcgctacgcacggtcctcgcatcttggatgctaccaacaacccttttggtcgcctggacgtgtctccgagccaggcccatggaatgcaaaacagcccacggaaacaagacgaatcgagctttgatgcttgtcctggctcgatgcacgccacgacgatgcatccgggtgtgcaaacaccacacccccgagtgcaaaagcggggatgacgggtcaacaccctcccccctcctcttctcgtcattcctcctctcctccatcttccgttggtcatcctccctctcttcgctagtcgtgctcgctctatgtgtcagacccctctattctactggctctcaccatcaccctgcactattacaaaaactctaaagggtgccggttgggaaacccccttcggtgccggtttttccaactggcaaccaggaggcggcactgatcacccaatgtcaaaggtgctggttccaaaaccggcacctttgaggtgcccatgagctaaaaaaaatcggctcaatgcatcgagccgatgcattgagccgtcaagccgatccaatatagtacccaaatcccaaaatttcctcaaattcatgaacacaaacatagtctataatcctttaaaaaacaacatatcaacatcacattcatcaagaacacacattatcaagaatcaaacacattcatcaaaaacagacattcatcaagactaaatcggatcgaggaggaggcttgccttcatcaccaccccgccaccgccggatggagaggacgagggcgccgccaccaccgttgccgctgccaaggaagctgtcgttgccacctcccgccgccgacccgccaccgccacttccccttccgccagatctggcggaggggagggcgcagccgccgggccgtcggaccaccgccgcctcccctcctgccaccgatccgccgccgtcgggccgccgaagccacctcccctcccgccagatctggcggaggagggtgtcgcccgccgccgccgcctcttctcccgccgccgcctgttgctgccgccgcgtccctcccgccacctccttggggtgccgagagagagagagaagtcatggctgagagagaggataatgtttcccctcacctcccacgcgagtggataaggccgtctctcggctcggctcgttgtcggttttctaagaaaaccgacacctttaatatattataggtgtcggttaatttgacacctataatatattataggttccggttttttttaaaaaaagatacaaaatataatagatgccagtttttatttagaaccaatacctataattatttaaagatgccatttttttatgatttcagcccgcggaggtgggaaaaagcctataggtgccggtttactaccggcacctatagtggcgactcctatttgatgttttgcagtagtgccgtctcttccacttacaatctctattgagcaaggtaaaggggccggctaatgggcgggtgatcgcccgatcaccccccatcccccctatacagtatacactactctcttccttcctcctcttcttctcaccctactacaccataaatttttaaaaaataaaaaacacaaagttgaaaaaatttatgtatagaaatactatataaaaaaattgaattcaaattcaaatttaaaacgggtatgtaaacttttgacttataaactttgggtctataaagtaatatttaaattcaaaatcaaatttgaatcgagtatgtaaacttttgacttataagctttgggtctataaactttagatgtatagaaatactataaataaaaaatatttgaattcaaattcaaatttgaatcggatatataaacttttgatttataaactttgggtctctaaattttagatgtgtaaacttaaggtgtacaaactttaggtgcataaatttactaaaataggaaagtaatacggtgccaaaaaaggaaaccacgtggaagagagggagggcgctaggggcgatcgatcgccccttagcaatctcgttaggtaaatgcatggatggttgtctgccgcccattggaaggttgggcatccaaacgtgcccatagtttgttaaatatgtgatccgaattttgggcccacaatatattcggattagtttcatagtaggagtttctattaggtgtctttcttttatccaatatatatactcttgtaagccgtacgggaaggggtgacattcccattgttattctcctacgtttgtaataaactcctctatagtgattatagtgattattgccggtcggcgcccatggttttttcccgcaagggttttccacgtaaaatttgtgtctccgttgtgcatctattttcataacatagttattatagaggagctacgtcctcctgtaggttaatctgcaggcttgactaacctacaaagatcacaacataacacatgtggattttcacccccttcggtcagagtacacaatcatgttctttgacctagaggaagacatagttgcttcatatagggaaaaaaaactgcaaaactatggtacgattgaagatgatcgatagggaaattatcttctcgttgagcatcccctttgtcgctaaacttaaatagaaaaattgggccggtgcatgggtcaggttcactaacctagttgtcttaggacttaggagtgcatccccagggggtgtgctgggtatgcaccggcatacccagaaattctgaaaaaagtttaacatgtagtttgcaaaaacttatctaaatgatggataagtgcttacatcaaagctcgagaggcctaggtggctagcaaggccccagcaaacagcaagtcaccacccagctcgtgtgcgtgtgcgtcgatacagtattacttgcctccttctcactggtggagaaaccatctttgatcggtccgctagatttcacaatagtctcggttgtattaaaaatcgggactaaaaatatctttagtcccggtttgaaagctcagaggaattttttgatcttcttttttttttgagaatctatgattcagatctgagacgatttgtgtgtgatgtgaatatgtgatgtatttgatttgtgtatgatgtgaatatgtgatgtatttgtgatgaattttgtagaagttatgatgtaatttttttaagattttgtgatgtatttagagatattgatttgagaatttggagactattctgggacgattgatttgggattttgggatgagatagagtgaatcaatatattaaaaacaatgaagaaaagaatataataaagtagcaatcggagctagcttctttagtcccagttggtactctatcttgattaaaaatgggtttttactcccggtttttttatccgggactaaagataatgatctttagtcccgtattcgtagttccggtttttcaactgggactaagggggttacgaaccgggagtaaaaactccttatccaccagtgtcttttcatgttggccgtgcggcgtgggcaaagcagcaagtgcgacggcggccggcaagtctgtcattgcccactagcccagagaagctgagcccctgcagcctgcctgccctagccagaacggaggcatgccggccattgagtcattggcagcagcaacgaccagccaggactagcaacgagagattttggagtttgctaaaagactagttttcacctctttacaattctacttccttcaaatatgcgatctcttttctctgaatgatattaaattgaatcaatcaactattagtattaggatgaacatggatcttatttttgtctttaacatgcatggcaccaaaaaataaaataaaataaaataaaaatgcatggcaccaaacaattatgggattcacattctgtatggtgctagatacgtttcagaagccagagatgctctcggaataattgtatcacttgataaaatttactgagattaataaagcttccattatcttaaaaaagaagatacattccagaacaaaactggttttagaaaaataaaaaggaacattatcaaacaagagtactaaagggagtagaaattagtcgtaattggtgttgttttgtactccatttatagataaaaacatcatatatccctacatgaagaatttagttttcctctttagatttgcatgggcacaaccagggtaaaaaccataggtacaccattgggtatggtgttcgattgtgaagtcagcaagtatgtagtcttatcgaggagatcatcgatgtcattatgttatattaacagtatgatgaattaaaatattgaagatataactgagagtaaggtcaataatatagcttgctactggcgctaaaattgcatacgtcagctattacagccagcacaaaatagcctattcatacaacaattatttacaactttcaaccttacatggctatgcagttttcctatttttctaaagacgaaaccatcaatccgtttctctcaggagatcgcttgaacagtgaacacactagtactccaaatctccaatcgaccattgatttgcttgtagtggctgcgaaagttgtggacagcggccacccttacggcgaagcttgttctgggccgtagctgtggcgaagcgctgcaccgttgtgaggagacgaggcgaccttgcgtcgttgcgcggccgacgcaccatcgccactgtccaagctaaagagcatcggttcctatttcctcctggtttatttttatctttagagcaggtacaataatagactataagtcagctataagcttatataaaggagataagaaaggaaagagaagagaaacagactacagatatgtaacggctgtatcacacggactccaaaacgttgtgtgtgtatgacaggtgggaccaattattaatgatatagcatatatttatatttgtagttatctattgtatgaattagctaccagatcgactacagatgatttggagcgagtaattggctatacttattaaactcgacgttctgattctggctcgatgttcccgttttgagatggtcacgccgccacttctctaggggtcgcgccgcatcgacagttgaacgggcccacaaaccgcctggggtgctgctggcatcggctgcgggccggcgacaggaaagcttcaacgctcttggagcacgcgtgcagcgagtgacaatttagtcgccggctcgccatctctctcctcgcctctatgctccagtctagctttcgaacctacgtgtcttaccttgttgctagctaatccctctctatcgtactcgctctaatagtgcttcaagttgtcaatcatgaagcacatattatcacaccatctataatgaacacattggtcatgattttctatattaaaagtaacgcaggtcctggcaatcacaataacaatcacaataagtaaaagttttactttcttcgtcccaaaataactttatttttaatcttagatatacaaaacgaggtaacaaaagaatcacatataccgaaaagtagtattagtgaatggataattgaggttggtaaggggtattgatagaacaaagctcaacgatttacatatcgaagataagaaagatataaatttttagaacagacaggtaccgttatagggtcatgttactttggagaagcgctgtaaaacccgcgagtcaaatcggacgttatcgacaagcattaaggtactacagtaaactcagtaaacggcagcatatcataaacaggtgtggactgggcggcacaatcgtaaaggagtttgttattgatttgataatcacaattgaacattaatgtcattttaaactatatcgttgtattgtttggtattgataaatatatgactttggtattgataaatatatgataatatttagtttgttactaaattgatcatgcctagagaatatggcaaatattaagtctatcctaccaaaatttgacaatgctaccaatttgccagaagtttggtaattccttcttgtgctggtgcagttgccaactcttttttttcttttttgagaaccatgcagttgccaactcgaatctacagggcataagaatatgtatgtatgagcaacgaaagcatcatctatttggaagtgaaattcccagaactcaaaaactccgccgcccaaaactccacaaataggaagcaaaggtgcccatctaacaaaaagatacaccccagatcctacaatcttgtggaacaaatttcaaactcgtcgcgaaacgttccttaaaatttcggacctaactactctcctgctcattggctgtctgtaaaatcagcatcgatgacatcaccttcctcgcctcctggcttctcggatgggccagcagagccagcggcagcatcagctcctggggtaggtcctgctcctggggcaccctgctggctgtagagggcctgccccagctgcatcacttcctggttcagagcagcgagagcatccttcatcgtctgtgtcgagccacctgcaacagcgtccttgagctccgtcagcttcgcctcaaccttacccttcacatcgcctgggaccttgtcaccgagctccttcaattgtttctcagtctggtagatgacagactctgcctggttcttggtgtcgattgcgtccctcttctctttgtcctccttggcaaacttctctgcttcttcaaccatcttctccacctgaacagtttttgatggatataagtcaatataagatcctagcaggtattagtcaataagacagtgactgcgagtttgctcgagacatacctcatccttcggcaatgtgctggcaccagttatcgtaatgtcctgcttctttccagtacccttgtctacggcgctgacagaaaggatgccattggcatcgatgtcaaacttaacttcgatttgtggaacaccccgtggggcaggaggaattccatcaagccgaaagctaccaagagatttgttgtccctgacaaactctctctctccttggaggacattgatctccacgctagtctggccatcagcagcggttgagaagacctctgacttggaggtgggcaaagttgtgttccttgggataatcttggtcatcacaccacccagtgtctccaaacccagagaaagtggtgttacatcaagaagaacaatgtcgctcacatcaccagacaacactcctgcctgttgtcaaaattttgccagtcagatattctgtagttcagtagagtacatttgctttctgactctagaagataatcaatcctagaacaccagtgagacacacactgattgctccctatagctaaaatttagataccatgcatatgatgtactaaattccatcgagtcttgcctgacattatttatctagagcaacatattgaacttcagtttttatgacaacatatttttcccaaccaatatctccagaacctgacaaaaggagttggttgtgatgacaaggcctttacccatcgcatccatttcaaaccatttttttaaggatcatttgtatatcgtcacattctccgcagatttcatattactagtgtgaacaatgttgcaagttttccacatgtaaggatagaacaaaatagcacatttattttaaaatccattgcaaagcttttggtgatatgatatcacaagtatctaagtagtatggtagactcatttaggcagcagttaacttgggctatgattaactcacctgaacagctgctccaagtgcaacaacctcatcagggttgacagtcacattggggtcctttccagtcattttcttcacaagatcctgcacagctggaattctggtggagccaccgacaaggatcacctcatctatgtctttaaatgacaactttgcatctctgagggcattgtccacacgggtcctcaacctagaagacagttgataaaacattagcagtgtatcattttttttctatttttgag

SEQ ID NO: 21359 - DNA, 4694 bp, Oryza sativa
agctccatctttgccttctcagctgcttctgtaagacgttgcaaggcctgcttgtcttttagtaggtcaataccttcatcattcttgaagttccccgccagccaatcaacaaccctctgccaatgacaatgatttgtgagcatatacatcttgtagaacagtaagaaatgatgctaaaagatctagcagctacagaaaattataacaaatatacatgacgtaagacccttcaaattaagcaaaagatatgattaccaaatgatgaattagaatattacgattactgagtcggtccatccatttgtttcatcatatcgtacatgtttaatgaagattcaaataattcaggcatccaaaattccaccatagagaaatttattatttattcactgtccccagtttgactagagattaagaacttcaagaaaaaccatagggcatatatatgtagtactgaatttactgccaacttatcatcccctaatcacccagaattaaaggctcataaataatcaaagatttggatggaatatacttcactacgaaactaattgagtccctaaatcaattcttaacggttccgatatgtatagttcaaaacttgagtccatatcaacacattaatactactaaaaacttaattttatatattgaaaaagactgttccttgaaatctcggaaagcaaaactaaccttgtcaaagtcatcaccaccaaggtgagtgtcaccagatgtagacagcacctcaaaaacaccatcaccaacttcaagaactgaaatcatcacccaaaatatagttaggagctgaattctcatttaagagatgaaaagtgttaatttaattaacatttgacagacgaaccaaaatgaagtacacccagaaggatgaatggataaacaaagttcaatagaacagatttgatcttatcaacacaacacaatgtgaccataacggcataatgttactataataattccttcagtctggaaatgccccttttctgaggaacctaatcattctcctgtcacaaattatcacaacgtatttggaaaattgctactattgccataagatcgtagtatttgaacatacagagtcctcatagcactgagcaaaaagttgtttagaccagcattagcctttgaaaattcattacaactgtcagaactacaactgaatgtaattaaataactgaaaaaataattgtccataacagcaagaaaaaatgtttttatttttagttttttgacaaatacttcacttggttatgttatgtcaataaaaaatacactacaacagagtacgtgaaaagatgcaaatagtggttaaaacaacaataactggttaaaacttgtagttgcaaatagtgttcagaaaggcaccgtaattgtaggatagatacctgaaacatcaaatgtgcctcctcccaggtcaaaaacaagaatggtctcattgttcttcttttcaaacccatatgccaaagatgctgcagtaggctcgtttatgatgcggagaacttccaacccagcaatccggccagcatcttttgttgctgtcctttgtgagtcattgaaatatgctgggactgtgatcactgcctttgtgactttatcgttcaagaactttgatgcatcatccaccagctttctaagcacctggagaacataaaatgatcaacactcggattaaaaacaatttgaaccataaaacttattttgcaggcatacataaaacatttgcatgcacatgctatttcagtttttgccaacagatccccaaaagaaaatggcacattcgactccaccaaaattacccatctaggcctagtaattgatgaaagaacaccagtaggaaatattgtactgatgaaaacaaagcaaacatgaagggaacccacaggatttgcactataagctgtcaagctcaaagcatataagatgtctaactcagtccatatatatatatagactgcatcaaaaatccacgtgcacatatttagatatatacaaagagcaagggctgttcagtacaaatatcctactacctgcattcccttttgtgaagtgccgttttaaaaaaaaaaaaagaattctatagttttgtgaagaatatgctaaacaaagcatacaggatgggattctatttgtgagacaccaaaaacactgttatggaagctgtgctattgttggcatcaagagaagtcaaggcgagattaagcaattaaccattaacccattattccatagagcttcatgaacagtcacgatcctataagctagaaatcaaaactggccacatctaagcaacgcaacaggattccatcttccaaagcattctttctagattctagccgtcagaacccctcaattgatgatcaattccaacacatggtaaacaatcacaaagcgtaagccacccctatacctgggcggagatctcctcggcggcgaactgcttgccaatggcgggacagtcgagcttgacgttgccgttgtcgtccctgatgacgcggtaggagacctgcttggactcctcgtcgacttcgttcatcttgcggccgatgaagcgcttgacggagaagaaggtgttctccgggttgacgaccgcctgtcgcttggcgatctgccccaccagccggtcaccggacttggtgtaggcgacgaccgacggcgtggtgcgggcgccctcggcgttggtgacgatcgtcggcttgccgccctccatggccgccaccgcggagttggtggtcccgaggtcgatcccgaccaccttctcgcacgccacccgcagcggccgccacctccggcccccgccgcgcccgtacaccgcggcggcggtgcggacggagacggacggggacggccgccgcctgccatggtgggcgaagaagggggtcgaggtggggaaggtcgtggtcgccatggccaccgagagagaccgctggtgctagctaggtcacgaaaccctaggggagggagggaggaaggagaaggtcgtggtggattcgagtggtgggttttttgagagattgggggagaaatggcgagaggttgggggaaggataaggaaggggagggagggttttatagacttcgcgtgtggccaccacactttggaggccagcctgtggcctcttctttcttcccttggatttttactatggttgtggtggtaaatcacttcagttcatatcactccagtaataatacttagattagagtaatgctacacatgttacaaataatatcaccctagttagtctatgtgaaaatgaaatgaagattcaatcacaacgtaccacatcaatttttatctgatatacttgtacatgagattttttttcttttacaagtatcatttttttttaccaataccatgttgtgacatatatttataatcagataatttaaatttagcttcaatttttatttattatgatataagataagaaaagatatttgctccggtcaataaaagtagtactccctccgtttcaaaatatttgacacagttgattttttagcacatgtttgaccgttcgtcttattaaaaaaatatgtggtcaaacacgtactgaaaagtcaacggtgtcaaacattttgaaacggagggagtatttgatgttaggacgttgtcgattagagttgaagggagtatattagaaaatgtatccacttatttattgtaagtcataaattttaatcatttggtgataaggacttttcaaacactttagtctcaaaatattacatctaagaatcatcctagtagcaacattttgagacaacatagtatctagaacttttgtaaaatttggttagtgataattagtaaatgcataccattattccatatcaatccctgccaactagtgttctcttagaggaagtttaatagtatagccaactactagctccaaatcaactatagccaacgtaatagtcaattcatacaatagttgtttactatactattaatacttggtcccacatctcatacacacatgacgtcttggagtccgtgctgtagctgactataaatctgtagcccgctgcttttctttctctttcttaagcctgctattgtacctgctctgaaccggtaaaaacctcgcagtaggctgatcctatgtttctggcccagaaattctgggtgtggccacacggttgggcagggagctgtggctggagcagtgcatccgggaggtggtggaacgttctggaatcaacgggacggggtagtagctagggagcacacgcagtaagctcgcggaggcgttgagaagaatgtgacacctgctcgcccgcgtccgcaaagcgcacggaccgtatcgccgacaggtggggccgcctctaccggcagggccttggaccaccgttgcgtggggcgggtcgctggaatcctgcggttgatgaatggccacgacgacggggcgacgtggtactatgcaagcggacgaaccagatcgcgtggcttggatgaaggtacccatcggttggcaataagccgtactataaaatcagcgcgccgactgatttatggtctgtcaccatggtgagcttctctgtatgtccataatctttcctgtttattcagaattagttttatgccaatgaaatttgtaacaaaaaaattcacacattgtgatcccttaattagtgatttcaatccttccctcgtcacttacagtctt

SEQ ID NO: 21360 - DNA, 19467 bp, Oryza sativa
  unsure (1)..(19467): unsure at all n locations
cttaatgaacacctaaaataggtaatattgtatagtggcttaaaaatttataactccaactgtgggatctgtctgataactaaaaaaatattgtcctagactccatgatgtaaaatttgctaggttaaattagaccagattttgtttttagaattgcatgtaacattttattttttaaaattattcttaccttaatttttcctatgaatttactttttgccatcttctcgagagtgctcaaatgccactctcccaaaatttcattcccaaatgccacccggacctacacgtcggcctcacacatcacctggtcccatgttacttttgtttgaatgagaaaagaggctgacatgtgggcccggataacattttagcaaaaagtaaattctccctctaatatttagtctgcattaattttgcttgtaaaatttccttgatggctaacattgatctcttttttttccttgttattttcctcctcttacatgcagcagcaggtgttgcccggccagtagggcacccaaggcccagcacgcgcgcctgacgacattcgtccgctcgtcgcgcgtcctttccttccagccggtagcgcacgtcctcgcacatgggccaatcggcccaacctcactgggagcaggcccaactcggacgcgcgtacgcgagaaatcgggaaggcacgagtagaaagaaaataatcagagcagaatcagagatcgcacgggggacacgtggctaattttcaggggagctaatcctcccagggagccacgtggccgaatcatatgcctgatttttatccctaaaatcggtttagataagattagcgaaaagataatttaaaatcagaacttttatatatgtgtccaactgtccataacaacttaaaagtaaatactaaaacgaaactacgttaaaaatactttaaaatctggcaacggcttattatttatagagaaatgatgaggcccgaaaacagtgtcggaaattcctgctaatcgagcatcatttttataaaaagtacctctctcactgtttcaatctaaaaagttcttttacaattgtatacacatacataaagtattaaatataggttaaataaataactaattgcatatattgcgactaatttgcgagacgaattttgtaagcctaattgctcaatgatttaacaatgtggtgctacaataaacatttgctaatgacgaattagttaggcttaataaattcatctcgcggtttactgatggattctgtaattagttttttattagtgcctgaacaccctatgcgacaccctatataatacccgatgtgacacgccgaaactttacgatccttgttgacaccctctaaatgcatcatgtgagtacttcgcttctgatgaaggggtgcaagatgagcaggagaatgattttagtgtagtatctacaacctttgttgttcatccctattcctaggttcatttgtttctttagaggatcattctatttgcaaaagaattgatgatattacataatgaaagtttcttgtaattcttttcatttgcgtatttctatgggtaagatcatgtattatggggcaaccatcacatgaatataaaacaaaggatggtatttcatgaaaaaaaaggtaggatgacgtgatcacggctactatgtataaaaccattgctcacatcatatatcatcaaggaaggtgtcgtttagcgcaacacaggggagtaacgcacgattaggagtcacacattgataagaaaaagcaaatgctgaaaaataaattataataaaaaaaagcaaattagatattaggctttttttttaccaaactttgaaagtggactagggctaacataagatttttgcaatttggcaaagttctacaatctgagcccctccacgcaggcacaccgttgatcttctcctctaagcggttactccctccggttctatattaattgatgttttggataaggttgaggtcaaacttttataacttagactattaataactttaaaaatatttagtttaaaggaactagaacaacatatatagatttgtcttttaaagtactataataaaaataaacatgcatttatttattatatatattataacagaaaaaaaagatcaaagatgtatcttgtagaccgtgtcattgtctaaaacgtcaattaaaatgaaaccggagggagtacacgcaatctggtcactgccaaggcaccactactgtcctcgaaggtatccataccagcccagggacgcatatcataggattatggtccaaactgcattgcatagtgcaatctgcgcttcttcttgttgtttccctcattatctagagcgccgagattagggccagtgttgccaacttgggagcggcatcttctattaattgttgtttctcttatcatccgcgatacccatgaggagaattagaaaattattaacggagtttaggttaactgacgattcacattaagcttgatcaacagcactccacaaaaatgcaaaggccatatgttagaggacaagtcacgtcatggcaataatcaggacaccataggaagagattagctctcaatgtgagccaccggtccaacttaaagacttttatagtacaaaacctgaaaacattgtctacggagtagtgcattgcaatgggaaaactaatgttatgataataatatatgttatgataataatctatctattaacttagtaaagtaatagaaaaatgagcattcttatggtttagaaattattatcatattaattggagtaaaataaaaaaataaggagaattcattgtagacaaggactctttcattttctttttttctaaaaaaaacaaatacgttatatatgtgtagtgtccaatcggacagctgcataaaacaaatcttttgcaaggaaaaaaaacctaagctggatagattaatctctctatacaaattaatacaaagtattgctattttttaatttttgttgaataaaatttagaaaaagaaatgaaatttggaattaagaaaagaaatattgaaatatgagtagttcatatagaaataaaatttataaaataacaaaaattataaaataaattatatttgatgaggattctagaatattctcccaaagaggttagagtgcatataggaatacaatttagaaaaagacttcaaattcaaataaaaaaataatattgaaatgagagtttagagtttgtatagaaatacaattagaagtaatgtaaataaatcgatatcatgaaaaacgtatagccaaatttcttattggttcaatttagctagaattaaattaataagcagtcataaacgattaaaataatactaatgctatttctgaaaatacaaaaatacttaaaatcactgagagagaaaaaatgattttagccttgcccaaatatatgtccctcttctgtgctacgtatgtgcggtccatgaggcggcccaatggcgacttggcctaggaatgacgcccgacccaacacggcagaagccagggtcgtccgatctgatggacggtcccgattgatcctgacctaaatgaatatccaacagcttaaaccctaaccttaaaatcatttcccccatacccttgctctctctctcgaaaagcaacggcgacggctgtgatgattccagcgggcggcaacggtagcgcccttccccaccgagcagatccggctacgacggcggcgttagcgtcctcccgcggcttcccacaagcggatcaggaggcgatgggggcaccctccccattttcccacgggcagatctggcggcgacggtggcttcccgtgggtggatccggcggtgacgaagattgagataagattgtgcggtttttattattttttctagttctttttctctttctttggattgtctgattggatttcgatctgacttatggacaaaaaattgatgttacggacaaaaaattgatgtgacaaactgaaagttacaatttttttaagtaaccacacgtgcaatttagtttcaaaatactctaaaaatcattagggagtacctatgcatctttcgaaagatttttatgatcgtatcacacagatttttaatatttggattaaaatctgatagacacagtaaaaggtaaaaagcaactaagaaacaccataatggacactaaattatcctatcttcaagaaaaagtccaaatccaatacaaatttcgaaacttacatgtgaagattcaaaaattacacagtaacaaagttacaatgtaagtttcataaattacactgcaacttacaagaaaatgcactgtaaatttgagtgagaaaatcgagtgagagataagaaaaaaatcttttgagtgagatatagcaaaatcgaaatcacaatgatttaagctaggaaaaagtacaccgaaggtccctcaacttaacatcgggataaaaaacatcctcgaaccgcaaaaccagataccacggatcccttaaatatacaaaccggtcacaataggtccctcagtggttttgatctcggttttgtcctacgtggctgctgagtcagcgtgggacccacgtgggccccacatgtcatcgtgccacatcagcctactctctattttcccctcttctcatctctctcactctctcttctcagggcggcgggggaaggagcggaggccactggcgagggtggcgtagactagccgacgttagggggaggaggccagtggggcgcggtcccgcgccaccgcccgccacgtgctccgtgaggtgggccgcgacgacgtcgtcgtcgtcgacggccgcgccgtctctgcccagttcgccatggctggcgtagacccgggcactgcgacggtggcaggaaggcgagtgtatgtgaggaggccggtggggcgaggcgggaccggcgtcaacggggcgaagcggcgggtgtgccggagacccagtaggaccagattcgggcgctcaagcgcttcaatgtcggcgaggactagcccgtcttcgacggcctctacagcttctgccagacctacgccggcggctccatcgacggtgccatcaagctcaaccacggccacgacatcgccatcaacaccctcgagctcgcctgcgcggcgacaccctccccttctccaacggcgctgcccccgccgacgccgacgtcctcctctttctcccacctcctgggcctctctgaccctaagacggtggggcaggggagagggcgagaaccgcggcgacggcctcccgcgcccaccctcacccgccgccacccagctcctctcctggtaaccatgccgcccgcgccaagctccatgtcgccggctgcgcactactctgcccccgatggccgcaccctgctcctcccccgacggtcgcgctcagctcctcccccggcgacggtggcggcgtgggaggacggcagtgagaggccgtgcggcaccggcaatcggtgtccaacggtctcgccgagggcttctgcctcatcgccctcctcgagttcctctactaggaggcccccgacgccatgcgcagcctcacctccgcctacgccgccctcgccgatggcctcggctgcttcttcgccggtggcctacgccgcccttgctggtggcctccgctccttccccctccgtcctgagaagatagagtgagagagatgagaagaggggaaaagagagagtatgctgacgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcgaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaaggcacgcgagccctagccgccagccgactcgaccagcgcccggaggcggagcacccgccgccgccgccctcgccatcgtcggcttcacccctcatcggcaacctagtgcaggtgagctccatctccacccctcctcatctcctctcctccccacaccatctttcctagtctccctctgttgcttcctcggatctgcttcgctctcgtgctctacgcctcacacgacgcgctcttcctcgtcgccaccaactttgttgctgcgcgcgcgtacgtcggtgcgctgtgcgcgttctacttagtttgccttgtgatgctgctcttagtcgggttagtgcttcgtgctgtgctcgctggtttggcgcttcagatctgtgtgctgtttgctctcggagacgctagatccatagtcgtcgacttgcaaatgctgcgagctaatatgattcttgttggatttcttcgctcctagcgtgagaaatccgaagaattgggagaacacggtctttttttttgtcccaataaattggttggattgttctagtatatattttttattatttttttctcccaaattgttggaatggcttctccctctttcccaactggttggattccaaattgttggaatggcttctccctctttcccaactggttggattgaggtgaagcgtgcttactgtattttttccacctggatttggtactatctttactctctgaactagttgggaacggatattccaatctcctgtctcttcgtgtgacttctttctgcttccacgtggggttctggaatcttcaattcactgtagtataagttcatatcttatttattctcatagactatgatttggtcgacttcgctcatatattgccgtgtagtagagggtttttacaattattcacgttcttggattgctgagatatcatggttagttgtgctgtttgaactggttatggccctcccgctgtgaattgccaaggtgtctgaatgttggtgattttgtggatagttcacgtgttggacaaagaatgcattataggagtgacaaatatgactggtttttgcaaaaccggtatatattgtggttatgttccttggagttacaaataacttgcagtaatgtttgaactgtgggatggttatgacatacatcttatattgggtcgtgtgtgaactgtttgttcatctggatgatgcataattcacacgagttggatgaaaggttctacctgaaatggaagaatatgtttggtttctgtaatttcgttgatttgttggttacatctctttgttgtatattttatctttttaggtgatgtagctatatctgtttccttttatatgacaagacgttgtgtgaaagagggttccagatttatttagattttacgttgtcattgtggtcttgtggtaattgatattcattgtttgttcagattattttaattgagtattatactccctccgtttcataatgtaagttattctagcattgtccacattcatatagatgttaataaatctagacatagcatctatgtgaatgtgggcaatgctagaataacttacattatgaaacggaggaagtagtaattaactacctttgtacttattttgaatattctacttgttcgttctaactatttgtcagtagagcattctaacgttttacagcttggcaaatttttgcatgtcattatcgtatccagttttccacctaactgaaatccatgtcctgaaattgctttttcataggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggtactgcatcctactgtctgttttttatttattctccccttggatgttgacttatattgtacatttgcttaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtaccgtggattcaacatctcctgtgttggtatcattgtctatcgtgggctgtactttggaatgtatgattctctcaagccagtcgttcttgttggcaaccttcaggttagtgaagtgaatgcaatctttgttcatcttctggcaattttttatttattccataaggttgctccactaaaatacctcgcgctcaaatattttgcctttctcattgcttcatttgttttggtttagttgaatctactcaatgtctctatactcctgctggttgttatatttacttctgataatatgtgatatatgttattttcaggataacttccttgccagcttcttacttggttggggcattaccattggtgctggccttgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaagactagatgatgatgataagcagtggggaactatggacatattaggtgctttcggatgctgttgcgtttaaataaatttaacgtatggacaccgtttacatgttattaggcgtcaggtgaggtttctgagtgtgtaaatcggtggcagatgcttatgccttttttgttgggggatcgagcaagacgagttttcctagttgaaaacatgccaaattattgtctgtgaaagcgtttcttgagattgttattgatgtggttcctagtcgattatatagattatcactccattgtagcatcttcgggattttgtcttatctaaccacatatgcaaaaaaaaaagaaaaaaaacccttgttatcttattatgtgagaggtaggacttagaagctgttcaggatattttttgtggtttgcaagctgactttctgaggacataacattccttgagaaaatttaatttgtgtagataacacaagcacgcaaacatccgcggggctgcgctgacatgccggagtagtaataaatgaaacagaaataaaactcctcaaggacttgtttggttaatccttgtgaggaagggattggaaagccttgtttagttaatccctatgaggtagggattggagcaaatttattccacatctattgtggtgtgaaattattaaatgaaagagaaataaaactcctctaggccttgtttggttaatccctgtgaggaaaggattggaaggccttgtttggttaatccctatgagggagggattggaggaaatttattccacatctattgtggtgtgaaattattctcccttaatcccctcccatcttcttcaatccactctaaaacgaacaaggctctctaaaccgaaccaggctttaagaattcatcctcgtgttgacatggcggagtagtaaatcaaactccttaattcgtctttgcgaagatgggaattttggggatctgtactccttaagaatgtcagagtgaatttgttttgtactcagtaatgtaggaattttaagcctcctttgacctttgggaagaggtcttgtacgatttgaataataatatgggaaaatttcttgttgagcgaacaaagtagaatttcttgttgagagcgaacaaaggagtgagactaagagaattctacaaaattcttttagaatgacaaaaacatgggtttttagaaacatgattcctacattttttatacaatttttcatacatagttttttgaaactaaaccgacaggagaactgtcaattatatttcaattaagcaggagtaaaaacacagacagggttacagaaaagaaaaaaaacaaccacttggcgagtaaactcgccaagtacctcaaccgtggccggtacaaatcacacagcacacggagcaccacacaacttctagccaaactaccacggcgaaatccaaagacaaacatcgacgctgagatgctgaagaagtggcacacgactttgacatcacaaggcgcatgtcatcgttgccgagcttgccgcccagcgaccaagcagcttcgacttcacggcgatcgcaacatcatacaaactttttctgtgtaaaactttttctgtgtatcgattttctagtttacgcatgtattcctattaaaatcatatccttcacgcgtttcaaatcaaagtagccctaagaatagtactccttgtgaaggaaattttacaaaatttgttgaactcttgcaagcaaatcactttgtagtttgtacgatccgattccaaccccaaaggcagattggtcagcatcaaatatggcaggctgataatggtaatggcacctacatcaccaacaaagaactgcgaactgcattgacggccacatcaatgggagaacatttctacgcgcatgatccgtcacaatcttacaacaaggcggccgaaaattccataattactactcccttccctctgttccaaaataccaaaatataagtatttttagctataaatttgaataactatatatctagatttatagccaaaagttattatattttaaaacggggataatatagtagtaatgaataatgatggctagtaagtttttgcactccttcactctgacaggctcttttttctctctcataaatatagtagagctaggcttcatttcgttaagaataagcataaaatcccatttccaaaggagggttcacattcatttcattaagaggaaacataaaaacccatttccaaacgagggttcacaacccttacgcgtactcctaccccaaaataaaacaacaaaacatcataagatgacggaggtagtgctcgtaagatgcatcacataaagatgacacacaaccaatttgataagcactaatccacaaaacatcatctttgccacacaaagagtggcagaacattgaagccaaaaacctgtccatgactacagcaaaatgttgcccacaattgctagtagtaagcaagaatagaatacaacaccaagcaggcataaaacagacaaaagtcccagcaacgggcattaacaccgactgtagcagcacatgcagctgtagtaaatatttttcaggtgatcgcagggaggaccggaggaatagtctggtaggtcaacttattctggaccaagatgtctggaatttatacagttgggcatcaatttggaatcttggttcacagggatggtttataccatcttgccacaaccagaacactgaatttgcatgctatccatcatgtacagaaaaactaagcaatcctagtgtttggattgaactgttattaagaaattcgccatctgcttaagcggctgtttgggaaacagggacttatcacatcggatgtttggacattaatttagagtattaaacatagactaattacaaaacccattccataactttggactaattcgcgagacgaatcttttgagcctaattacgccatgatttgacaatgtgatgctacagtaaacttttcataattatggattaatggcttaaaaaattcgtctagtgaattagctctcatttatgaaattagtttttttattagtctatgtttaatactctaaattagcgtttaaacatccgatgtgacagggactaaaaagtgaaaacatcaaatcatgaacaaattgtggcagacaacattaatactgaagggaaccatcactccaaagaaccatctattggtaatcatcaagtgaggtatatgtagcagtacagtattttttttttatctaaatgctaaagggaaccatcactccaaagaactcgccatcaaggagtgattagtgttcttagctgaatgatcaacaagtaaaatcccaatgcatgcgacagaatgcccattggactattccctactaagtactaattaattagacttgagatttctgacctgaatgaaagaattatgtcatatagagaattctccacaaatgccatccaaaatatccatcatcgtcatctgaatcatctgatcatcagtgcaatttcgatagattatgctacagcatggttgcttgatacacctacgtgcttttcttcgtcatgctctgcttccgttctctgaagagctccttccagaggttccaaatccacaggttgctgaccgtgatggcggtgccgacgacgacgatccaagaaatgcgcacccaccacgggatgacgtcgacggcctggccggacaggtagaagaggctcatcttgaggaagaagagcgggccggcgacgcccctgacgacggtgtagatgaagtagaagggcggcgacagcgccctgtacaccctcgccgcggcgggcttctcggcgcgccagatcccggcgagcgtccagacgttctggaggaggctggtgacctcggcgaggacgaggaggacgaggagcgcgtaggcgccgtgcggacgaggtagcggcaggtgacgaacacgaagagcgtggcgacgtggtgggcgatgaagagggtgtccccggggaggaaggcgaggtagtggagcaggtccatggtgaagtaggcgacgctgtagtcgaggacgtggtcctggaggcgggtgttgggcgcggcgaaccccctcgcctccggcggcagcgcgaggatggcgcccgccgcggcgagcgcggcgggcgtgccgtgcgcgagggagatgaggcagctggcgccgtcgaggcggagcggccacgcccaccgccggagcagggcgagttggccgacgcagtagatggcggcgtacatggccaggaaccccgggtacagccaccgctcctcggcggccaaagaatccagcacccccaccaccgccatggccggaccaagattcgcgccgacggagcgagggatcccgccgctcctggccggtctgcctccgattcgggcccaaccccccgcgtgcgcgcgaggcggaggcgaggggattcgatcgacgccggtagggtttcggcggcggcggcggcggcggcggcggcggcggcggagggatggatggctgtggagcagtgtgaagggatggacggccgcgtggatggtggggaacgaaaagggggagattttaaagcgattggttttggtttgtttttttttcttttcttttttcgatatttgtttacgtgggttttggtttggtttttccaaattaaattcaaattaattttgggttgagtgattaggtagaggattatagagggtttgcgtgttaaattggggttttggaaggaaggtcagtcttccgggtgttgtttgaattgaagattatattatggttgagacttgggtgccatgaaatttcttctcggttaactatcattacaatattttgctgagttggcacgagttttcatatcaaagttatatttttagcagttttatgaactgaaaataaaaaaaaatgtttggactttgtaatgagaggcacaatgccgacatggaaaaacaagtaaaattttgtcagtgaatcactcgaaacgaacgaacaaggtatataaatttatactcatcgatcagagtatcttatagtatatatactctttccgtgttttaacatatgtgccgttgattttatgagatatgtttaaccatttgttttattaaaaaaatatcatttattttattgtgactttatttattatcaaatgttctttaagtaagacttttcaatgtatacaagaaatttgaaataagataaatgatccaacatttattaaaagttaataatattatatattaaaaaacgaagatagtattgtaaatggctccttttgttttatactaatatggctgaatagctaaataaactatacttgtctaaaaagcgttaaataaactatatccccttcatcctcaaatataattattactaactatgtattttgataaaggtatgtctaaatgtgtagctaaaattgactatattttgagatagagacagtaaaaattattcgagagtagtataaacaaatgaattaaatattcgagggtaatattatttgggatggagtataaaataaaaaataaatctaacatagttttatcaaaaaatcatatataaaagttttccgtaaatcactctgtttataaacttgggaagcatggacatatatcaaatcatttcattaaacataatttctaaatatttagtcatttttcctccttacattaaagaaaggcatatacatccacgacacaagcttaacaaatgtatggatggatcatggaatatttggttacggagtaattaggtccggaagagcacacgctctatttcgaaacggctacttagatcacgtttcatgaaatgctaaatgcttgtttcatgcaaaagattttagttatatagaagttccattaaaaataaataaatctttttttaaaatataatacttaatactcgattaattatgcataaatggttgtctcattcagtgtgcccttaaaatttcaagctaaatagagctccaaatgaagccttaaaacacgagatttttttttctttacagcttgaaagtttgtcctcgcaaaaaggaaatagaaacattcagaataccgtctaaaggagaatcgcatactccatattgggttgattgggttggttccttaaacacggaagcaagctttgggctgtgtttaaatcaaaagtttggatcgaaacttccaattttttccatcacatcaacatgtcatacgcacacaatttttcagtcacatcatctttaatttcaaccaaaatctaaactttaggctaatctaaacataaccttggtcacgtagtatgcgtaaatgtgtcgatatctttttctggatcatgtgacagatcatggtattggcgaatattccacgcaatttggtatcatgataccttgtagtagtagatcgcgtgggggcgtgtgtgttgctaaagaatgtgattcttgtggcacactgctagctctacttgcgatttctatacactaacactaggctgctcctgtctttttcagccttcagaagcgaataaaattatcatcgctaaagtatataaaggtgataataaatgtatatatgttgtcataagagcaagtttaatagtatagccaactactggctccaattcatctatagctaatctaatagctcattcatacaatagttacatactacactattaatacctggtcccacctgtcatacacactgtgtcttggagtccgtgctacagctgtctataaatctgtagcccgctgctttcctctctcctcatttatcttcttaaaatatgtttgcagctggtttatagcctgttattgtacttgctttaatgctctaatgatgggcgatggcggcacggaatgtaagacggattaggacaagtttaacgaaattcgacggagactaatccgtggctaattgtttattgcacagacatgatttttcctccaacaactgcatttgatttttnnncccggctccaaactacacgtttgttccaatcttgtttacgaaactgcacctgtttgttgcaaagtttagttttctaaaacaatctgcaacaagtgtacttttgtgtttatataagggaagtgaaaagtgtacttttatgaaaccttagtacctgctcgctcttcacgatattcccgtacaggtgccgttaaatttacttgcataacgatattcccgtacaggtgccgttaaattcatttgcgtaatactagcaggcaaagtgttaattacaaactagcaatacaatactccctccatactgtaggacgccgttgactttttaacgttgataaaaaatcaacggcgtcatacattaaaatacacagggagcagtagttttcttagaccgatcactaggtgaaggtttcttcatctgaattgattataagtagggaggataatacaaggttcattgatttacaatggagcataaaggggagatgaaatttcttcacagggtgtaactacaatcctgcaatcgtatttcagatgctcagcttagagccgcatagcatcatctacacattttgttataaacctagcgagggaccgcaggtatgattccacaacctccaaaagcaaagaaggtagaaaaactggaagtgcttgaacggcagttggctgggaggctgcaagctggtttgatctctcatggaggagatgttcagttgcaacggtagttgattcagttaatgagaatacttacataatttgaagctatgatctacgaagaaggaatttgattcagtaatttgaagcgtagtagcaattggcagcagagttgaaaaaacatccagtcatcctatagaggttgactgctcctcaatgtcctccctcttattgtcatcgatgacggaaagctaacaagatgaacaaatatgctgaatctgcttcctgacgtgcatgctcggaaggtgtgaaatatgcctactattagtatcaactatcttcaaccacaacggactgaggtgcatgcttagaaatcatctcttattgtttggattgggtacccatgcgttgcaacggaaaaaaaatcaatttaagatcacatgttttaatcactcacgatcccatgtgactaaaatttgagccaatgccataaaagcgatcatctcttactgtttggattgggtgccaatgcgttgcaacgggaaaaaaaaatcaatttaagatcacatgttttaatcactcactatcccatgtgactaaaatttgagccaatgccatgaaagcgaagtaataagtagataatttgcttaataaaaaaaataccccctccgtattttaatgtacgacgctgttgactttttgactaacgtttgactcttcgtcttattaaaaaaattatgtaattatcatttattttattgacttgatttatcatcaaatgttctttaagcatgacataaatatttttatatttgcacaaaaattttaaataaaacgaatgatcaaatgttggtcaaaaatcaacgacggagggagtacttgaaaaaggaagtttaagcatgaaatatatgtatcttgttttatagctgaacaatattactaatgttttattttgaagtacacataacgttaacaatactattttttttttgcgaggaacgttaacaatagtatgaatacatgatcaacgagttcctaaatttttttgaagtacacataacgtaacgttagatcccactccgaacagtcaatgattatatgtatcaaatatacaacgtaacaatcatccggccatcataaaagctcatggtatattaaaaaaataaaaatcatctcaagagactgtatgctacatattaaatctaatgatagaagcttaatttggacaaaaaatcaacaaggcttaaagaacattaaaaaatcatgcttaaagaacatttgataataaataaagatccaaaaaatcaacaaggcttaaaaatttaaaaatacaaccagctactaatttgtacaatttaatattccaagatgacatcttatatgtccaactaatagaaaaaaccatgactacagacatcatgataacagcttacatcttataggtcaacatacaggaatgatggaatttattgacaatgaaatgccattaggaacatgttagttggacagtaacactggatatttcagcaacataaggacagctacacagactgaaatagattctacatgtgtgtacatatatgaccatataatattcatatttggtgaaatcactctgcaaatctaatcatgcacacatagtgtattaatcttatttttctcaactaatactaatcgaattagttataacaataattgaaaaaaaaagaatgtgataaatgcatgccggatctatcatgtttaactgcatgtgataaaccattgtgtacggtaaatgaaatatgaaataagtttgactgatattccagtaggtaatgatttcaacagttaatataaaaattgcaaagataattagttagtacacaatattctttgtgcacactagatatacctcgtctatgctatgaggacatccttgtacacaatattctttgtgcacgttgtagtatgtttggaccgtttgtttttcttcctctctttgtcctgcatgagagaatcttgatgtttgttcctgaagttgctctagacaacgtgacgtagagctgaccatgagagaacaccggctccgggaggtagacgcctgcatttggaattgtttgtccttatgccttattgatcgtcaattcgaaacatagtctaattggaaacaactttctcttaaagtgaaacgggaacatttcatcatctaaaaggcatagaggtatccgaggaaggaaaactcccttaccagcatgctgccctaccacaatctccacgttaatagcatttcttccgaacccatgaaccactagtggccttgtcccgtttcaaagtccgttggctgggtcaatgttcctcaatagcatgatgggtagtttaacttcagctttagcacatgcggaggtagcccgtttggagttagagagttcaagaattcgggcaggtaatagctatgagggtcatcctctgctcggtaaaaaactatgatatgtcatcatctctcctcgaaatcgctcgatcattttcatgtttattcgatccatgaactcattctgagtggacattatggccctagatgtgatgtagtttgggtccgtaaggttatcatttaggttggggaacacggtatcagcccatcgaggtccgagtcattccctttgcatgtcacacaaatatccgaaggcaggtgtatgtgt

SEQ ID NO: 21361 - DNA, 6739 bp, Oryza sativa
ggacacatacacctgacttcggatatttgtgtgccatgcaaagggattgactcggacctcgatgggctcatggataccgtgttccccaacctaaatgataaccttatggacccaaactacatcacatctagggccataatgtccactcagaatggtttcgtggatcgaataaacatgaaaatgattgagcgatttcgaggagaggtgatgacatatcatagttttgatcgagcagaggatgacccttgtaactattacccgctcgaattcttgaactctctaactccaaacggtctacctccacatgtgttaaagctgaagataaactgtcccatcatgctattgaggaacattgacccagccaacgaactttttaacaggacaaggctagtggttcgtgggttcagaagaaatgctattgacgtggagattgtggtatggaaacatgctggtaagagagttttccttccttggatactcctatgcccttcggatgatgagatgttcccgtttcgctttaagaggaagcaatttccaattagactgagcttcgcattgacgatcaataaggcacaatgacaaacaattccaaatgcaggtgtctacctcccgaagccggtgttctctcatggtcagctctacatcgcgttgtctagagcaacctctagaacaaacatcaagattctctccgtgcaggacaaagagaaggagaaaaaaaatggtcagctctacatcgcgttgtctagagcaaccgtctaaaacaaacatcaagattctcaccgtgcaggacaaagaggaaaaaaaacaaacggtctaaacagactgcaacatgcacaaagaatattatgtacaaggaggtcctcacaacatagacgaggtatatctaatgtgcacaaagaatattgtgtactaactaattatctttgcaatttttatattaactattgaacacatttgatatttcagttgaaatcattacctactggaatatcagtcaaacttatttcatatttcatttgccgtacacaatggtttatcacatgcagttaaacatgatagatctggctatcacactcctttttttttcaattattgttataactaattcgatcagtattaattgagaaaataagattaatatactatttgcctcacttgcatgatcagatttgcagagtgatttcaccaaatatgaatatattgatatgttcatatatgtacacatatgtagaatttatttcagtttgtgtagcttcccttatgttgctaaaatatccagcgtaattgtccaactaacatgttcctgatggtatttcattgtcaataaattaaatccttcctgtatgttgaccaataagatgtaagattgttatcatcatgtctgtagtttttttgttagttggacatataagtcatctcggcatattaaattgtccaaagtagtagctggttgtatttttaaatttgtaagccatgttgatttttttccaaattaatagcaagttgcttctttgatttgtaacccaggttagttctttatttagaaagagttaacatctattacaatagtatgttgacgaatatgctaagagaatacagttttcattctgcaggttttactccttttgataacttaaagcatgtggtgaaggcaaacacgtgaattcgtggcagaaatttttgtatggaaatttaacattgatcagaacaatttgtatgcaaattatgcatcacaaattggcatatatttgatacatatcttcaatgtaccgtattttatcatttaaattaagcttctatcattggatttaaaatgtagcatacagtctatcgagatgattttcattttttttaatatatcgtgagtttttatgatggctagatgattgttacgtcgtatatttgatacaaataatcattgactggtcggattcgaattcacctaacgttatgtgtacttcaaaaaacaattaggaacttgttgttcatgtattcgtactattgtccagctataaaagaagatacatatatttcatgcttaaactttcttttcaagtatttttttattaagcaaattatctacttattacttcccttttatggcattggctcaaattttagtcacatgggatcgtgagtgattaaaacatgtgatcttaaattgatatatatttttttcaagttgcaacgcacgggcacccaactagttcacatcattttatcaattttaggtcatgttctccaagcaattacacaatattttagtgcttctatcccgttagaatggctgactcaattaaaggaacaacaaagaaatgtgtcattagaattttttagaaacaaaaaggtctgcattgttcacatcagtatttttgtttcaaaaaaaaaaaggtctgcatttgtaaactaatgatttttcaaccttcatcttgcatctaaaaatattgatcagccataaaaaaaagacattcgtgaaccagggaatagtgtgaacacatatattatagcaatcaagagttgagaagttaagattctcacctagagatagtagcatgtgagttcacaagatctgaataactggagctgcaatccttaaagcatcaatctgtgaacagaaaaaagcaaaagaagatttcgtgaggtgaaagcatgtgggtttgcaacagttgaaactcgaataaaaagaacaattctcaccggacactatgcacctgggtcagcttcctgtcagccagcttgtaaactctgaaactcgaatcagaagaaatttattgtttgcatatacttgtggtcatcgcaacgcgagatggaggggattatctgaaataccagatgtaggggattaccaaatggttccaaacttaactttgctttttttacatacaggtgatttttacatataggtgattatctgaaataccagttgtcatgggcgttgggccggctaaggcccatcggcagcccatgacaccagttgtgcagacaaatgagtgataacaatctgaatctctccagtagagaacataaagcgaatcaaggttgttcttgttcatgatttttgattatattcaaaaccgtatgatcaacttagtaggaaagaaaatcagcagattttatacgtgttgtgcctatttacaacctgaaacttatactaatgtatgtgatggcatgagctccctaacatggctagtatgtatatatctgctgttattatgaagagaaaacatggcagcatatgcagtcagcagaacttaccaagaagtgtattatactggagaggtagatggcatgatgctgaacttgaacagccttaagagagattgaattgaggaaaattaagagatgatcgaagtgtagcctgaaaaggaaaagcagagtgagaaaggttatccaatttctctgcagatattcattaaaaatatattgcagcgatcctttttaatatatcagactacccaacatacataatcttgattttagctgctataattaaaatcattgaataaacatgagaaattatggttaatagtgaacagtggggatttagtcaacacagtggatttctaaactcgaaagccattatgaatctctatgaatgaatgaaccataccctgcctcgtatgcctcctcctgtacaggaacgggatcgtctgtacactaagtgaacgcaacatttaattcatacatagtaaaacatcaagtacactaagtgaaacatttttcggtggaacaaaaaacaaaatgaattctcttaataggaggtttccaaaatatgtggtttttttgttgcactggaatatttcgttcactgcaatattagatctatatatagtaaaacattgtgagtacactaagtgaaacatttttggtggaacaaaaaataaaccaaatttccttaatagagagtttctaaaatatgtgggttttttgttgcaaaagagtattttaattcactgcaacattagatttataaatagtaaaacattgtaagtacattaggtgaaacatatatttggtgaaaacaaaaggagggagaagtaggtgggcccacgtggggggaggggcgcacggggagtgcctgatccggctctcccgcgccggtcgcgcgacgtagagattttcgaaagaaaggcgatccagacgttggatttcgcaatcgatccaacggttcatactccgcgggtctgcctggcgaaggatttttaatactactagagattatgccaagaccacctatacttgtttgtatatatataaagaaaaaagacgccctgaacatcaagtgcagcccatcaaaaagaaagagttgtacgcatgcctaaaccacctatacttatttgcttggttttctttataaatttgtcatactatcaagagaggtgataatcttggcaaacatataagagcagctctagcctgcacctaaaatcgatttcaacgtaaaaagaaccgaactatgcacactgtgggaagcgaactgcatgtgtcagatgaaaaagcaactccaaaacaaaagtcgaacactgatgataaaaaattgcttgttgctataggtgggattaagattttttttatgggtcccacccaaaatcgattttaacgttgtaggggtcgaatcgaatgtttatttgacttttgtggactagacttttgtgttcgcaagtgcaggatgggaacacatccctcctgcacgtaaaacggagcgtccttttaacatatgattaattaagtattggctatttttttttcaaaaatggattaatttgattttttaagcaactttcgtatagaaaatttttacaaaaaaacgtaccgtctagtagtttgaaaagcgtgcggacaaaaaacgagggagaggggttgggaacaggcgttgcaaatacagccttaccgaaccaacactacaaatgccctaagcaaacacacgccacattagtacacgagcgcgttttttttatttgtagctttgattttgttttctgtgtacgagaatctatacgataggacatcaagcacacatgagacaaagattatactggttcaggtcccttgcgaggaagccctaatccagtttatatgggattatggagaaaaccatatagattataatagagaacaatggaaccctgagattgccgacgagatccctatcaagaacggctcgacgagatccaccggtgagttggcttcgcgttctcttgattgtttctgctatggtgtgtgtcttgcgctaagattcgatgccatgtgcccctccagggtcctgtatttatatcgtaggttatcttgacctccagtagaactcggagatacctttctacgtatgggatcacaaatcccctatttcttccgaatatgactcttgtcgacgtttgatgtcgcgattccggtatttgtatggtatggggatcgtcggtgctaggatatatgcgagactgaggtaaaagagatatgtacaaggatttttatacaggttcgggcccctgaattgccaggtaatagccctacatcccgttggccgaagccggtcgttgctcttattcatcataatcacaccagtacaatatttggggtagcctatctaattgttgtcgacatggtggtctgaagttctgactcgtagtcgacaacagggtagtcttcctcttcgaatccgtgcccggcgagatcagagatagagctttcgtttctcctgacagtatccggagacaccgtagggaactagctatgcttatccctgaagtcgatatccgacgtcttgtcttggcgtatgttggcttgtatgttgatcttctgtcttgatctattgttccgtgtatgttgattgtggtgggtgtgtccctctcctcctaggaggccttgtatttatacccataggtgtctccttgtccaagtagaactagggaaaccaatatggatacaatccgagtagtccttgtcgtttccatgtagaactctggttgtcttttcttatccggaactccctccatatccgaggtcagtttccgtataagatatggtatgtggtgggtcctaccaagatttagtcaactactattaggtatgtggtatccgtaaccctgacaacactaacatcttttattcggggagacggtttccttgcggatcggctgttttccttagtttggaggtaacattcccgtatacttgaggatataccgtatttgtatatcttacgaccccaaggataggagatatgccttattcgtaaccctgatagtggaggccggtcgaaccggggttttagaactggtcgctttgggttggtccaacagattagaaaacctttttggataaggtgaatagaccgggccctaggccggtcggtccgggcatgcccatggcgctataaccccctcaacaccttcctcctcggcaaggagacactcttggcaatatttttatatttcacttgatctattgtatttactctcatactacttgagcacttctccattcactgttggtttttgagggagagtaagccaagataagtgtattgcaatttcatttctacccctactttgatgtctaatattgattttacccttattttttagggttttcgtttttaccctcaatttttcgaagtgaatgcttgttttgcccctactttggatggtgaagttaacggtgttaagtgattgagaaaatgacatttataccctctcatgtatgtacattaattatgtttttgtccctattttatacacgtagc

SEQ ID NO: 21362 - DNA, 4309 bp, Oryza sativa
  unsure (1)..(4309): unsure at all n locations
aacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtgacctctacgagaagattgtgaaggaggcttgatattagttgtctgtgatgccccagtaataattaggaaaaagaaaaaagagaggaagaaaaaaaaagcaagcagcaaatataatggacgcatagagcaaagctagctagcgtgcagcactagtctggttggcctttgggccttgaccggcccacgcgaggagtagcggtgctatcaacgtatcaggctagcagcaacaggcagccagcaaagcgcaacaagctagctggtcccacatctctagtgaagcttgagatataatactagcttacttatatattaacatcaaaattgaaacttttttaaagcgaggataaaagcacatagtgttacattgtaagtgtgttaacagtgaaatttggtaagcccctaaaagaattatcacatcaccaatagtcagattcctgctatatttggttaagaaaattaatctatcaaagaaagcttatccagaagtgacagagttcaagaaggatgcggcatgacaagttatctattaattagaaataatttattagttttcttttcatctttaggaaagtgtatttaatgtcctataaggacttatatgttttccttttatctttaggaaagtttctttattgtcctacaagtactagtatgtccccataggtataaatatgtacacatggggtcattgtaagagatctccacgatcaatacaattcgggccatcgtcaccttttaccttttctattttattttatcgtccgacgggatttggcacctaacgcggggctgcatcgcttttcgatctccggcgaaggggtaggtcaaatgttccgccggcctagacaattatatcgtctacgttggcgtcgttcaaggctgcatcaatacattcgacctcttggattgctcaggtttggatgatatatttgtctgcctttttatcatatgtcttagttaatctattcttagtatatcaatttagctctatcggttgtctctcgctttagggtttctgccggtatcggctaaattgttttactagattagattagataaggcatctaccaccttaaaaattaattagtcaagggcttgattgtctagatattatgtttcttttcatacttagtgctgcatcagttaagtttgatctactaaaccgtgtttagaaccataatctctagcctgcttcttgactgctaataagggtttcatcggggtttcagccaatgaggtatctagatgttgcatcggcttacaagcattacatacaagttggatttagctaattgcaacaaaggtttcactgtttatccaatcttgtggattttatgacatcagacctctagccgatgtatgctttaatcttcggatcagtgcttattctatcatatcatttctagccgactggtttctactggattatattgtttaattatattgattatcggccgattgtctttatatcattatatacattggacgtatagccgattactcgaaaccctatcgctatcggctggtatcggtatcggctagaactattccatcggcttgtcaaccgatcagctgttttatctattgtttatatatcttgtcggttgcaggatcaaactgactggcacgctcgcatatcatcaagatttggacctgcactggagctaagcagatctcccaggtcagtgtgtatttttagcatcaatagtatggtccaacaaattgagttgcgcctaaatccgcctttagaccctaggcatcacaaccaccttcagctgaaggaataaccgtcctagtgatcgagccttatatgaacaacttcaggtttggcttccaccttacccattccttaactaggggatttggaggtttgacggtttgatcggtgaggttgggctcttgtgtaaaccatttggaaaccggctcccaccttaccgtgagttcttcctgctgtgtagttgaacatccaaaaccctcggtacgcattcactctgtttcgtatattcaatctattcatgttttacgtactgtctagttttagtttacatgtatagattgtatgatacgattatgctagtttacatgttcaatcttatgatttatttatagaataaattaaatcaatatgtatatttttaacaagggtcaccctgactcttcgttggtatttgattagtgttgttccattaatcatgatgtgtactttgccggattccaaaagctgtttaatccatgtgatccaaactgaattaaacccctgtgcgatagtatggtgtagagacattcccagtttaaccatatgcacaattttagggtaaataaacatttgcagtgtatctactgcattacttctatgtgtttattctttctttattcacttttcagggtgctcagattgttggaatggttgcagaagcactgaatgttccagcaactgccaaactatttgattaaggccaatgatgtactgggtatcccccaaccttttattctatcaatgtgatttcacctgtttcagagtacttgttctgccatgttaccaagtttctgtgctctactccaaagttgaaaaaaatagtgatcatgctaatgtttttaaatcaatggaccaaaatttgttggatctttgaatcaatggaccaaaagaaaagcttgattcaattaggtttgttgatgaatctaggggttgtttagattgatgacattttaaaccataccaaattttctaaagttaccaaagatgtgcatacatttagttttgtaccaaatattgctaaatacataaggaatcctgcaaaaacttggcaatattgataacttaccaacattctagcattgccaaaatttgataatgtttattttggctataatctgaacagcccctagttaaacacctctatattttcatcttgcaatttctgctagaagtctagcccacaatttttttgagaattcccagctatgattttatcaacaattgtttgagtgccaagtatgacatatttcagatatggttccggttattgtcagttaaaaaagttgaattcttatggtagaacaatactttttttagccatctatgtatgggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtaccagccttgcagctgtagaagcactgcgtgcacgtgattgagaccaaaatgtaattgactctgtagatgtcgcatgcagtctcagcttatgagaatacactgcacttgcatttgctggtgttttcaggtaattcctttgtcatgttcataaaatcatgcatattttgttttgaaacaataagcacgtgggttccttgcctatcatgggggtgaacatatatacaatggtttgatttgatcgatcttttgttaatacctgtaagatggaattcctaattgaagcatcatactttttcattctgctatgtgccaagtttgtatacttaatcatagttctaaacatgcagggatggtttgaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21363 - DNA, 728 bp, Oryza sativa
  unsure (1)..(728): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttctgagacaacctgtaacatctaccatttggaggtagaaaacaccattcgtgatctgtgatcatatcagacaattcatcaaacaccttgtgggcgatcacagcaacgccgacctaaatctcattaggttaactagattccagtccaacccaaatcatcacattaggatggagaagctccaatcctcgattgctaattgccatcacaaatcattgcataaactaagtttcattaaccaaatgcgagttaagtgaaagaatgtgggaaggaaggaaagaaccatacggtggccttgttgatgaggaagacagcctcattggaggggcggatggtggcgtcctcggcccgcattatctgccgcacccgagccatcgggaagctgccggcgccgtggtcggcaaccgcctccgccgccgccgccttgtccttccgcttcttggcgggcgtgggagagcttgcctggcct

SEQ ID NO: 21364 - DNA, 14186 bp, Oryza sativa
cgacataggcgcggacgcttgctgcttctcgcgcttgggctccttgctgctctccttcttcttcttcttcttcgtgggcgtgggcttctccccttcgccggaaacccggtgcggcttctcgctcttggcccccttgtgcttccgaggtttgggctccggcggctggcgcttcggcttcttggagggcgtccccgcatcggccttcttcttacggttggatcccccttgggggttgaggcgcttgttgttggcgggcggcggcggtggtgcctcctccttggggttggggtttttgcggggtttcggcgtggagcggtccttggaggtggcggtggatttcttaggggtggaagcggaggcggaggcggagggagaggcgggatttgttagggccttcttcttcccggccatgtcttctccggcaccggcaccggcagccgcgaggttcctctggaaggcggcggccggagtccggagagttcaaaattatttggtttgggggcgctgatgctgaaactcaactgattccagtctctgttgggtttttgactcatccggttcacgtatttgcaaatgtcatcctcctggatcatttccatctttttatcattgaagagaaggcttttcccaaatattggggttattgctcgtgtgtcattttttaaatctacggaagccacgtcaccgcagtatgtgtggataatggatcatgagaagcctgattgagaaatgtaaatgaatgaaaaactgagatgaaatgaggtactatctccgtcttaaaaatataagtatttttagctaggaaattatttccctaacccattagtcatgtcttgagtgtaaaattactcatttatcttttttctttctccctgccatacaaagaagaacccaactctcattggaataattaactatttaccactcttacgagtggtgataataaatttgtcaataaaatcgcatgtcatatcattaggttactattttattgatttgtatcatcgagcttgttttattctgtttcaattaaaatgtattgtagtagtaattatttacgtctccacgataaagataagaacgtgcattgcaggtattaaagattctaaccttttctcattaaagaacaaatcactgtatcacgacataattctttttctaacgttcgatcttctttcaacaacttcacttgagtctcaaatttttccagtgcgtactacccttttttttaataactaaacattattgcaatccagattattaagctggattataataagttataataaaataagttattagctgtttgtttctttggattattagagacatatattattggtttcgaaaggctgatgtctctaataccctaagctattgtggagtgggagaaggatgaaatggcggcgatgacgatacggcttggggaagggttcgcgcgcgactagggagagaggaagcggatgcatgcgcggctgggggaggcgccggattcgcctgcactgtggagagaggaagcggatgtactcaatctattgggttcgatggaagtggtgggtaatttgcatacaaattttaagattagtgggtctttagccacctactaatttgaaagaagcacgtttagaggagattatcatattatactaatctagcttatagattattataatgatctacatgattgtttcagattattgctaataattcagattataataattctaagctgaaataaatagggcctaaacaatgtcatataaataaaaaatgtagggagtagttaagttgttaagctagtaagaaaatacaggagtagattgtaagtgttactttagtttttccatatactccgtataaccaattgcatacttacaccaaaacaatacaatatgattcctccgtttcataatgtaagtcattttaacattgcccatattcatatactccctccgtttcatattataagactttctagcattgtccatattcatatagatgttaatgaatctaggcacatatatatatatgtcaataaatctagacatatgctaaaaagtcttactagtataatatgaaacggaggaagtagatgttattgaatccagacatatatatatatatcattaacatctatatgaatatgggcaatactagaatgatttatattatgaaacggagggagtatctattatagagaaggaacaaccacatataattaacatccacgttttatttttttctatatgaccacttgtaatccctggcttgaccaacaacatactacaacaacataggagtacataccaggtcagatttgaattgtcaacgaaacatggcgcgttgcaacgtgtgcgctgacgtgtcgctatcctactggaacacaccacgtcaatgcgaccgactcgtggcccccacatgtcagtgacacgcaggcaggcaggaaggcacgcagccaccggagacaccaatgcacgcagctttccgttgcgagtttgcgacccatctccatctccatccatccccttcccccttccgctgccaacatctcatcggcgattcgattcgggtcaattagggtttactcgagactcgagagaggagagctcgcccgctagggtttcgcgggagatggcgcaggcggtggaggagtggtaccggcagatgcccatcatcacgcgctcctacctcaccgccgccgtcgtcaccaccgtcggctgcaccctcgaggtctctctctctctctctctctctccgcccgcccctctttacatgattctactctctcctcgatctggtgcttgtttgagtgcctgcgctgatggcctaatgccctccttgcctcgcagatcatttcgccctaccacctgtatctgaaccccaagctggtggtgcagcactacgagatctggcgcctcgtcaccaacttcctctacttccgtaagatgggtatgcgcctcttacctttctcttacacttgcaagattgtcagtttacaaacagtatctacttatatttactatttgtgcggatcccaatcgtaatttcaccacgtttgcatagtagtaataagagttctcaatgataattctattattgtattctgagggtatcatttcagaggtgtgaagcatagggatgtgaagttagaacggaagtattgttctgcccatgactcattgatgaaggcttatgcgcctacgtgctacttagagaatgtacagtaaggtataaagcgctagtgccaagagtgctcatgatgaggtggaggagagaaggagctgcccctcatgcaagaggcggcctgtacatgtgctccatcaccaagagagggaataggaagataaccaatagattgatatcaaacaaataaaataaaattggtattgtcctaatcgatgagtagataatgtgggcaaaaatagaggcatcagttacctctactattaaactcgctctttagcgtccttgttggacagcttcaacctgtggtattgattagggataagtgcctttgggctgcattaggagtttaggtgggacctcgtcaaagaacttatcaagtggtatacaatttgcaactctttaattatgatcacaatgtatttcaaactcataatgtgtgaaagctccttatacccacccactcaaggtccttgtttgttttcattgaattaattgtgtctaccctgtattttgttcccctaattgtatgatcctgatgtatagcgcatttagaaaattatatctaacatcttaccacgtctccagttaccattataagttaacagcggatatagatttatgttatcgtgctaatttatgtgtcctcatgtgacaccatggaagtgcttgtatattattagttcgctacacgtgtgttgcgtatgtattgcattataagtagaacatgtaagcgctgttattctagcattattgaataatttttatgcataatttaatccctttactcttattcctgaatccatcttttgttgtttccagatttggactttctgttccacatgttttttcttgcacgatactgcaagcttcttgaggagaactcattcagaggaagaactgctgactttttctacatgctcttgtttggcgctactgtcctgactggcattgttctgattggtgggatgataccttatatttctgagacatttgccagaatcctgttcttgagcaattcattgacatttatgatggtacgagattagtacaagcattatacttggtttttggttttctacaccatcgttaggggtgcaggacaaatcttagggattttctgggctctgaaaatagtcttcttgggtgcatacttagaagttgagttttagtaattcctctcgtatggacctgcaggtttatgtatggagcaagcacaatcccttcattcatatgagcttcttgggtttgttcacctttactgctgcttatttaccttgggtaagtatttttagtttcctttccatgtaccacaacatgactacatgactaatgcacacttgattctcatcttaagttaacttcctagagcctcttcatataatcatttttttcatgcctgaatgttaaatcacacgatttgaaatctgtaattgatttcatatgttttatgcaatagaattatttaaaacctcttcaatttcaatatttttctttgtttgtagagcaaaatatatgtttgattttttcccctattagccaagagcccaaaagcaaaccattttttttcccaacagttgtccatttgtcctaagcattacccaacaaatgcttttctgttggtttgttttgtgatgaatgctctcactatttcacaacatgaagtagtagtaactttatgttttggtgcaagaatggtctatttagtgtgtaaaaacgtcacaggaacttggtgtaaaatgctagacctttcctttaccatggagccaatttgttgttccagtaggtctaggttcatcttaaaaatgaatgctccctccatttcaaattacttgtcgttctagctttgccactagtcaaacatttctatttttcaccatccatttttggaaattcgtgtaggttaacatgcaatatatattatggaagtatttctcatggtgaatctaaaaacataaaccttatgatgttaaactatatgaatttctacaagttgatgttcatataaacatttgatttaggacaaagctagaacggcaagcaatttgaaatgaggggagtacctcactagagtgggaataaatttctgtattcagtactgtgtgataaagtaaaatggggaattagcaaatgtaaatgtgctctctttacagaatgccttttggatttgctaagccttcaacataaactggctgtgacaatgtacgctgaaaaggttttgtcaaccaactcctggacatccttttgcatcgcgcacatatttcattgtcagaatgtattattacaaagtagagaaacagaaactctagtggctctgatcttgtttttgctttgtagtgatccttgattttactttttcacctgatatcacacagatgaaatttcactgaaattgttcaaagtttattcaactttatatcagagatgagaaacagctgcgtgaattgttctcttttaaattgcaggtccttctggggttctctattcttgtgggaagcagtacatgggttgatttgctggtatgtttcttatcgttatgatgaatatcataatagcactgtgattttttagtgtctgtgctgccaatgctgcagttaaagaatgccttgtagaattgcaagctcagtatggtcaacggttatttcttctatcatggttttgtatgaatattgtttgtttcgttttccatgagctacaagcctgtgactggtttttattggtcatcttgctgtccaacttttatttggcattgcttatttgcaagtgtgacataagcctgtgttaaaagcttgttccattgtttttgaatgcctgaacctgggctctattttgcattttctacccagcttgccaatagatgtttctgggttagtgagctataacctgatgtaggtttaactagctacattgagatggtactagctattttcaatggttaaccttggtgttgaagtatggaagctgaaaactttattttcaacatgttagcatatttttaacagaaataagctattggtctttttgctgtctatgtgtgacgatgctggtagacatagcagcatgtattaatggtaacttggtaatggagtgctggctggctcgtgtcttctctgactggtttgtatttgccaatatcatgaacttaaaatggatcttatttgcttgtttgtattaacagagactttttcctcagagataatttatgcctgtgtactctcctgaccatcattttcatgcatctgtatttttttaatgaattattagccatgtccttattcggtatgaatgcctgatgtattgactgaattaaaattgtcaatatgctgttttcttcttggaccatatctgtaattgacaaatattgtttctttcagggtatgattgctgggcatgtgtactacttcctggaagatgtatacccgcggatgactgggaggcgtcccctgaagactccttcgttcatcaaggcgctatttgctgatgacaatgttgttgtggcaaggccacccaatgctgggcttggcgctggagcaaggtttggtgctatgggtgcagacccccaggcccaatgatcaattgccattcgaaggcagttactgattcgagagttcttttttttttttcatctgttcaaattgcgaaattgtacaagcaatgttcccgtgtatttatacaggctatagatcagagaattattgtgcataagaaagcatttagtagtatctggggcagctaaatttcttaactggacacgaagggtgaaggaaatggtttacgagtttcaaccggctggacaatgccgccatccttggttgcagaaactgatcctttttgcgacgattgacatctgaccgggatacttttcaatgtggtagtctattggtaacgataactgtatcaatcgttgtgatgtttgtccttgcgatttatggtatcagaaatgttagaatgttttatatactgtttgggtttgaagaatattggtcgaagatgaccctcgaaatgtacagctatccgtcaaagtatttttttttaaaaaaaaaacatgagtggataaaataagttacgtgcaatgatattcataacaaaatattgcaagtacatgcgagtaatgattcttgcaaattacatagaaagctattaatgtaaaatatcacgtgtacatgataatattgattgctaggagatattagctgttggatatatattacaaaagacaaccactagttaccaaatcgtccccaaatacatttcaccgatttgacttgaatacaacagatcaattttacttgaatgcaacagatcaattcataagcgtgccacagagctgaagtacgataagcagcgcgggttacgcggcgcagtctcgcactgaaagaagtgtttgtgggtatatcatcaactaccccatttgatcaaatcctgtcttaaaacataaatcttgttctaaatataaaatgtttatagccagatggaataataaagagtgaattttacaaaactacatatacatgtacattgatcaaaatatataaaaaaaatacagatttaaaatattatattttaaaattatcacaaaactatatatgtagggcctcatatatttagatgcagtatcaggagatcggtcccttgtgcatcttccccgtcttgacttgctccggttcaattcaaatcacctcgctcgccgtccgtcttcgtggagctttcgaatacgaggcggcgatcgatgcattcccgccaccaacgcctcgcgtcgctgacgaagttgctcacttcccacgtcaacgtcggccgtcaccgggatgctctcgccttcttctcccgcatggtctccgacccctccctcccgccgctctccgacccctccttcgcctacgccttcccgctcgccctcaagtcctcctccgccctccgcctcccctccgccgccgccgccgccgactccctccacgccctcgccgccaagtgtggcttcctctccagtccattcttcgcctccgcgctcgtcgcctcctacggcgcctgcgcctcccccgccctcgcccgccgcctgttcgacgaattgccccaccgcaacgccatcgtctgtagcgccatgatctccgtccacatccgatcgggcgacctcgccggggcgctgcgtgagctcgatctcatggatgtggcgccgaccgcctcctgcttcaactctgtgatcgccgcggttgctgagtccggggaacatccggcccgggccatcgatctctaccgacggatgcagagaatgggcgttctcccgagcctcattactctgctggcgctcgtcccctcgtgcacggcgctgggtgcgttgagctcaatcaaggaggttcacggttttgctacgcggcacggcatgtttgcgagctgccacctaggaagctccctcattgaagcatacgggcgatgtggttctctggctggcgcacggaacgtgtttgaccaggtgcaggagcgcgatgtggttgtctggagctctattgtatcagcatatgcattccatggccacgcagatgttgcaatgtcgcttttcaggcatatggagctggacaatgtccggcctgatggcataatgttccttggcgtattaaaggcttgcggccatgctggtcacgcagatgatgcattgaagtatttcgatgttctaaccaaaatatttggggtcgaggcctgtggagatcactattcatgcttggttgatgtcttgggccgggcaggaagactacgccaagcttatgatgttatacagacaatgccagttaaggttactgcgaaagcctggggtgctcttcttgctgcttgcaggaaatatggggaggtggggttggcagaggttgcagggagagcattgtttgagattgaaccggagaatgcaggtaactttgtttcacttgcgaacatctattcaggcatgggtatgcatgacaaggcagaacaggtgagaagggagatggagcagcgaggtgtgcggagattgcctggaagcagttggatgatacattgcaagtcaaggtgctagcatcatttccaatgaattccttttgcaatgcccagttgcctatatgaccattacagctttattatcacccaaagcatgaattaactgactgttctgtttgctgcagtgaactgttctgaaaggggaaacacactttgagaactgcatcacagactcacaagaaaattttatcaagatattcaaatcgtttcgtatccatgaaaggtatctgagacatgccactatgtagaacacattttacttgggtcaggttcctaactctatttatcacaattgtgtcatatttaaatcaaaactaactgcaaaatagcaaaagtaacagaaacatagtgttgggtgaatgttaactgtacatccagcagaacatcaaatttccccatggtaatgttgggaagtcaggaatttgtgctgacagctatggttttgtttggaaaatatcatttgcattaacaaaggaaaaatcacacgccctttcctgtggccctgttctttaatttcacttgctttaagattgcgttacaattagtttacatgttctttacatttcagttaagccactcattaaaagatcactaaggttactgcttctatttttcctctaaattttttgtgcttgtttattgtgaagttagattgatatgatttggccagtttctggacttctgaactacctttttagccttttaagggcccttcccctagttatttcttttcctggttcatatgatgcttactttaatgcacctttacaaaaagcatgtctcattagaaaattgcactaagcaagatccttaatatctttcatgtattctttttctccatctcatctagtgatcaaaaaatattattttataaaggtgtcagcccctgttatgcttccattagatcagtcggtacagtgccttgggcttgaaaatatcaagtccttattttgcacgagtagtgtgagttcattaatactatgcattagagatgttattcctcagctaaacttcgtgcaaatctaaatatccattttcagtatgtctgtaataaacaatttcaccatatattattaccgcattttgttttggcggagggaaatcagttgtttccagtctctaccctgaaagcttgacaagagttagtatgatcaatcacttatagcaaaatgttttttgtctttttacataatcagacaaagtgaatacaaatattgaagagcatctagataaattgcaaagttccaatagttggaactgattaccgtcaggttacttcagttgaggcgtacaaatgatggatgagtacagctaagttttgcagttacattataaatatgaagtttatccatgattgtaattttgtagaatggattatgtactactcactgtgtcgtgtaacatttgggatctgacgcctgatttaccagaccatgactgatggtgagcagtacagttttcttgtgtgttctgtaataatatggaagagcacttacctaaagtcttaccggagaggtccctctcaaatagcttcgttgtagccttgtaggtgggttaggagcctagggtgcatcactattgctagtggtgctaggtcccagtacagtggcatattggctggatgatgtggaagtaattctataaacctaatttatccaacatgtattgttcaacttctgcactagagagcctaaaattgtgatgctgctaactgctaagggtatttagctacccacacgattatattatgtttccttcatgaattggagcagaatctgtaaatcatatatgtatctgctatagctacccacacaattttcttccaccgtacacattttctgtctgatactaatttcatagacctctcgatacatcgtgcttgttttgatcactaaatttgcttgttcccatcagtatctttttctgtaccaaattcctcgatctgcttctacaaacatgtggtgagtgtatgttccagattcgatatactaggccacgaaccattgaagaaaaaccaggaagcgagcccaccaatgtgcataacaatttttccgacaggatgtagtgcgatcattaaagttgtttatctctgttattatttatgcatgtgggaacctccaagtgggaaacaggtgaattggattgctcatgcagctcaactgatgccaaagttgaacctagctagctaacatattagtaactattggttgaattgaaaacatgcttgacacaccgttttggataggaaagactggacctaagaactagttgccttgtgctgatctatttgctaactacggatttatttatgattacaattcttttgctcccggcggtttgcttcttgtgtagaattgtaaagctgttgggtcattctaatgtgttgcagtgtcctattatgactgaaaaaaacttgttcatggcacttggtacaccatagagtgaagtttcccttatttaggctagcttccaggcttaatacagttatggtcagcagtcacattttttttgacatcacaagagcagccacattttcctgataagttgacatgtgtggcatccgtacacaagtgtggatttcgtccaggatactcaatctgttggcactttatctattgaaaagcatatagtattcaaaaggtgaatgatgaagaacacttagataaagtgatgcatgttcatctcctatgtgctcttgcatagtaggttcatgttgtatgtcaatctttttgagcccactttctgattcctctttactcggttaaagctgtaaactctgagtctcagtaattttttttccttagaaaatccgcatggagtgtttcattgccaacctgctgccctgctaggctgatatgtttttgtccttctgaagctgaaacatttcagtacatcagtaaatcatttcatcatcctttgcctaataaacatttgcttgtgaacatacctgtagtttttgtccgaagtgaaattcattaccttttctcccaccctataaagctatgtgttcatataatttaaacagcttctttttcttggaaaagacaggcagtgagatcagcatcaagcactaccagcgggcaccagcagatgcatgtgggccacagcactagccagtaccacggatggttccgtcttcctggccgtgcaagccagtccacttctcatcatcctctgtccgtgcaaggtgccctggctgcaagtataaatacccagtctccttaccttgcaagtctgggctcttaaccaaatgagcaggagccaactgatgcatatgtataagcttggagatctgacgcctgctccatccatgacgattccaatggcacattcctcaaggccaactctgggttttcccctagggacggcgctcctgatctttgttatcttctccctcagtggcatcttctcatgttgctaccactgggacaagctccgtgccttcctctggtctcggcatcctgatgtgatactccaagaaggccagcacaccgtcatctccattgcgtctccgagcaagacaacatctgatcacaaggtactacagtactaacgatccctattcatatcttactttgatcttaacctgaaatgatcgtttcttgtagacttacagaaatctaagaatgatccccatgtattgttgtttgcagaacgagaaagcagagaaagagtgtggtttgcccgttattatgcctggggacaggatccccaaattcttcgccaggccgtgcccgcatgagaagtgtttgcctgcagcagaggaggaggaagctgaggtgcaagtcaaatgttctgttccacaatctagttagtagctgtaaatgaagccatacagagtgggtgtatataagcttttattagaacctctaaaaaaaattccatttcctctttggtcctatgaaaatattcaatttcttcattgggtatctttatctttggagttagaaaagtaaggattatttcattctcgcaaactttatgaattcatggcatatattctgaccagacccaaatctatgagctcaagactaaaccagaaaaggtcgataaaataatggatggagaccatattctttctgggtcttatgaaaactgttgtcgatcttcaagcccatcccaggtgtggcactgatgcataccagctactggtggcatttggctattctgaagtatgaaccaggtaaacaaaaaaggctattatcactccattgttcaacgatgagaattggtgaaaacataagaggtctgaattataccatttactactagtatacataatttcagaattctgacgaacgtaacaggacattttcatatatattttttgcctggtcggccgatgagacgatcaatttcattaaagacattttcattttacgttctgatttttcttcccccatggaccatggtcgtcgttgtattatgtccggagaacgatttactttggtgtgattgatcataggaaattaagctgctgctattactcatgagctagagatgagttaacatgtaattaggtgatcttttgtttgtgtaattaacgcgtacgatgtgggccatattagcgatcgatggtgcgtatcgtgggtggaggcaatttggatggggttttgctgttgcaatgcgtgctgatggttgcccactttgctggactgcaatccgtgtgcagaccgtgtacgatgcatatggtattttgccgtgggttttgcatgcactttcttttgctagagccagtgccgtgcacataattaagtgggatatatataagtatgattgtatgcatggcacataattatggatgttgctggaaatctgaaacgagatcgcgatggcaaattggcagtgtcatacagtaaattaaacaatccaattaagactgtatctgtatatatgtgtagtatggtagctgattaattattttctcatcgtccatgaaaatgaaatagggcccaccctgaaattttaaattaacctgaaac

SEQ ID NO: 21365 - DNA, 3599 bp, Oryza sativa
  unsure (1)..(3599): unsure at all n locations
atcacacgatcgaattttgcgtttagtgttgagaaacatccacgagtcttccggctagctccacgagatggtggactagatgacctggattcgaagcttcaccccttctacttatttgatattatatcattctctaatattcgtgtcttttttattttgcgtttagtgctaaaaaatcaatcagttgcaattggacggtatagacggggagggggacagcgacctaacattcttggttatctgcgcatgatcgattaatcgatcgatgttcgatggatatctatgtgcgcttgcttttcggctttgagggcatgaagatagaagtaggtaaagtgcaagtactacgtagtaggccaggccagcaaggtcgtgcgtgtatatatactcctatacatgacagccattgattaattcagcggcagtatgcatgcttgatggtgaaacgtacgctaatgcatcgtacgtacatgtacggcggcttagcagctggctatcgtcatttgcaagactctaattagcgatcgatcgggacgtgatcctttaacttactattctctgattttgagaggttaatatacggatccaatagttaatggattcacatatatcagagattcacgtcaaaaggcagtacacgagaggagctctttccgtatcgatctaggtggacatatgatcccataagctgataggcatgccaattaacgtttacgtataggcttggcattaatagccttggctatgcctatgctttgcataatagagtgagtacttactattacttgctacaggaacaccacggcacagtattatttttgggcctccagccctccaccgtgccaccgtggccgacggatgaaactccaattaggcccacaaacataggcccatttataataggctaatcagcccattaaaagtactttttcttacatgggccgaacctaacggcaaggaaggcccaggcccatctgagggcgagcggtgaggagagatgccgcgtcacctcccctcccgcccccgtcaccggcgacattattactactccggtcgaggccaacggcggcggcgccactgtccctctccctctagctccgccctccaatcccccgccacccaccgatgataccccgtctacaccgtgccattgcccgccgatcactgctaacctccaccgccctcctccccgccgtnnnnnncaccgcgatgcgccgctgccctccgcccccggcctcccccgtctgctccaccacgcgccgggggcgtccgatcaagcccggaaatcaggtaatcgccctcccgcgtgatccgatcccctaccgctccgcctcttcctgatcactctcactggcaaaagtgcctgtacgccgtagcatcttaagattttttcctcttttttttccccgtaagcaagctgccgatcattttatctgatggatgtaattccacatcacgctaccgttcgcgatccataatttcgttttttcgtctgaaatccaaccgcatatgtgacttttcttcttaattttggttttctcataccctttgtgttctatctgaaggtcctcttacgctctacagggatctggtgagccaagggaaactccaacatgacatctaccaggaaaatgtagcaactcagctggacaacttacttagacgacttgagcaatacgagatggaaatggaggattaccatgtaagctgcatgtgccttgtgttcactactactagttactagtagtacctttttcacatttttttcaataatattatttctgcataaagtgcaggcaagactctctatgtgggaaaatacccgggagaaacaaaggcgaaggcttcttgttcaagaagctgaggataaacagcgtgatggggtgtggatagatgagaaaagggggtttcttgacaagttagtgtcaaggtgatattttttcttctaactgaaatctacccattgttccccatgtggtattttcactaagtcattcttgaaattagatgaagttccactatcccttttatttatctatagacttctcttctgacttctgactaccaactccttcaataacagtagcactaaaatgacgataaacaagtatcatgtacaatacatgcactgaacttctgacttctgactaccaactccttcaataacactagcactaaaatgacgataaaacaagtatcatgtacaatacatgcactgaactttgcttgcgaaaccaagaacaatgtaactaaacagattgttcaacttgttgcatggtgttatttgacttttcgtttggtgattaattccaggaaaagaagaggaaatatagaacctggagttgggaaatgggtctcatatttgaaccgagaaaagaaactggataccttggttggccagaagcctgttgcacccattgctccgaaaggaatatatctttacggcaatgttggaagtggtaaactaatcaataacttcattataatagttttttgatcccatcattcttctaatatcctaacatggcctgcatatgaataactaattctttctcctggttcatatttttaatcaaacactcattatttatcatttatcgtgttaatgttgtccttttggcaacataggaaagacaatgctgatggacatgttctatggggccacagaaggtcttatcaagcacaggaggagattccactttcacgaggtaattagtttagaactatgcatggtagtgcctgttcattcattggaatgaacgcgcaactattatatttgaagaacaattgttaagaagaaaaatctgatctgttgttcatcgagcagtgtgcatgtccaactgaactcaagttcctagctgcactttgtgtgctaggtggctaggaatagcagaattctgtgaactaacttgttgaatggttaccaacatattcagttggtgttctgttgtttagcatttttctgaatagtgttgagttcctttttatgcaggctatgcttgaaatacatgatcatatgcatgatgtatggaagagacgtgatgaggacaagtctattgagtcgagtgctttcagttggatatcaagcctcccttttgatgggaaaattaaggagtggctaattggggaagagaagtacaaacaaaatacacaacaaaaccatatccttttagctgtcgctgacaaatttcttgttgatagacaagcaaataagagtggagcaagcattctatgctttgacgagatacaggtacatgaactttgatattttgaatattcaagtcattttcctgtatgttattatttctaaaaacgagaattggcattcctgccacagataggatcttgtttaccagattactcctaggttagcaatctgttgcaattacataaaaggagtaaagaataatcttgttgaatatttcttgtgaaatctaattttgcttatcttggctgtctcttcactaaatcttttactttacatagtgtatgttatatagcacgtgtgctatatagcatctacataatcacaagtatatggaaaaataattgatcgagtgtcagttattgttaatggtggtaaataagattgtctagtaaag

SEQ ID NO: 21366 - DNA, 11928 bp, Oryza sativa
ttccattgttaatgtaataatttctggtatccatagtatttttttaatacactgggaaacttcatctatgcagacaatcgatgtatttgccgttgtagctctgtctggtattctcagcagattgttaagcacaggaactgtgcttgtttcgaccagtaataaagcacctgaagatctgaatcaggcaagtcgttttttatgatttttttctacttttttatcaaatacttcatattctggcccaaaaaaaactttaacctggggatgaacttcagtaggtgttttcaactttactcctagagatcagaacaacttgtcacatatataagatgatggaaagagtatctcaagtagcaatcttggatttttagaggagctaaactagaattgtccaactaagccaagaggtgcagacactaaataattcctgtaatgcatctttgtttcttctagttaatgatgaatttagcagttaaatttcatcaaagtatcattccatggcttaaactactactacctatttatacatgaatatcttcttgtgatctaactgttttcaaggcacaacattcatctactagaaattacaaggtgctgacttgaagttaaaacaatggtgtgcttccctttcaccttttgtttttctcttggttttgtaggatgggatgcagcgggaaattttccttgacttattgtctaagttggacgagaactgcaacaaaattcttgttggaaccgaaacagattatcgccgcctaattccaactgacggcttaactcaggttaacctctacctgtttgtagcaataggagatttatgacacttgtctgcataaaatgatacacctctagttttcatgtgctagagactaaaataagtagtttatatgttatcttatcacttccttgcacactttttagattttttagaaataattttgtgctgataagctgggggtgagcagatcacatgatcagtacctcaattttagtttgcaaaatcttctagttgactgttgacattcttttaagaacttttggtttgtattacggtggccattggacttcatcatattgtaggacactaggacttcgctctcttgccattcagtgcaatgtctttttcttttttttttttttttgaatctcagtgcaatgtattggtaaatggtaagatagcactgctttgcttcagtaacctgagtttgataattcaccaatcatgtattcatctcttggtgactatggcatgagttatcatgtatgttgcaagcatggaacttcaatctacttttgcaaatctcgcggtataccataaaactacctttttgtgggtcctataactaaaactatcttgtactgtaggactccataaaatgcaatgcaattgttaggtgtatccttttctataactggattgtatcttcacaataagttcatcttcatgtaacaactaatggttctccatcttatctacagattcactacttttggcctctcacttctgacattcggagtatgtatgaggctatgtggcacgatataactagacaaacaggaggaaacattatttctgtcaccattccagtaatgtttgggaggtgcgcacatagcataaagcatctctatactgttgaaaatgaactgaatttaacattgatattatgaataggtatcttgagattcctaaaagttgcaatggagtggcaaggtttgacttcgagtatctgtgtggccgcccagtaatatcttgtcttcttaatttacatttatttagtatgcaagtagatgaggggaactaattggttcatgatcaggcacttgtggcttgacaaaaaaatgtttagtatccatcctttaaaccgtctaaacttggaactgaattctattgttatatacaggagtatttgttattttgagctgggatcatgtgatatattgcagctcattatataatccactgtttattttaattatcaggttggagctgcagactatatagcaatagccaggaactaccatacaattttcatatcggatattccagctatgagtatgaagattcgtgacaaagtatttcttcttctatctccttttctgattcttttagtttgctaaaatctacttaattgtgcttccggagtgtgaatactgaattgaatataaaacattggaagatggaagagatcttataattcaaaagtgtcaacacatgaaaactgagaggaaataattcgtcaagacaagagaaatggaaactatcttagtatatctcatggtttcaagctccattttttttattttctagaatcatttggattcgtgtggtgtctgtactatttaaacatggtgatgacattgagaagttaacaattataccagatgcttgtgttttctgtgtttattttgatgctgaatgaacttcttggtctcattcaggcaagaagatttatcacccttattgatgagctctacaatcatcactgccgtcttgtatgtctagctgcctcatccattgatgatctttttcaaggaactgatgaaggacctctttttgacttggagaggtaatatttgcatttatactttgttgtacatggtgcttccagctgtctgcaatatttcgcattacagaagtttttaatttgcaacataattcagagtgatttttgacatgggaggtcatgttatgcagttttcagttcgaaggtgaagctgaaggggcaaagcttaggagggatgttttagcagaaggtaatgttggtgcagcgccttctcctacaggcctagtggcaattttgtctggccaagaagagatgtttgcattccgtagggcggtaagtaaatagcatttttactttctgattgtagctacttgcttgagttcaaacgcactagtgaagtatcattagcactggggagttgaatttcgttcagaacttaccttattatccagtttactgaatataagctcacagtaactccttctcacagtaactccttagaaggtacactcgttaagcaatatctgcattctaaatgcatgaaaataacacatgctccctacgtttcaggttataagatgttttgacttttgttaaagtcaaactgcttcaagtttgactaagtttatagacaaatatagtaatatttacattaccaaattagttttattaaattaataattaaatatatatttataataaatttatctgggtcgaaaatattactattttttttctataaacttggtcaaacttgaagcagtttgactttgaccaaaatcaaaacatcttataacctaaaatggagggagtataagggcctgtttactttgatgccattttcaaccataaattttttttggtaaagttgccaaaaaaatgtcaacgtttagtttgttgctaaatttggcaaatcataagaaatcctgccaaaattttgacaatattatcatcttgctaaaattttggcattgctaaaatttggtaaggtttattttggctacaatctgaacaaaccctaagatatgagcactgtccatgagtcatgactttgtctggacctatatttctttccaaaatttctggacatgtttgtattcaatttctaacccgtgttttcatgtcggcggtacaccatgtttgagttagatactgtcatcattcttctttgaattaataactgcaatgttcatctgtttcacagatatcccgtctcatagaaatgcagacctcactgtatctggagcgcgtcgagcgtgtgcactcatccctccaacagcagagttcggttcttacaaagagcagcactgtttcgcagtctgctccgtccgtttgacagacgagacccttatagtaccattatttcatttcttatcgtggaaaaaattgtcgaaagcactaataagattggagaacctacttgccgtctgtacaatgcactgaaccgtacaaaacataagtgattcgagcaattgcgtcgcacatattcttatgacttcctaattcctatccaattatgctcaaggtttttttgttgatatggttatgctcgtcgactggatacctggtcagtgatgacgggagattagaaggaagatgacagggttggtgttataagtattacatgattcttaagacaatcttagccaaccaaagtaacttccagcgaaaaaaaaaataaaatatcaatcgaaaacattccatgttcatacaaaatccatgatgcgttccacgatccacatgatgtgttctagaatgaatgatccagaccatttataaatcacaatgcttagcaatagccctgtaatgttggtataaaccatatcggatcctgatgatcactgtacctatctccataaaacaatgcaagcacgtcttgcatagcagtatagcacaatatcttagagatggcgttacgacggaacatgccgaacgattcgatattgggtagggtggaggctggcggcaactcgatccaatcatcggtgcaagggttgatgagctccgtattgcaattgtagtaatctttttcgaaaagatcgtattgctttattgtaagttcggtgtacaggacggcagcggcttcggcgacaactggagcatggaggagaagccaacggaacatttctgtgtttgctacattagtgtattggatttccatgcttaattttgggaagcatacgttcagatatactccctccgccgcctctaaatacttgatgccgttgacttttttaaacacatttgaccgttcgtcttatttaaaaacttttgtgaaatatataaaactatatgtatacataaaagtatctttaacaatgaatcaaatgatatgaaaagaattaataattacttaaattatttgaataagacgaacgatcaaacatgtttaaaaaaatcaacgacgtcaaatatttagggacggagagagtatatatcacggaaattagagcaatacttcagcggaatctgtaatcaacaagcatgatttcccctgttacagcatcaggcctctacagtttgtacttataaatttgccttcagtcagtgtactcctgcatattttctctctgtgattgttacagcgtacaacatgacgcgaatcatcacgcgaaacaaaaggtatttcaaacgcaatgccaaggtcacagcagacagcaagtgaatccccccaaaacctcaggatcgtgtatcgatttcgatattatcgatcagcctgacctttccaaaccacgccgcaacgcaaatgaccacagggccgtcgatctgttctacagggaccaaactttcttgctccacgatctgcattgcaatcagaaactcgttcagcagtatgccagtatgttgttcacttgtgctagatcatagaaaagataatgtactgaattttgccgtctcatatgctacaagatattgcaagtgctagattccaaaggctctctagaagaaagccagcatcaacaaagtaacgggaggctctaagaacagaagccagtagcaattaaacaacaaagagaggccttccacattacctcaacatagtcaacctgaccgccagtttcagttagtgtctgtactattttgtttttgatttgtttgcaatcagtgtttcccttcaaggcgccagttctagcatcaaccagtgatctactgatggataatgcctacaaaagaaataatacaaccattggcaaagttcatggtgagctagcgaaaaaaaaaaggttctttctgcagttctgcaaggtagttataaatacagcaaaactcaattgaaacaagaggcagatatgacacctcgaaactgtgcaactggcgaatactcaaaagaaaattgtgcatttacaaactatcatcatcttgctggttatttgtaatacacaaggaatactgtaactgaatcacacaaagcaaacttttgttgcggaagctgtttctgaaatacagtgaaagagagacaaaccttttccctctcctcgcgtgataggtgcacattccgggagctcatggcaagaccatcagcttctcgcacaatttctgatcctattatctctatggcaaaatcaagatcacgaacctggaaacagcatgagcataataatcaactaacattagcaagtgaaagatactctgaaccaacaaagattacaggttctcctggaaaagaaaaactacaggttaaaaatgttactgaagcatcaaaacgggaacaaaacaagttatacctttggagcatcaattgaaaatacacattatggcaatgaaatgaaagcaaatcccgttctctaaatagttgtagctaagcataccaagttggcccatgaaacgaatcactaactagtaactacaagaagaggtgcaatcatgaaaaccaattatcttgcaccaaaaagttgaggggtaaaaaggatttttttttcttccttttaaccacatgcctcatcttttcgtttatgcttatttttatccgccaaaatttaaatttcaactttaaatttatagttgattttggaggtttttcatcgaagtttatttttcagtatttgcttttagatcgctaagaacacgtatataaaagttttattcacaaattatttttagtttgcaaataagctgtttcgattattccccgaataagcgaaccagtgggtccgctagactagactaatttttacttcaggcttcttatcgatgaagccaaaattcagtcttgtctgttatcattgaagatatcctactttgttcataaagctgtccttttgttcctaactcgctatatgtacccgtaaacacgcagccttagaacttggtagtgtactagaacaaagcaatgcgtaaaaacttactgcacatatgtaaaatggaaagataaaaaagagaagaaattggcagattttgttaccatacggcagatgacgcgccactgctgataatccttcttcccgaacacagcaacatccggctcgatgatgttaaacagcttggagactatggtggccacgcctcggaagaacacgggacggctggccccgcacatccccttctccaatcgctccacccgaacccacgtctcgtgcccatccccggccgcctcctccaggcaggagatcgcgcctccggaggcggcgccgcggcgaccggcgccacggacgtagaggtcaggggggttgaagacggcatccacgacgccggtggaggcgagcttgcggaggtcaccggcgaagtcggaagggtaggtggcgaggtcctctgagggcgcgaactggctggggttgacgtagatggtgacgacgatggcgacgggatcagcggaggcggcggcggcggcggcggagatgagggagaggtggccttggtggaggtagcccatggtgggtacgaccgcgacggtcttgccctcggcgcggcggcggcgcgaccatgcgcgcatcgccgccttgtcgcggatcacctccggctcgcgcggcgccgccatggtcgtccaatcgataagaggtgaggaggaatcggacagaagtggacagggagaaactgggacaaattgagactttgacagctttagtctaatacgatgtactactacatgggagggaaaagatggaaccttttaaaaatcagagccaacggagaagatgccatctcgtacgcaagaagatttttaaatactcgcaagatcaaattcttttatcaatgaaatcatggagaagagttcatatgtcaaaagggacaaactgcaaattgcaatcacgccactcattccgtcgaacaacctgcgtgcatgcccgacgcggccagccttcccacaatcacaccatgcaccgctggatccgtgaagaggcgcgcccccccaaaacaactgggggatcacagggaacagcgcctccacgcacccggagccagccgcgctacccccaccgccatcgccatggaagccggcgatggtattggcggtggcgtgtcgacggcatcccggtaatggccgtagagtagtagagttgaaggatacaattaaaaacgcccccgaataagggattgagatcctccgacgtaacttccctctgacttggtggctaacatgtgagcccgaaaatagtaggaccatgtgagcccgaaagtagtaggacccatatgtcagttacggtgaacagtaacgtcataggatctcaatccccaaataggatagctatactatttcagttggaagcatccctactcaatttgaatctgttttttggaattaaggctgtgtttagattcagaggtgtaaagttttgacgtgtcacatcggatatacggagacacgtttgaagtattaaatatagattaataacaaaactaattacagaatccgcatgtaaattgcgacacgaatttattaagcctaattaatccgccattagcaaatgtttactgtagcaccatattgccagatcatggaacaattatgcttaaaagattcgtctcgtaatttacacgtaatctatataattagttatttttttcgtttatatttaatactacatatatatatatatgtccaaatattcgatgtgacagttaccaaggcatctaaacaaggcctaaaagtccaacattttgacggatccaaatccaatgagagatgtcaaattcagacataaacagttaaacactgaaatgaaatttacttttcttccttattcattaaacaaaactctggaaggatgaatagaatagcaatccaatctcaccttaaccttgctcccaagtgaaataaaaaataatctagtgcactcttcgatacatacagaagcatacaggtactcatttgcggatgaacaggagcatatgcagagcagaaatgcagcatttgtctctgaattgagagagaggagtgtggctggcctggcctggcctggcctcgattgtttcattctatacgaaggcgtgcttctcgagcagcttgaggacttcctcctggttgttgagtttcgccacgtcgatggccgtcttcccgtccaggttctgcaccgtcctgcacattgcataaccaaaccgggttagtttcagtcagatgtccattgatggatggcatgggcatatgcatgcagaattgcagatgcgatggacttacacggcggcgccgtggtcgagcaggagggcgacgcagtccttgcggccgtagccggcggcgtagtgcagcgccgtgttcttgttcttgtccaccgcgtccacggccgcgccggcctccaggagaacctgcgcgcatttcagctgcgcaaacacaagcaacgaatcgatcagataactgaacaagatgttcactgagaactgcatgcatgatgcttacctcgccatagccgcaagcgaaatgcaggcctctcctcccttccgaatcctcctcgtccttgtccacgccttcctccaatgctttcttcaggccctgaacgatgccaatgcgtgttgaagatgaaggaaaagatgcagattttacttgagcaaatgcgcataattagtactccctctgatttcagattataaaacgttttaaatttaatcaaagtgaaacagctttagatttaaacaagtttatagaaaaaaataataacattttcaatcctaaacaaatttattatgagaatatattcaattattgattttgtattgtaaatattactctataaataatcaagaaaaaaactaatttagtattataaatattactatatttgtctataatttagttaaatttaaaatggtttgattttgaccatcttgtcttgaaaaggagagagtaggcagtaatagaagtgagaattgatttagagacctcgacatcgccgacgctggcagtgtggtggatgacggactcgtcctcgtactcgccctcctccccgccctcttcctccgcctcctcgtgctcgccgccggccgccgccgcgccctcgcccgacgggccgacgcccatcgccctcccgaacttctgcagcgcttcagggtcgttccaatacctgaaggaagcaacaagtattgccattgctcatttgctttcgagatcgacgacgacgacgacgatgaactcaaccagccatggcgccaattgcaactatgcttacttcatcatggcggcggggccgccgttctcgatctcgtcgaggatgggcttgagggaggggtcgtccttcatgcgggcgatgcgggcctcgagctgctccttgtgggcggggttggtgaggccgccaagcatggacgacatggccgggtcctgcatcagcgcgctgcccagccgctccgccatcgccacgaactgcgggttctgcatcagctgctgcatcgtcgacacgtacttgctcgggtccagcgccggcgccgccgccgccgcagcctcctgcgccgccccccgcgccggcggcgactgcaccgtcttctgcagctgctccgccatctccgtgaacgccgggtccttggcgatctgctccgccatctcctttatgctcggatcctgctccaaacaaacaaattaccatgcagattattcatatctaattattttttctgctcatcatttcatcaatggactcactaattattactagtaattgcatgaactgtataattaatcaatccagcttccatctcagctaataagcaacaacacctggttggttatatagtgagttgcttaattaactcaatcttgaacaggtagctgctaattaattaattatcggataacttaggttcaagaggagattatacccaaaatatagttgaggaaattacgctgaaacgagtaggcaattagtgaaataagtcggcagcgaggtaagcttacattgagcaagttcatcatggttgagaagtcgaaggggttggccggcggcacacccctgcgcggcggcggagctgcagcttgaggtggctgctcctccgccgccgacgaggcctcctccgacttgacgctcgtcttctcttctgcgcacacaattactcatgtcgtctcttatcagtatcagaaagaattgagccggagcaaatcaaacaagaaagaaagaattgaagaaataaacagcaaatcagttcttttgaccttgagaagccatgtcgtgtggaggagggcagtgttcttggttcaggcagtggcgttgttgttagtggtggtgatgatgataaggtggaggagtatttgagaggagaggatgcgagtgagtgagtgcgaccaaccagaggcttggtttcccggtgtatttttcgcctgccggtttatatagccagggacacagacaccgcacatcgatcaaacgcttaacttaattgggtgactgcaatttgtacacatcgattactctctcctgcaaattagtgtttcttgtgactacaaacagcagtggcaaatacagtattgctctagtttttcttttaaagaaaaaaatgttgttgcataaatacatagtttcagttatcttgttaatcagtcccaagtattgacccggcaaaaatcagtctaagtattgcattgatgagatgtatttaagtgtttagttgatagtgattatgtgtaagacagtaggtagttgatggttaagttgttctagaattttcattcattccgtagggtgtggtgcatagtatcttgagagcaactttgttagtagattggtgggggagagaggtgccatgcttgcatgccatgcaaggtcgaaagaaagcatggagaatccaggagagataggtgtcagatagggatgtcgataacaaatgtgtggatggaattgcttctcttacaaatgcattggttgctaatgcgacaagatttggtttctgtccagtgacaagtacatcttgcatgtcccaaatcagattattgtgatttcacttaaattcagtcaatttgaaagagctttcaatgggtgtgttttctttgtgaaaattaactcaaaatatt

SEQ ID NO: 21367 - DNA, 26998 bp, Oryza sativa
agaccatgactggtttataagagctgactgagactcgctgctctcttgtttccaaccgagtgtatgaacttcagtctgcctaagcctaacgtcaaacaaccgaagctgcctgcctggtgccctgtaagggaaacaagaaagaaacgcacatacaaggtttcagaaatgcagcacaagcatcaaaaggacatacaggaaatgactcgacataagaacatgataattacatgatttcagttgatagatttgactaaaacaggagcttgagctctaactggaatgctaggactatcacatgctagtttatcagcatttttacttccgctgatatgtaaaacgaaacccaaccaaccagtaacacagaaatagcatttgagtttttacttacgctgtttgcaccatgtacaagttgaaatcacatggatttggtaatacactcatgcatttgtaatcaattaggttcttggactctgtccttccagctgccagatcaaatgatataatcctcttgtcactgccaactgataatattgtacttttctgctgtaatccagcaacacccatgacagcagaagaatgcaaatccttgtgcactttcttgtggttccatgaatcatctttttcttgccaaagtatgacagcatggtcacttccaccagtcacaaagcatacatcagaccatggcatgaaatttatgttgttaataattcccttggtatgaggcttcactggtagaaaactaactttcttctgtttcaggggattagttaaagaaacaccttttagtaatgatccaatacacacagtcatgtgttactcttaagaaaaaggtaccctaaaaacaattatgatggattcctcagtatttcaaattgacatgaacacattacagtagcccttgatgcatccttgcccgggggaaatagcacaagatagtcaaatgatttatgacttttgtgtgatcatttagaaagatttaatgtgatgctactgttaatacaatgaagaaagtatcagcagccaatcatgataggatcaagcaccaaaaacagtacaaatttagctggcaataagttgcatgttaagaggtgaagctctgagcatgattacatgaataacttaaaagactacctctctagttcctatcgtgtgataacctggtttaagatgattagacgttcagaatcaaatttgcagatagaatgccaccaggaaaatcattcaggtgtcattatattttttttatcagtttgcacattcaagttaagctaaactgatagtacttcatgcaactatactgtcggtggaaccaatttagttggattataacaactaatgacttttctcgtcgcatggagaaaaccttgcaatgggatgtgaagaagtgagctacttctagcggagttcttacttgtcctgataagttgcgattcatcactgaaacttgagagtcgccgttatcagcactgtacacagcaaaaattaattcaccatgtggatgccaagctacatcttcaggccacctatgcttaggagaaaagcaatctgttgtgctgagcaaggagatgacgggtctgcaagtaaaatatatgtgattgtaaaatcatgcttaaaaccaaatggacaaaaaaatgtggttatggtaggattatcactatagtttctacatcaatttctagttttatatctccacataagagtttttttttgctacatgtccaatgagattcaggaagcaagaagtcatttagtgccaacagtagtgtatgaagtcatgacttcaatgtccatacgccacaccatgtttaagttaggtattataatttgcttaaattcataagccaactgtttgggggatttggtcatatcagtgttaaaaatgtcacttggtagaagtgttggcatattcttttacagccacttactgtgttgcaattacaggttttccatcgaaccagagagtttttcttatgttgcttaagttgctgtgtttaacatctcagcattgtgaagttgcatcaggcaaggcaatgcaaaaaaaaaaaaaaaggaaaagtgagaggatttaccaattaacttggcttttgtgtgaggtaacaaaaatatgtaagtgctaaggtgggtttttaaatatgatttcacaatatatgcttcatgaggcaatgcaaaaaaggaatacataagtgctaaggtgggttttaagtatgctttcacaatatgtgcttcataaacaaagattaaatccacatttccgatgccaatcacatgaatgaactttcaggcctcatgccaaaataaccatggagtaaaaacattgcctagagctcctattcgcagcaaagtcagtcaatagcaacttaaactacagtatgataagaaatgagtaatatgaggcctacccttttggctgcacttgccacagagtaacaattccatccaatgcactgcatcacaagaatgtgtaagattaaagttcttaaaagagaaaaggtaaggaaacaagctatggcgattaaattaaatctaccacagttcataggtgactggagatcaacacacacacaaaaaaaggccaccatttagctaagcatatccgtctaaacagatagtatatcactcggaactcctaatctacaaacacatcattgctggcatcctgcactgaaacaattccattccatgttcatactatccagatagttgtgtagctatccttttaaaagatcggtactgttagttgtttggacttaccaacctcaaacagactgtaactttgatagcttgttagttcattaggatgtaacgtcaacaaccaattctttggttgttggcaaacacccaaccaaagacatatgtacaaaacatgactgtgcacggaaaatgcttcatacttgtatgttcgaaaagaagaaataaatagatagaaacagttgatggagcatgaaacacaactggaaactgatggaacatgaaaggtcagctagagatttcattcaaaactgatggaaaatggaagatcagctaaatataagattgcatcaatgcaagagtccaattttagattcactcatgcaggaacgcaagcaagaagttatgacccaatagaagattgctctgtattgaaaataataacaattcaacaagtgcgtgtacggctgtcaaattttaaaattctggacttccgggtgataaaactgataggatgaacaatgcggaagccaaccagacaaccacaacagatattggttctctgtgcatgttccatccgtcgttctttccaaattaacaagaaatttgactgaattgttatggaatatcattattttgcggagaacttggcatcgctaacctctaatccgtaatcagttgcattgatggcatacattaaacagcccatgaaacatacctagtagcaacaagctgatcattgacagggcatagctcaagacacctaagcttcctcttgtgttggctacagattacggtaccgccatagaacctaagcaccgttgcagatgatttcttcacgctctgaatcaagttctgatgctccttctgttctgtaaagagaaaaacgcagcctgatgtatgagcacatctgaggaaataatttcatcatggtagtggttctcctaaagaggaaaatcaaaagaaagtaccgatcttaagcttgggcttcttctccagtgccctgggccgctccggcggcacggatgcggaggaggatgatggagcggcggtcttcttcaacccaggcatgggctctgggcgcgggggtggccggttgtttgcccccgggatgacaagctgcggccgctccggcgccttgtgctgtggaggagatggcttggggtccctctgggtcgtcgtcggtggcagcgacggcttggggtccctatgggtcggcggcggaggcggcttgcgatctcgataccgggcgagccgatcttgcgcctcggcgagcttcttctccgcggtgtccagctacggcggcgtaccgggaaccatgagaatcgatcaagatcgcaacatttatcagacaaaatagcaggggaaaggggggggggggagtaccagggactggtagtgcgagagcttgagcttgcagcgctcgacgtcccgctcgcggtgggcgatgagggcgaggaccgcctcctccgcgatgtcatcctcctcatcctcctgcgtggcggcggtggcggtggcggaggaagaggattgggggggtttggatgcggaggaggcattggaggcggcggggcggggccagtaggcggattcgtagtcgtccttctcgagcttgggcctcttcagcgccgggggatcgcccatggccggcgagcgagcaggcgggcgggcgggtcgaggaaggaagagaggaggggagaagcggcgcgtgtaccgaccaggggtggacacagaccctggtctgccaatagtcgcgtcgcgcactcgcgccgcgccgcacgctcgctcgcctctcgcttgcctctgcctctgtatatactgtaggagtatgctgctgcctgcacgggtgcacgcgggcgcacggcacagggccaagaaattcttgtgtccgtgctccgttcactcatgaatttcgttggagttgcagctctggtttaagcttgtgattcccgatgatccgtgtttacaacgtgattatcaaatgctttcacaagtcacagacatttgtaacgccacaattaaaaatcttacattagttcctccaaaataacaaatagtaaaagttgtcaatttggcatttgttatttagaaatatagagtagcaaattttaccaaaaaagtgcgttgggagccgtgctctctctcactttactaataaaatgataaaactttaccatgcatctaaacaccaactagcaaattttcaatgccaaaacttttgccacaacaaattgatcaaaacatgcccatactactacttgtttaaacggcttatttgcttcatgattaaaattatttttttcttaaaagaatctcttcaaccatattgcttgcacatcttaggtttatttattaaaacatttaatttaatttatatttatataattaaatagataatccgtagcaacaatcctctcagcaatctatttcaaacggagcctaaggcgttaaggattgttcaacttgtgcaagactttgtccattttttatccgattttggtagaacaacaaattaagcattctcttgccatgatcgctctttcaaattttggtatttttgaaagtttcttctcttataagctctaaagtttggtaaccaaacacatctaacactatcaaaatttagtacttcctccgtttcataatgtaagtcattctagcattttctacattcatattgatgttaataaatctagatagattcattaacattaatatgaatatggaaaatgctagaatgacttacattgtgaaacagatggagtaacatgtaagtgcctcgaaattgattgtagcaacacactgaacatccattaaatctatatcaagcgccaaggaacttaactgtggttcatggattttatgtagccttaatctattgcacattactccctccggcttcataactcttgacgttttgaaaaagtttagatcagacaataaaaactttaactattaataactatatagtttaaagatattagaacacaatgtatagattagtcttaaactattaccatgcctcacgtctaaacacgtgttgttgttcaaaacatcaaaaattatggaaccagaaccgtaggagtactcgtgtatttgctctttataacagtgccaaaaaggaaagaagtggcagacggggcctcattgactcgtatctacaagaaaagaggttcagaagataaagagaattccagtatgaatgatacttcaactcctgatacagactgaaaaccttgataaacagagagatggatcaaccacagccttttgaaccaaatcaggcgagaaccaacgcagaacttatgaagtggatgctgcgccacttccctacggagtctcgtcttcgtggtaaagatacagaccaaagccaaaccttgcgcaggccttgcagaatgcggcctcttctgcagcagccacgggatcatcaaatcgtgcatcattcagtgatgttgttccagctgcctccctatgaacctgcatccatagaaacaattcacataaaacaaacaaacaaaggcaaacttggttcggtgccatcattttagttttatagcacccgaagattatggttcactttgatatagcactgaaagttatcacagttctcatatagcattctgttaaaccacagttaaatctctaccgcgttcgcgaaaaaaaaaagcgttcgcgaaataaatctctaccacacattacccccttctacctttctttctgccccctcccctccccttcttccatgtgctagagatcggcggccagctctattgcagacctgtggcactacccgcttgggagaaggcaggaagcgggagagcttgaggtcacagcagcagctgagctcaagctggagcctagagggcaccggcagcaagcgagctcgaggacaaatgcagcaagatggtggtgattgtggtgtgtgttggtgtgcataggtgtgtgcgtacaactctattcatatgatgattatcctgtaataagaagtgttgggctgtaaatagactagttatgtgtgtgtgtcttgtgtgctggcccatctattgaagagggcccatcccatgtatatgtaagtgagaatggcaatagagaaagtgaagcttccagagaaaaaatcacaagacttcatggtatcagagccaaccggctagtgactggcgatggctaaaccctagcctcgccggagctcgtcgaggagggagacgctggtgttggggaggacgtgtggcggcggcgctgtgagcggaagagtgctgcacccgtcgactgctgaggcggagcggcggcgtcgacggttgaggcggagaggccacgtcgacgccggagacggcgacggctgctgcagtgcggccggtgtgaaggagggagcagggttgcagtgctaggtgtgcttgtgcttgtgaaggaaggagtgagtaagtgtgcttgtgctgttgctgctgcttggatttggtacttgtgctgtgagaggagacagagaagagctgtgcgacggtggtgcttgtgctgttgaaaggaaaaaacaaaaaaagggaggagacagagaggaggtgaggtgcttgtgctgttgctgttgaaaggaaaagggaggatttggtgcctgtgtagctgctgctggttggagtagctacaacttatagaaggtgagaataaggaactttctactgcaagtattgcttgattaaaatgggggaaaatcagggactggaacaagtaatgggtaaattggtagagatgcttgcaaagaagtttaatgaggctccaactacgagtagtgcagtggttcctcatactgaatcggtgcaaaaaattgagttgatgcaaaatgacattaagttggagggtgtaaaaaattatttgagttggtcaagaagagctttattgattttgaagacaaaggggttagaaggatatgttaccggagagataaaggagcctgagaacatatcaagtgttgaatggaagacttggagtactaccaactcgttagtagtagcatggttattaacctcacttatccctgctattgctacaactgttgagaccatttctagtgcaagtgagatgtggaaaactcttactaatctctactcaggagaaggaaatgtgatgttaatggtggaggcacaagagaagataagtgttttgagacagggggagcgttctgttgcagaatatgttgctgaattgaagcatttgtggtctgatttggatcattatgatcctcttgggttagagcaccctgattgtatagcaaaaatgagaaaatggattgagcgtagaagggtcattgagttcttgaagggcttaaattcggagtttgaaggaagaagggatgcaatgtttcatcaaaccacccttcctagcttggatgaggctattgcagctatggcacaggaggagcttaagaagaaagtattgcctagtgccacaccatcttcaccaagccccacctatgtagttgcacaaagtaaagagaccagggagtgcttcaattgtggtgaaatggggcaccttatacgtgattatcgcgctcctcgcaagcctagttatgggagaggaagatttggtgataggggtggagcaagaggtggaagaggttatgcaggtagaggtaacagaggtagaggctatgagtatagaagtgatcacagagctaatgtggtcacgcttgaagagagttgttctggatctacaaatgttgatgttgccaatcttgttcattcttcctcaggtaactcaaaccaagcatttatgtctatcaatagttctcattcaaattggatacttgactcgggtgcatctagacatgtcacgggtatgtgtggagaatttgcatcatataaaccatacccatttacacgaaaagaaacaattcaaactgctgatgggacatcatgcccagttaagggagagggtacagtacagtgtactccttcaatcactttatcatcagtgttatatgtcccttcttttccagtgaatttggtttcgataagttctcttgttgatcatatgaattgtcgggtctcccttgatcgtgagaattgtttaattcaggagagggaaacagggaagaaacttgggattggcgtcaggcgtgatggactttggtatttggatcgaaaggagacaagtgaagatgtatgtcttgcattgatggctcctacaagtgaagaagaggctaaggtattacttttgcattgtcgactggggcacatatcttttgaaactatgagtaagatgttccgagcagaactaagtagagtggataaacataagttagtatgtgatgcatgtgagtatggaaaacatacaagaacatcatatgtgagtagaggactccgaagtatgttaccatttatgctaattcactcagatgtttggacttcacctgtggtctctatgagtggaatgaagtattttgttacctttattgattgctactctcgcatgacatggttatatcttatgagacataaggatgaggtgcttaaatgttttctaaatttctatgcatacattaaaaatcattttaatgctcgggtccagtttattagaactgataatggaggggagtatataaacaatgaatttagtagctttctttcatcagaaggaatattgcatcaaacttcttgtcctgatactcctccacaaaatggggtggctgagaggaaaaaccgtcatctcttagagacagcccgctcattgatgtatgctatgaatgtacctaaattcttgtggagtgaggcagtaatgacagcaacttatcttatcaaccgcacaccatcaagaatacttggaatgaagacaccatgtgagatgatatttggaaagaatgaatttgttgttccaccaaaagtgtttggttgcacttgttttgttagagatcatagaccttccattggaaaacttgatcctcgggctgtcaaatgcatctttgtaggctattcatctggccagaaggggtataagtgttggagtccatcagaacgacgaacctttgtaagtatggatgttacttttagagaatctgtcccattctatggtgagaagacagatttaagttctttattcattgatcttgatgattcaactagtggtcatgatggtcaccaaatgaaagatgaaatattgggtccaaagggagatgaacaaccaaagaaggaaaagcttgtggttggttcaattccatgtcccatgggtggtcctgttgcacaggagcaagaatggaggaagccacatgaagagaaaaatcttcaagtatacacaaggagaacaaggtgtccagtaatccaacaagttgaagaggataatcaggtagaggaagatgtaagccgtgagcaaggatctttggagtcagggggagaagaagaggaagttagagaagaatctgacttaccaattgccattagaaagagtgtgagaagcaatgcaggtaaacctccactaaggtatggttttgaagctcaagatgagggtgatgatgaaaataatatatccaactatgtttcctatgactccttgtcatccacatataaggcctttatagcatcactagattcagtgcaaatcccaaaggattggagagaagcaaagcaagatccaaggtggcatcaagctatgctagatgaactagaggctcttgaaaagaacaaaacatgggatcttgtaccatttcctaaagggaagaaaattgtcaactgtaagtgggtttatacagtaaagcaaaatcctgatggaaaggtggaaagatacaaagcaaggttggtggctaagggatatagtcaaacatatggaattgattatgatgaaacttttgcaccagtagcaaagatgagcacggtaagaactcttatatcttgtgcagctaattttgattggccattgcatcagttagatgtcaagaatgcattcttacatagagatcttcaagaagaggtgtatatggatgtcccacctggatttgccacttcacaaactaaaggaaaggtgttgagattgaagaaatctttgtatggtcttaaacagtcaccaagagcatggtttgatcggtttaggcgtgcaatgtgtgctatggactataagcaatgtaatggagatcatacagttttctatcatcatagtggagatcatataaccattcttgctgtctatgttgatgatatgattatcactggaaatgattgcttggagataactaggttgaaacggaatctaagcaaagaatttgaggtcaaggacctaggccagttgagatattttctgggtattgaaattgcaagatctcctagagggatagttatttcacagcgaaaatatgtattggacttgcttagtgaaacaggtatgcttggatgttgcccagtctctacaccaattgatcaaaatcataagttatgtgcggagtctggagatccagtgaatagggaaagataccaaagattggtgggaagactgatatatctatgtcatacacgacctgacataacatatgctgtcagtatggtgagtcgatatatgcatgatccaagaagtagtcatatggaggcggtgtatagaatcttgagatatctgaagggaagtccaggcaaaggcttatggttcaagaaaaatggacatcttaagatagaagggtattgtgatgcagattgggctagctgtcttgatgatagaaggtcaacttcaggctattgtgtttatgttggtggcaacttggtatcttggagaagcaagaaacaatccgtagtgtctcgctcaactgctgaagcagaatacagggcaatggcagcgagtttaagtgagttgttgtggttaagaaatcttctagttgagctgaaaattttggggaacactcccatgaagctattgtgtgataataagtcagctattaacattgctaataatccagtccaacatgatagaacaaagcatgtggagatagatcgtttctttatcaaggaaaaattggacgagggagtgttggaattaggatttgtaacgtctggtggacaagttgctgattgtttaacaaagggcttaggtgttaaagagtgtaattgttcatgtgacaagatgggtatgatagatatctatcacccatcttgagggggagtgttgggctgtaaatagactagttatgtgtgtgtgtcttgtgtgctagcccatctattgaagagggcccatcccatgtatatgtaagtgagaatggcaatagagaaagtgaagcttccagagaaaaaatcacaagacttcaagaagaggcaacacctttaaacttacctctccatctgttcctcgtactgtgacacgatatatcactgtcactttcccattgtcagtgtaaataacatcacggacctctccacaccagcctgatgtttccaaaaaaaacagtgataatatgagtggaaatccaagaacggtgtaaaagactgaagagttggcatgaccagtgcatttcaagtagataaaggatagatcaagcaaggaaatgtgactatcatccactggaaatgattaaaggtgttaaatttggtagtcgttggagtatttcaacagacataggacaggtagagcaagtaaatgttgacaatcatcagaaggaaacaattataagttgaaatgagagagaattcagcatcccggaagctgcatatgcaggttatgtgtacaaaacacactacttattcagcacctggaagcagcatttgcaagttatgcgtacaaaatacacttattcatcatgacagcatcctttaagctgcctataaaggttatgtgtacagtacacactacatattcagcatcctgaaagctacatatgcaggttatgtgtaccaacacacactacttatttagcatcctgaaaacggcatatgcagtttatgtgtacaacacacggtacttattcagcatcctggaagctagtacatatgtaggttatgtatacaacacatactacttatgtaactttatttgctcatgttgctttcaaaagagcaagcacagaaggggtgaaccagtgactggcatcgattttgtgattacaaattaatgttcagcaccgttagctcggtattagattcaggtatagagtacacgagatatgcttacctggagcataaaagcttagcatcctgttggcatgatacctacaagaaaccgtgaaacatcagcaaggaacaaacttctttttgtgtcttgactcttgagagtgtgccactagaaatgtgaggatctgagcgtcattggtcgatgctgtacatgagcctgaatatcgcgagtgctccttgttgcaagcaaatgtgtatggcagcaagatctgcagtgctttaccagtagcacaagcaaaggccaaggatgtataggttgttccgtaccaggggatgaccggatcggagggcgacgcgcggcggcgggaggaacggacgacggtgtcggggacgcgcttgttgaggtcgcgcaggatttccaccagcggccgcgtgatccccgacggcgccgcgtccagcggcaccaccacgtagttgctgctgctcgccgccgcggccggcttccgctccggcgccgccgccgtgacgacggccacgcgccggcgggcgcggacgacgatggggagggaggcggcggagagccgcgtgtcgacggggcgcacgagcaagctggaggttgtggcttccatgctcgatcgatcgagctcggaaagtggagactagcaaatgtaaaggacacacctactactagagagtgaaagcttcctactcagcaaatgggaagggatctctaacactgtggaggtaggtggaagtttggaagcagcctgcaactaccactctctccctgtgccctcatgcaaaaaacgtgtgaactgtgaaccagatttccagaccagtgtgcagatagggggtgcttgaaaaagaattaaaatgcatgaacatgaattcttaaaaaacattcaaagatcatgtgttttgtagagaattgcactcttcaaacaaaatcaatgtaaattctgaaatcgaaagataagcaagttttgacaaacggagcagcaaacggagcgagcttctccaaatggaaaatgcactttgctttgagtttgggttatattccagaactcatgcatagattctctaaatgaaaaatgtgcatctatttagtttggattatattccagaacaaacagatagcttctccaaacaaaaaatgcacttgacatagagtctgaatttcattccagaactcatgaataccctctccaaaatgaaaaaaaaaaaaacactttgtatagagtttggataacatccaggaactcaggcatagcttctccaaatggaaaatgtaccttgcataaactttgggttatatttcagaacttatgcattgcataggttctccaaattaaaaatgcactttgcattaagtttcaattatatcccagaactcatgcatgattctccaaatgaaaaatgctcttcacaattcacagagtttgtaattttggattatgactcatcctcatccatagattctccaaatggaaaggtgctttaaaagaccgtaaacataactccactaataaggcctaacaagtctagtcaaacgctagtagatgttgatgaaaatgatttttgaacatgtaaaccaatggtttatcataagtactatagttagaaattgatacaacaaagctgtacaactcattgatatgccaagtaaactgaccttcttaatgagaccaatactcaaactgatgctaattttcttttttcaaaaaaaaaaaaaggaacgatgatgtgcatttcctagtttcagtctttcagaacccaacagcccaacccaaaatgcatcacttagcaaacatgtagaaatatggtgagcttactaggcaagtctcaccgagcttgccacaagaaattaaatgaaaatgtggtagtatttttcacaccttgctaggttgagcaatttgctccttcaagattactgttaggtgatgcattgcaagcagctggagtgaatggacatttaggccctcgagtgcaccctaaactgccctcctgtgctgtcctcttacactttgttcccatataaaggcttgctgtggctttccgaggcattgttctagcagcgcaaccctatcaggaatactgaaacaagaaacctctagggaacattgtttctgatcctccacatattagttatctcaatagagccgacttctcttagtcattctctttctgcacacaaattattgcacatagacattagggatgtggccgacaaaacacatacgcacattacagcaaaacaaacagatgcgcgtgagcgcacacacacaactacaaaaaaatatagagcaaattacattgtgaaccacctatgtgtgcctttgtgttcacattgcaccacctttaagggattgtgtcattctagaccattttttgtttcccattgttcaatttacactgaatatgaaggacccatgatgcacacaccccatgtcccgacccctggtcccagcttcccaggagagctgcgaagcgacagcacaatcagccagcttttggcaccctagttcagatactgacgttgccagacaacgcttaaggaggatatctctggtgagaagagattggttcaaaacctagaggtcggcatcccatttacttttttttggttgattggaatggattggagataaaaaaaaaagaatagctgcaacctggggtttcagcttggagtacaattttcctttttagatatgtagttgaattgtaatgtttcagtcttgttttacatggtgatagatgacaataggattttatctccactggaaaaatattgttgattctacaatatcatcgaccattgttactatagatgaacaagagcatgcttcccttagtaagatgatgatgacaatgacatggattaggagaatcataccttgcagctaggtgattatcaatcttctgatgaggatgatgcagaatatgctttcgaggagggaaaaaaagaacttgaaccagattgctgagatgaaaagtagggtaggtaaggactttcattgtgagggtgacaccaatggtgaagacttgttcgatgccattgctgacttgaattttgagcaacagatggaaaaaagggttggctcaaagattggacgatttggtggcatcgtgtttattttctttttttaccatgaaccagtaatggaatccactatggtatatcaaataaacagtagtgttttttggttcaatgtggtgcagattaaaaattgacagaaaattgtgccaattgaaatgaaaatgcacttcatacaaagtttcgattatattccagaactcatccatatcttctccaaatggaaaagatattttaaaagacccttactcaactaataaggcctaacaagtctggccaaatactagtggatgttgatgaaaatgattttaaatacgtaagtccatgatatatcataagtattatagttagaaacataaacaacaacgttgtacgactcactaatataggaataagtaaacggagctttcttaatgaggccactattgaaatgatgctaaggatgatgcacatttcctaggttcagacccccaaccccaaaatgcatcccttaacaaacatgtagaaagataatgtgcttactaggcaagtctggctaagcttgccacaagaaaattaaacgaaaacatggttatacttttcacaccttgctaggtagagcaattctattgtccacagggttcaactggatccccaacaaagtttggcgaactctgagttaattgaacagatatgctgcttctatccttcaagatttttgttacgtgaggcactagaagcagctggagtgtatgaacatttaggccctcgagtgcattctacactgtcctcctgtgctgtcctcttgcgctttgttcctgtaaatgcttgatgtggctttgcgaggctttgttccagcatcgcaatcctatcagcaatgctgaaattctctgtggaacattgttttggatcctccacgtatttggatagtaatctcagtagagctagcttctcttcatcattctctttctgcacagaaatggttatacaacattagggatgaggctggaaacacacacacacacacacacacacacacagagacacacaaactatatagaaacatagagattaatttacactgtcacatactcacattgcaccacctttaaggaattgcatcactctgcaccacttttttcttcctattgttcgatcagtgctgaatcagcacaacccaccgatgtgccccacaacacatgatgggtaccgcacccatgccctgaccctggtcccagtgccgctgccaagcaacggcgcgagcagtcagcattccgcaccccacttcagatcctaccaccatcacacagcgactctcaagaagatgttctctgatgggaagagattagttcataaacatggttggcatccaatttactttttgtttttgttggttggaatgggttggagaatttagtttagttgcaacctatggtttcgctagctgatcatcaatcttttgatgataactatgaagacttatcaatcttggaagaggagaataaagaacttaaagcagattgcttagatgagcagtaggatagacaaggaccataagtgacacactgacactgatgcggaagacctgtttgatgtcaatgctgacttggatgtgtttaacattgatgaagtaccagtgtttcagcaacagccaacagatgcaaaagggattggctcacataatactggaggaatttggtggcatggtgtttatttagtctttgctacaatatgaacctctacagtcattttagtttattgcttataggtatggtgacatgaagtttgttacatttcagcagtcatataaatctaattgtgcaatttgtctggtgttggcgctaaaaaggacctgttgaaggtattggtgcgcacatcaattggatggatgcattaatcggtggaagttaacgcctattggttaaatgtggcacaggttgaaaaattgatagtaaaatgtggtgcagggtgatacaaatccttaatggtggcgcaaggtgacacaaaaacacaaaaaggtggtgcaaagtgtaatctacactatatagcaggagttgagtactgaatataacacatcatataacggtaatcaaatatatgcactaacggaaagaatatatcatgtcaaacattaaatcatgtaaaccacttgtaataggttactggtagtgcaaagtacatatagcaggagttgagtattgaaaataacacatcatataacagtaattaaatatatgcattaacagaaggaatatatgataataagctgatagtgtgataaacgacaaaggtaccgatcctggcagatggtgctgttcttgactgtcttgatcctttgtacgcccaactctctcaatgacacaagtcgctatcgcagaaagcgggaatgcatcctgaagttcaaatgcaattattgtagcaacggtttgatgataaattcctctattcagcatatgagcaacaacatctgcaagacaaaacagctgcagccagttagtcaaggaactggaataattaggcataggtgaaatgtcacaagggtttatcagtgattcagtggtaagtggccctcaccacgcagcttatctaagaaatgcttggagcatttgagcacctcggcgcagccaggccgccagcagcatgcaacagctcgaagatctcctgcgacgggaactccacgggcacgccgaaggcagccatgaggagaagaaggccgcgggcatcgttggcggcggcagcggcaacccgtcctttggaccgcacaagccggctgcgccacgagagcgccgcctcgcgggcttccgcccgcaggtggtcgtccccggcctcctggcccgggcggagggggcagccggcgcgcacgtaggacagcaggaggagctcgcacgcggcctcggtgtgcctgcccccgggtcggatgtagtagcggccgatagcccggagcacgagctccgcggggttgggggcgcggcggagcgcgggcgggacagcgcggagcagccaggagaggtcccccatgcgggagatgacgaagcggaggagctcccccgagcccatgcgctcgcagatgcggcccatatgctccgccgatgggtcgccgccgcggttcggcctgggctcctcgggctggggcacgggtgcaggcttgggctcggcgacggcgacggcgacggggttgggcgcggtagaggattctggctcatcgacggcgacggggctgtgcggggtagtggattctggctcggcgacatcggcgaggttgggcggttggtcggcggcgggaaggggtggtaagtcgtcggagatggcggtggcatagcggatgaaggagttccagtgattgaagaactcgacgagcctgtcgctgaaggtggagaagggcccggtgaggcgcgagcagcattggggtgggggaggcggcggcggcaggcggcggcggcggcggcggcgccatggggatgaatagaatggatagtagatgagtcgcgacgacaggtttgggtggggtccaaatttcaagtgaaatcgagcccgggttgggttgggttgggttgggtcagccgcggcggtgagccggtgaggcgcgttcagcgtgacggcggcagaggcagccgctttttcgccgtttccttctttttacggaggagccaaattaagtttttcaggttgctagtaataattactagctcctctatctctacacgataaaatttgtcaagatacttaaattagtctaatttagaacatccattaagattttgagcatatcattggtcaccttggtgttatgcttattattgctatgtgtacccatcttatataggttggggataggacttaaaaaaaaacctaaccgaatacaacattagtgtcccgacattatgaactagtcctactctattacaaaattcatggatttgctccaccttctatatctagtcaaatatggaggttgtgtgagcacccgatttctatgttctccacggtgagtatattatttggttgttactgaaaatagaggtatctcatgataaattattttggttgtacatgagttgatgctatcgacattatcagatatggtatagacgcttttaaacctactatctttttcggacggaagaagtaagtcacactctaaaataaaacctagatattaatcgttagtggatatatgattattaggtgatgtcccaccgatgagcaaatacataaaccatgagatagtacaaagacaaactaactgtagcaggtaaggagtagacccaatataggccaagcctttgtgcggcccatggatgaaacactataacgaaattatattaagtatttccaaaattaaatataaagtgatatgggctttaacacacacactcctatccatgactctcgaggtaaatgtatgcataacgataaaattcgatggatctaggatatgtaagataaggtatgaaatcaaatcgtacatcagcattgtgctcatgtatacgtgcgcttttgtcatctccttagaaaaacatcttctatgactccataaatgattggtttaagtgttaacttcttatagattgtgtcatattatccatcataatattattttgctgccactttcagatcaacaatcaatcacgctaccccttcttcttcacaagtttaatcaacaactgcatggcacaaaatatacaaaaaaaaactagagagatgaaagagagaagaagcgacgagtctcccataacatacgttggaccgatgtgtacctttgacatgtgggcccatgacgatgggccaccacatgttagggactcacgcccctctaactttacaatagagtagttgcttctaagaaaaaatgcatgcgacatgatcaacacaacacaagtacaactaaagtcatagaaaaccatgaggcctaaatgtggtagtacaagaggcaaaggtgtagacccaacatgggccaagccttcgggcggcccatgctgcaatagcccatacgcgaaacattaggatgaaataaaataatgtaatatgggtcttaacacccatattccttaccatagcccacgtggtcgatagcaaaattcatttgatataaatgtatatgcaatagtgaggtcgattgcttcgataggtttgaagtatgtaacaaacgaaaacgccatgtatgaaatcatatatacacaacatagaaaaataacttatagacaactaatttgaatgctaacttcttatataatataactgtgtcatattatccatcgtaatatcatcatgctaccactctcgagttaataattaatcatgccaccatttttttcacaattgtagtcgacaaatacaaatacaacgcatgcaatatgatagatgaaatgaaataggagatggagaggaaaagtacatgttatcgacacaatacaaagcatgtcatgtcataagaatcaggcctattttagtctttttcttttcagatgataatttttgtggaaatagagtatctatcttctacatagttgtaacacattatattttaaagcgcatcatgcaaacatgtcactccatcattcaatagtaatcatatatcttaaatctcatacaagcatgccacgtcatctgcaatttattatattttagaactcaatatgtaagcacacaaataatcattttccatatctttaccataatattttaacatataccatctatcatttccacaatatttaacatatatgcatccacatatttcacaacaaaatacaaagcgacttaccttgacatttaacaacaatgatatcaggtcataaactagcttttacgatgtgtatatatgtaaccagcagtgatcttaaaactttgttttagtatataagacactattagaaatactgcatcagattattattattgttattttggataaagttagacgagtgctaaccaatgggataaagaattttatgagatcttgaaacgatggataataacataatcatgtgaaaatgcaaatcctaatagaactcgtgcgttgcaacttgcaaggaggccggtacggtgtaggtagggcggccggctgctataagccgcgtaattgagagaagccgcgagggtttccccgcaaaacggccaccaccacaccacagagagcccgagagccctactccccttctctcctcttcttcctctcccgcaagcaaagcgcacgccgcctttgccttagatctcctcgactccgccgccgccgccggcgcctccccacggtccctccctcgccatggtgagctcacctccctcctcccctcccccaccccgaccctccgcccgcctctccggggttttggccttcccgcccgccccgccgcggcccgcacttctcatctagggtttcgatctcttgcgggttgatctgatgccttgcaatctgaccctgtttcttgtggaccgatgcaggagggtaacagtaccaacctcgatgcggcgatagagtcgctcctcaacgtggagaagcagatgaggctggccggcgatgtcgccggcacgaggaaggccgccatcgacatcgtcgagctctgctacaaggccggcgcctggaagacgctcaacgatcagatcgtggtcctctccaagaggaggggccagcttaagcaggtcaagctctcgtcctctcctatctttggacttcgtttagtagttctagttgaattactagctgtatttagctatctaactgatatcttcaaagttatactctactgactagaggcacatgcaaaccccaaagtttccgaggagcacatgtaattgaggctaacatagcatacccacctgctattatgttgtcactctgaatcaccagccattgattttatttttgtaatcttggtatgaacttagagttattctaagttctagtgatcttaaatagattacacaattcaaattatcaacgctcactgaaagacaatagtcatattttgctcgatgtaattggatatatgcccttatttctaagggatactggtggtagggaaggcatgccatagtgttgtgtaagattactcttttctttgcaaagcattatgtgtttaggttgagtttcaactaatgttttgttgagtgctaatcgagtgcattgtatatttcacttcgaaacaatatttgcatgcatttttctccccccaaaatttcagcattgtctctccatatcccatacttaggtcttcctgaaatatccagttattatttacaagttgaacaatatttcataaatcatgcctgtttatgtatgcaatactattgctgctgcattataacttggttatgcacatgtggcatgtctcaactcttctaattctttatttttacaggctatcactgccatggttcagaaagcaatggagtacattgacttaacgccagacatggacacacgtattgagctaatcaagacgttgagcagtgtatctgctggaaaagtgagaatcatggctactcaaatattgcttacctataagatttaatgccctttcatgtgtgtaatctcactgatatgcatcaactgtagatatatgtggagatagagagagcaagattgatcaaaagacttgcaaaaatcaaagaggagcagggacagattgatgaggctgctgatttaatgcaagaagttgctgtaagttcaagctgcactataatcatggcacacagttacatctactataaccaccatagtgttgtcttcgcatctacataatgtctaacaagttcatcctcaggttgaaacatttggctccatggcaaagacagaaaagattgcattcattctagagcaggtatgaagaaatacagtaataaagcttgaaattgttacaaaagcctgggttctggaatcttactgtaatcatgatcacaggtccggctgtgcttggatcgtcaagattatgtacgcgcacagattttatccaggaaaatcagtcctagggtatttgatgcagacccgtcaaaggaaaaaaagaaaccgaaagaaggtgataatattgttcaggaagccccagcagagataccttccctcctggaactgaagcgcatctactatgaactgatgattcggtatgtcttcctgctcagtgagactaattcatcatgagttcatgtcgcttctagtaatgttggttgaagttaatgctaccccctcaggtcgcaaaatatagctacctttagctatgaatatggacaagttcagattcacagataaaggtagctatattttgggatggagggagttctattttgttcagcaaagaattgctttcgactgtttgattcatgatctaatacatagtgatagttaactatttagagttttctgctaagtcaatctaatgcttggttgattaaacaaaagaactaatgtggtgtcatatcccttactgctattagacaattgtttatgtagcttgtattttatttactcaggaaatatcaattcctcttctgcggttacctgtcaaatatgtttgcgattgtttaccatcatcatgttatggttactgcttgaatgccttatttgtatccatcaacctttttttatgctacaattatgaatactgtatttgtgctgtttgaattctcgctaactgattttataacctgctaagagtatatatttttttctatatatgtggtgaaacatgatttctgtttgtctctattcagctattactcgcacaacaatgattacctggaaatctgccgttgctacaagtcgatttatgaaattccatcaataaaagaggatccatcaaagtggataccggtaaagctctctcattcgcaagtcttacttggtgtggtgtgtgcgcatactcactcacgctataatggttatctgactgcctgaattcgctttaggttcttagaaagatctgttggtatttggtgttggcgcctcatgatccgatgcaatcaagccttctcaatgccacactcgaagacaaaaatctctccgagataccaaatttccggtacgttatgttgctttcaggattacaaattatcatggtttttaatgttctttctaattcctacttttgctgtttggatgggaataggttactgctgaagcaacttgtaaccatggaggtgattcagtggacaagcttgtgggaattctttaaagatgaatatgcgaatgagaagaattttctcggaggagctttgggtgacaaagctgcagaggatctgaaattgaggatcattgaacatgtattgcttacttgactttatcgtatttctcttttggttccttgctttgtatttgtcagttgatttccagttctttgcttttgttcagaatatcttggttgtttcgaagtactattcaaggattaccctgaagaggctcgcagatcttctttgcttgagcttgcaggtttgtgttcccagccttcctagcatcacttgtattcctcttgttactttgtagcctaccaagatctaacatgccccacatttttctcattcaggaggcagagaaacacctttcggacatggtaaactcaaagtcgctgattgcgaagattgacaggccaatgggtgttgtatgcttccgcacagcacaagacagtaatggtatactcaattcctgggcggcgaacctcgagaaactcctcgatcttgttgagaagagctgtcaccaaatacacaaggagacgatgatccataaggcggtgttgaaagcttaatctgtaaaccattttgcattggctggcttgcttaggttctctgcctggccttctatggtcaaattttacaatcacaggacgtcaagcttttctcagctcaagcatcacctgtttgctttgggaactcgtgcgtgaatgatcttaaatactgtgaccacagaatgatgacatattatttgttgttggggttcaatcgctgtcctccaatttgcttaacatgtgtatcttcccgaatattatttgaattctagattattcaatcagatgcctggcttgttttaggttctgcagatgcgctggttctcaatatgatctgatctgtaacgcgttcgttgtgattttaagtttctggagatgcatcatatgtggagaagataaaactggagatcttgtcgtttgcatgaagcacggtgaactcgtgcctaagtaattgaatttgggggcagggctatcttctgtttagagcagagttatccaagctacttagggcacccacaatggttatctataagctctctacaagagatccatgtcagcatatttttctacttggaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcaccttactttaccattgcgggtgctcttaactaatggtacaaatatctgcatggaggtacataaccttgttatcagttactccctctagttccatattaactgacgctatgggttaatcctctttggctggcaaaaattgatgttttagcgctctccacaactctctcccttgtatttgtccagaataccctcattcatgcatgcaaacagtaaatgctgttgcttcgtctccatccagcggaaaagtcccaaggcaaaaattaactaatgcctggagtactaatactctggccacggaagcggaaagactccatgatagccaccgtgtgctgctagttgctcgcctctggccattgcgtcgcttcgcctcttgacaacgccgctcgtcgcgcaccagcatcatggatgtcaagctgcaggacgccgccgtcgcgcatgaagacgaagtgaccatcggcgccatggatgctgaggttgcgccggtggacgacatgatgacgggcggcatcgtggaccacctcgcgcaggaggacaacagcgccgacgccatggaggtggagcagctcgcgcaagtgtgcgttcactgcggccgagtccacgagaatggtcttgacaagatccgatgcgcgcgtaggaggccatgctctcgttgtggtcttgttcacagagaatatgcgcagaggcagcaggcgccaaaacgctcaaaaccagctgcagatgcacc

SEQ ID NO: 21368 - DNA, 19259 bp, Oryza sativa
agaagttattcctgatttgatgtgtatccgagagtatttaataagggtataacaagggaatatggtgactaattaataagtcattggtatatgcaatcctgtccaaaacgtcacttaatatcaaactggagggagtatcagttaaggagtagtacatttaagagcgatgaaaaacaaatagattggactacttgggcaaaagatttcgctccaagttttggatctttttaggtacaagatcatcgcctcagctctataagagaataccatccagacatttagagatccagacatttagagctgtgacatccgagtgttgcaacaggaagtatttgtcatcaatattaaaatttattagtcatgagtacaattgcacgttcgagttggacctcactgcttgatgaattgaactgttgacaatcttagcatcaccagttctttgtcatggctgaagagtacatcgtaaaggaccatataccatttatatgtactctatggtgtgtttcgacgtttatactaagataacattgctttctctagtgtttcctgcagctctccacttttgtatgcatctgcaaaatataaaacagtgcaaacattaaatccagctgaattgctgaaacactgatcatatcaaacattcagtagggaacacacacattaatcatcctcacatcttgtgtgtcaattattcatttgggtttactcaagtcaagtatctaaatatactaccatgatgaacattttaagtgatgatttgctacatcatggatttgtgttctcactggtcagctggtcgccaagtgcaccatccaccttagggcctgttcactttgatgccattttcaaccttaccaaattttggtaaagttgctaaaaaagtggctacatttagtttgctgccaaattttggtaactatacaagaaatcctgccaaaatttggtaaggttgaaaattgcattaaagtgaatactcccttaatttctactactgggcaagatgtatacatattttttaacagttatttcttacattatagtaggttcttgagtatataggtggcaacactcagaaaactgcatggagcagacctatacaagctagttgttcagtgaagaacactaaaccagattataaccaatggtggcacagacagtggcgctcctacatgcagcttctggtaatttaaactaaattatatcatgctgatcaatatatcagttaacaattaggtaattagtatgttggaccctgttaatttttgttctcggttcgccactaggcatggatacttaggatacatcactattggtgatgattaactggtaatgatgagaggggtgaaagccacgtctcgggttatatatatgaatcagggttcacaagctgctcttttatggccagtacaagtagcatatcttgatttaacgcaaaaccagcgttcagatgatcagatcttcagatactgcgagtatctcatgccatgaaaattctctctcaaaatttatatactctgataaattctctcaaatttatatactctgaactatgcctatgaggatagggaatcatcaaaattcagaaccacagtaaacaacagggacgtctggtccccttgaaaagtttctaacaggattctaatggactagacacgataagcgggccgcagcatgtcttcagcattagactaatcgtagtgggataatcacaatgtgttggatcgaagaggtgaattggcatgtcaaacttctcataacaaatcaatgctgcttaaaaagattcaattccttaacagtgagcttgcgtgatgtcaggtcaaatcggggaggcggggtgcgtaccaacggtgatgtcgcatcctccgaagaactcgccgtcgatgtagagctgcgggaaggtgggccagctggagtactccttgagcccctggcggagcgcctcgttggcgagcacgtcgagcgtctcgaagggcacgtccagcgaccggagtatctgcaccaccgtgtgggagaatccgcactgcgggaagtccttggtccccttcatgaacagcaccaccttgtgcgaccccaccaccttgtccagcgtcgccctcatctccggcgccagcccgccaccccccgccgccgcaaggcaccgcgtcgaccgcgcgcgcgccgagccgacgctgaggcgccatgtgggaggggaagccctagggagaagaggaaccctcgcggagacggggcgcgggagggatgccccggggagaggcgaaatcgcggctacggaggcggcggcggtggcggccatggctggtgaagctcgcgcgccggcggcgagggagagggagagttggtggctgtggtgatacgagggcaaacctgtaatttccgcagtgtttctttcttgtggcagaggagaaactgggagtgggcctatgggccctagtgggcctatgggccctagtgggccgtacggcccatttgcgcctccacgggttggttacaagttacagctacgaggtggccgcctctcctccccattcgactcctaaagccctaaacccgtctctctcctcctctcacctagcgccgccgccgccgccgccgcgaacgcgaacgcgatggccgcagccgcagtgctccggagccatggcgcccgccgcatcctctcctaccccaccctccgcgccgccgtgatctcgggccccacggcgctaccggatgcgtcggcggctgcggcggcggcgccccagcagccaccgcctctggctggaaccctgtgggcgaggtccatggccaccttcacccgcacgtgagtccttcttggatcagatccgttgctctccgcgcctggttttctctcttcctgtggttagcatctagcgatcgatccgtgtgtgacttgtgttttgaatttgttgtatgaatctgtctcaggaagcctcatgtgaatgttggcaccattgggcacgtcgatcatggcaaaaccacactcactgctgcgattaccaaggtctgatttgtcacatatagtgcaagttcagttgttttctttggagtccaaacaatttcaacgcgtgaaatgccttttttatgctctttgcaggtgttagctgaggcagggaaggctaaagctgttgcttttgacgagatcgacaaggccccggaggagaaagcaagaggaatcaccattgcaacggtgagccttagcactagttttttcttcatttggaccagatggtgtccttgtatgtcatcatgtgtagatcaagtctgagttatgtggttgtggttgtgtaggctcatgtggagtacgagactgctaaaaggcattatgctcatgtggactgcccagggcatgctgattatgtcaaggtaagtagttctattttactaaagtggaagttatcaagattatatattgacaatcttcacgaacaataaccatggatattatgtaatactaattcattggatattatgaaattgctgagcacatttgtagtatgcgctgtcaatattaattattaaatccagtaggctcttctgatactcaggcttactgagttactgtcccggaactgctagaatccttaatattgagcaatgaccaatgacatctctgtttcaatgtgcacattttcagaatatgatcactggagctgctcaaatggatggtggtattcttgtcgtatcagctcctgatggccccatgccacaaacgaaagagcatattcttctggcccgacaggttttgaatcactgacaattctttatctttttcacattcagtgcgaattttagtatatcatttcatttctggttactgattactcaagcattcctctcggcattttaggttggtgtgccatcacttgtatgtttcttaaacaaagttgatgctgttgatgaccccgagctactagagcttgtagagatggagcttcgtggtatgctagcattctgcatctctttacattgttgtatgaattgttttgttcttgttctaaggtatatttccctttttttcctgcagagctcctcagtttctacaagttccctggtgatgagattccaatcatccgtggatccgccttgtcagccttacaggggactaatgatgagattggaaagaatgccattttgaaactaatggatgcagttgacgagtatatccctgatcctgtgaggcagcttgataagtctttcttgatgccgatagaagatgttttctctatccaggtgattaactttatgctatggtatacagctatttttttttcatattcactgtagttttgaactgattgcaattaaaaattgaatttacttcctctgtgccaagtacaatgagcgaacctatcttgatctatggatataattagtgttctaattctgaaaccggctcaaggtttgaattatgtacttgttagcatctgtttatacaaaattagccattgaagttgatggatgaatgctgctgggaacctagaaactatacagcaagaatatatgacactttatactttgttctgtcaataggcattctatttaactcctgaaaagattttaaccattgtacccttaagtctctggaagagaagtcatatgattaaattgtttatattatgttaattttgttcttgtaactatgagttttagtgtgccagaacactgtttactgtttttggcaagtataaggatgacacagaccaattgatttcaatctgcagggccgtggaactgttgtgacagggcgtgttgagcaggggacaatcaaaactggtgaagatgttgagatcctaggtttgactccagtgagtaaaatatctgatttgtcttttattacttaagtccagtaatgtggtttataccgcctcctagacgtacaaatttattcttgagagtatgacctgcttggttctgaagattcgagaatccacaatctttgtagttatatcttacccacgatttttttacaccatatgcacatttgacttcacgcaaatatcggaatggaatatgtatatgtcataatgggttaagctaatatatttttttaccaactatggttattgaaagaaaaatgtaagcctgctacataaagcctcttgacatttctaggttctttggaactgtcatacgttgattccatgttgtatgttatgttgctattttgatgcattgtgaattttgatgagcacttcttggtcacagagtggtcccttgaagactacagttactggtgttgagatgttcaaaaagatactggatcatggagaggtctgttctgaaagtaaaccatttactggttgttttctattaatgtggaatcttatagctacaacttgtttgcaggctggtgacaatgttggtcttcttcttcgtggtcttaagcgtggtgatgtacagcgtggccaggttagcatacctaactctgagcgggacccatataagtctgatccaagtcatcttttattctattcgtatcatttgtggtctttgagcgaactggtggattgatatattactactcttggtgcaataacaattctttgacccttttattgatgctcctatgtttgtcattttttgtactgctttcaggtggtgtgcaaacctggtaccgttaagacgtaccaaaagtttgaggcggaaatttacgtccttacaaaggatgaaggtggtcgccacacagccttcttgtcaaattacagtccacagttctactttaggactgccgatgtcactggaaaagttgtgttacctgatggcgtggaaatggttatgcctggtgataatgtaactgcaggatttgagttgatatcacctgttccccttgagccaggtatgctccaccatttttgacatttcgaccttttggtatggttttctgcaattgaagtgaacacatttgtttcattttatgctattcaggccagagatttgcgctgagggaaggagggaggacagttggtgccggagttgtttccaaagtttacagctgatctgtttccagttttttctgcgtagcgaatttagtaacaaatgaatgttcatagggaatcagatctatccgaccggcaatatgagagcaaaagagcgagggactcgcagagcatcttctctgaattcatgagatgcagggatcgttggctcggccaccattccgaactagttattgcttttctttttccatgtctggttgttgctgtataacaacgcgtttagtcatcttaacacgtttttttgcccatagcttggtgactaaataagaaagattcatcataagcatcttaatggttgatgtttctctcgcatgattttctgttttactttatcgatgtgtacttgaagtttcaagtttcacaccggatacatggctgacttatctgatcaagtgatcagtcgtcataaaatgtgctagccattgctttcagtctatggaagactgcagccgatatgtgccgcatcttgcatgatctttgccactttgaattcattcatcaatggccgaaaaacatctttgccgatttgagttcatcaatggcggaaaaacaatctatatctgtagaagaatttcagtcaatggtataagcagagcaacaatctcaagttgtagaagttcaatcaaataatcatcaatgctataagacgaaaaataactaataggatttcagtcgagacgataaaataaatcgtctgaaatctgaaacttattatttaaatcgtatctaacaatgaacaatgcgaattcgtccgggtgagatgaacacggcgactatctcgcaaagttaggctgtgatgtcaattcgtccgggttaatttcgctgtcacttgttaagttgtttttacgacacacatctcttcccaagttaggatcaacgcaacgaatcaacggagggtagcgttcacatcatctcatcgatccttggaagccctagaaatcaagaagcggaatcgacggcggctgcggcggcggcgtagccgtcgagaggagaagcaatgccgccgcagttccccaactcccgcgtcaagtccaccgccgccgccaacaagccatcttccatctcctcgcactcgccggccaacaagatcatgtcccgcacgacgtcggcgcccaacctcccggcgctcgccgcccccagggtcatctctcccgccgccgccgccgccgcgcaggccaagaagatcgctcgcgcgacgtcatcgtcaaacctcgccgtcgccaagccgcggccgccgccgccgccgccctcaatctccaagaagccggacgcgccctccgccgccaggccgtggccgccgtcgtccaaccccaagacggtggtcgccaggaagccggcgcgtccggcgtccgagttctcggagccgccggtcgccgccgtgacccgtagcgtccacccggcgcggcggctgacgtgcggcaccgccgtgtacgtgcgcacgaggtacgtgaagatcaccgccaggtgctgcctcgtgatctggctgccggcgagggtggtgtcttcctccgacgcttaccattacaccgtcaagtacgccgccgacctccacgccatgttcgccggcagggtggtccgcgtacccgtcggccacgtccgcccggcgcctcaccgagccgccgccggcgagcgtagcatctggtgacatggcaagcagcaacaagaggcacatacattgcgccaattgctgttcatccatggttgagcagagagagctttttgctaggcagagtattttttgttcgtcttccatcttgcggtgattattttctgtgcccaaactcaaactctgaaattggcgcagaacagtgtacaaagattgagtttttaagccttttatgtggtgatcatctagctgatatgcgcacgcgcaagagcttcagttttgatttccatcaccttggctgtacattcttatattagtgaactattaataggtgcaatagacgcaaaagtctattttaaatggcatcatcatgagctttggagtagatatatcatttgaatacaaacttgtctcgagaacaagattattcaaaccagtcatatgctggcgtgttgaacatcgctttcaaccatatgcttcccagtttgcactattttcagtgggacttcttcttataccaatatttccgctgttttaaactgtacttcaaatttcaatcaatagtagctctctctttacagacagaaacaattaacaccctttgctaatcatagttcactatagtacaaacacgaactgggcgtctgcctctcattgagaggtttagagtattcaagagagcattgctggggggtttagtattcaagagagagcacgtagcatgttcatatggttcatatgctagtataacataagttcagaactgaaatctgagcaggtaaaacacatcattatttttcatttggggaaaaatcaacactgtaccattgcaggatatctccaaacataaatgatactagtagatagttgagacgtgaaggacatctgcaaaccctgatgctagtatattctgaaccaaccagaaatgtgaacatcaaaaccaggtaaaaaggactccatggcatctcagcattcataacttaggtaaaaactcggagaaactaaaagtttccaattgcaaatacaaagattggcctacgaggagaagcaaaacagggccgtcatagaaaaccatgacctcagaacagcggtcaagtaacatttcactacttgtggtatctatgatcaggcttttgtctcctgagctacctcttcgaaattctctcccggaacaagctctggaacatcatcatcgttctcttcctttgcctgggcagtggcacctgcagcagctacctgcttctgcatctcttcagcaatcctctttaggtgctccatgttgtcaggacctacaagaaagatttgactgtcagtaactggacaaactgcagataaactgaatgagtttgacaataatcagacaagtccagtgatgagcaggaataaaggctgatggcaaccaacagataattggcaatggaaacaaagcaagaaaaccagaaaaaaaataagagttacattttatggagatcaaaaatagataaacactaatgtttgcatagcttcatcgctgatttacatgatgggtaggctaggagatactccatacgaaagagctcatgtttggaatatacattttgtgaacatggttctggaatatatacatgacaggaaagagaaattggagtcatgcagctatgaaatgagactgataacatagttcttataacagaaaaaacaagccaattcagaccaattaagacaactatcaattgaatattaagtgcagaagcataagtcaaaagtagtttttataacagcaaaccaagaagaggacatacccaattggttaatgatcccaggaagaacatcttgaagctctgacaagtcaaacagtgatcacaagtcaggaagataaaaataacaccctaataacagacaatcactgaaataaagtaatcaaaaggcaatttgagtcttgctaaaagctagttttgttcatcgtaatattcactccaccccacaatcaacatatatagtaaaccctacaatgttgcagctgaatgcataaaatctcctagagagtgtgcagagataaaactaaagacgaacatgggattattcagatgtcatacagagctctacatgggatggttgctgcaactcagcagtgtataagagaaacagaacagccgctaatcttaaaagaattgaactcgcacaacgaactgatcaaatgtaacaaggagaagtcacatactcttggtctgtggggagccactgaccacccatgtgtttgcggcgatggaagcttgcactgcacaggtcggatcgaacatggataagtaatctaacaccaagaagcagttggcatttccatggtacggtaggcaaaacaggagggatgcttatacctttgggattgacgaactggatgacgagatcatccttgaagatgttgacctcctcgatcgcggggatggtgttgacacctactctcttgagcgtgctctgcagcctcttgtcgtcagtggtccccgtcttgtggacggccttcttcttcctaacaaacaaaatgaagcacatttgtttcatttcgcgacacggcgagaagcaaagaacaagacattcatttcatttcgcgacaaaggcgatttacccacctgcgcacggtgcctttcccgccggtgcggacggcgccggccatcttcataagcctctccttgttcatctgcaaaacgaaccgaaaatctcctcgttaacatgaacgaggaaagtggcatggatctgggcaaccagaatgcggccggaagagatcagatggatccgaatcgaagcgcacagccacactaggataaaccatcatcgggcgtcgggaaaggaaataaaaaaaaagaagccaattcgctggccgccgaatacgcgttgtggaatgagtcggaggagaggcggggagtctcaccttggcgaagcgcggccggcagcgagaggcgaggagggagatgcgggaggaggaggaggcggcggcggcgcaggagaagagaggtgttggggggtgcgaggattatagggttttgtggacgaattcctgggcctttccatatatggaacggtcaggccggcccaaaggtttgggcccggcccacaaccatctcgtctactactgtactacaataactggcccggtcgtattcgtgtggaagttttgagtgggaatttctaggaataagttcatctgatgtctcttaactttataccgaatccgattttcgtcctttaaccccaaaaccagatcagccagtccttaactgtcaaaattggtgcaaacgagatccctcggtggtgaactcaaggacgaaaatcggattcggtgtaaagttaagggacctcagatgaacttattccgaatttctatgcctgaatagcccgtttggtagatctctaacttctaaatttaacttcatgagttgagtttggagtggagttgtggagctgactaaacccagtttcacctctcaagtttactttgtgagagagcttcacctagctccactaccattttagatggaggtaaaacagtttggctgagctccagtttcaggagaggtggaggtgtagctatgccaaacagacctgaaactcaaacgtactatttgtgattcaagaacctgcataatgtggcttttattcatatttatatgtatataaatttcaccggatacaacatccgtcactcaaagaagtgtacaactattatatattgatccatgtgtgtatgcatgcatagatgcattggatcgtattcttcattcgtagaattataaatcagctgatggtggttagaacacacacgatcgacaaacatttgtatatagatataataagcagctggttgagatggacggcatggcgccatgccggcgacggagacgacgacgacgaggaagaagaagaactaggcggcggtgacggcgatcttcatgccggcctggcagtggccggggaagttgcagatgaagtagttggtgccgcgggcgagggtgacgcggtcgttgccggacttgtacaccttggcgccgcgcggggcggcggtgcagcccttgtacccggcggcgttcaccgccaccacgttgtgcgccgacgagtcgtacttgaacaccagcacgtcgccggccttgaaccgcttcccgttcgcccacgatcccgcccccatcccccacccgccgcggtcgccgacggtgaacaccgccgactcggccatctcgccgtggaggagcacgcagaggagcaccagcacaccaaccgccgccatggcactgcctcttcccgccattgttacttgattagctctggttggtgtagtagcagctggcagagaagatgagtagagtatagctagctgagttggtgtttgctgtacgtggtggtgagccatggaggtggaggaggtgaggttttataggtgtggcgcgcgggcggtggtggtggccggccggcgaggtcagtggaggcgtgaagggaagtagggccggggcggcgaccggcgccgtgagaaatggaggagttggccaacgacccaccatggattcaggcaggcgccaatcccatgattttttttggacggaccatatatcaaattcgaaagaaactcctctaactttgtgcaatctgcagtcgtcccatgtcgattttgtgcaatttgtagttgtgctatatcgactttgtggcactaacatagcacaattacagactgcacaaagtcgggatatgtttccatcaaattcattccatgaatgaattgacggttcgttcagagaccacgcccagttgccgcgtgcaaactttacaacgacgtcggcgtcaaccaagtgtggaaatcacacaagacacaacgcacaaaacctaccaattgattaattaatgtcaaaagattttgcacactagacaaagttcagactaactttagtttttgatttgagccactaatccgattttcaatttggcgcgtgcagtgcggtacagtggtcgatcgatcgatcgatcggctcgtatactacactcaaaacgtataggtagcttaagatagcctgccttttgagcctgtgttacttactactcgacccttgccttgacgtcaaagcatgaatagttaagtacgtttgaggctagctttgaattaaagaggtcaagttgccatcgtctggaacatactcctatactttttgtatatatgcacaatatgtccggtacaatctcatttccatcgtatagcgaccgttagctgctgcgtcctccatcgatctcgtataaccactttcttcccctctcaataacctgaattagcacaatgcggatgagtactaattgtgtgcttggagtccaaaattagcaaaggtaggtaactctgccacttgggcctatttctacttgttaaagcagcaaaaacgaaaagaaagtaggctcaatttgtagcaattggacaaagcaaagtccatttgttaatgggcccaaaccgtactaaaaatggacgaatttttgcataatcacccttggaaaatcacacaatttcactcaagccctcgaaaccgtactacgccatctcactcccacgcagcagcgcagccacttgcacaagatggagaagacggcggcccctctcctcctcgcggcggccttgttcctcgtcgtcgccggcgacggatcggagccgacgccgacgccgacgccatggccggcccagttccacgcgaagctcctgatggagttccacggcaacctgtcgctggcggacctgtggtacgactggccggggggccgcaacctccacgtcatccgctaccagctcgccgccgacgagcccttctacgacaacgagtggaacaacggcacctccttcttctacaccccggcccgccgcgcctgccgctccgccgccgtcggcgtcggcatcctgcccccaaactggctcgtccctggctccgtctacctcggccgccaccccgccgacggcttcgactgccacgtctgggccaaggccgacttcatcacctactacgaggacaccctcaccaaacgccccgtcaaatgggtcttctacaccggtaattttgaaccctattccgcggcaatttcctgttccatcccttctcatccatgtgcaccacctgtatagttcagaattaaggttagagcccacaagaggatgcaaatattcagagtccatgtcccttcttatgctttggtcatatatccagggaattgctgcatattgatctgttgctagtagttagtacattgtttcagtatgttgaggatgcattttttttgaatgaaaaattgaaaatgatgctacacttttgatggatacaattcaaccaggaccgatgaatagcgctataaacagctcacttgaagcatatacagtatgtaatcaattaacattatgaactgtttttttttttctttttgctgggaagaggcaataacactatgaactgtatccatcaaggagactacagctgtatgatgaaatcataggggatctgcttcacccagtagtgcaatccttcattggaagcatttcgaacaaaaacattctagttcttaacttctactatctatcacttgtttagtgcctataggctagctacttagtatgcttgtggtttcagactcacaaactaatggttgatgaaagggcccatgccccttgaactttacttccattttccactgatcgctagtcgttatgttctgaaatgctgcccaattttactttccaaaaaactttctcagcaatttcatcgcatgttaaattcttatagatgattgtgcaatgtagcttttgggaatattatctttaagtgttgtgatgtcttctctgtgatgaaactgtggccatctggccattaagttttatttccccaatgttcgatctcggctctgcaactttgagcctagccatagaaatatgcagacccaaatatatgcctgggaaatgttccaatttgagccatgtctgcaggtattgctgcctcttgctggtcaagaattaaagaatttctcgttagtcaccagtcctgtgtcatcttcccttgaaagtagagtatgccttctgtattgccggcatgtacacttcagttaatagttaatagtactcattgtttaggtttgccaaagtgatacaacttgtagtctccgttaagtttgtcatgctgatgagctgcccaacaggtaaagaagacagcaagatactcttaggtgactataagttagtatttccacactcccagttccactgcatttggtaccacagagatgtctgtttgtcctgaattcgtcatgagtcatgagaaccaaacgcttataattatgtgtataattgtgtatcacttttgtagtactaacattttgcaatctactactatatagggaggactagccatgtgatgagctttgaggagggtgctgtgctggaggacgcagaatggcaggcacctgaatactgcttcggcaagggtgatgagactgaaacatccaacgacaacgccctcatctctgaacctgttgctgggcatgataagggcttcttccccaggagagaattctgagaggctagctgtattctactattatctggtgagacccaagaccttaattagtatggccaccatgctgctaatcgtctgtctgtattgtgctcaagtatcacattcaaaacattcactgtgcgagtttgcgggatgtacagttttgtgcaaacaggtgaaactaatctggaccatatatcatttgtgtaataaatttggatcatgtgtttcttagaaccgtactcataatacggatgaagtgaaataaatatggttcactatgtggttacagtaaaagcataggagatgcagagtaagttgcctgggaaggtgaggtgaggtgggactgggttgtgttctacattgatctagtagctactagtaggatcgataacattgtgcagaaattgcagcacggatgatggaagaattgaattgaagatagataatgcgctggcaatggaccacggggtgtaagtaaaaataaacatgatgattactgagactgaatcagatcaaagagaggcgacacagatctcgccgtctgccaaggccatcccatccagatgcacgtctactagatagatccacccctactcataaagccaggaccatcgatcatactggtaggctactagaggttcaataggacatgaatttgcagaaataaattggtatgaatcaaataaaaccccgaaatttatataacactatcgcattgtctaattgtctagttttgtaaattataacatgagctggagagtctccaaccaccgcatggggttggaggacgaagttgggctcctggaaaattttccttgaatattttgatatatatgtttattagttttgttttttgtttttttttttggggggggggggggttgcttatgtgtatactgatctaatattgtattcttcgctctatttgtcaacaaattcattactctactgacattattttgtttttttatgttttatttaactattgagtgattactcaatcaacagaagtgtggcatatcatatcatatcatatcaaacaggaggagtgaatacgctcttaaaatcagttgccaaaaatatcttatttcattatatgtgacgtaacatgttagctgtttttatgtcttaagaatagctcggattttatcccaccactcttgttaattatttcaataaaaactataatcgactgtgtgtcttaaagcagagaactggatgtaatacattttcgttatcttttaagagaaatcatattggcatgccgctttggatggcgtcgtggcaggaggtgagccacacaggaggcgcgtacgggcgtgtacgaggcatgggcccaatgggccatgggcgcgtgtgtgcgagccactactttcccggggcagcgtcggtaaggcacaaagctcggcagctgctagcattcatggccaaatcaatgaaagatacaattcaattcaattcgggggtacgtggtggttagcatttggctactctgcatcaaaatggcacgaggaaaattccttcttgcgtcccatgcatctcgccatttcctttttttttctttacatacacatagccccatcgtccctaataaagttaaagttttaatttttaggcttaaaatttaacttgattaaagatatttttacatagtttttctgcattgaacacatatataaaaattttatctataaattatttttattttctaataaatagtttattagagaatacgagcaaccaataagacagacaggacaaagcaaagcagacgtttagaatgctccacatgcatccatatgaacacacatcttactgatataagcatctacagaagactatgggcttgtttggtttgataccaacttattgccctaccaaaattttggtaacttcaataatagcaagtgcatgtttggtttgttaccaaattttatcaacaatagtttaaattcaatactatccaatttggtagtgccaaattttggtagggtaagaattggtttcaaactaaataggccctatgccgatatattttaatattaacgaagccaatagatacatagtcaatctttaaaataataattagtcgtaccactattttgttgtaaacggatactgctactagtctaataacgtgacttgactgccagatcatgattttggtagtatttctgatggctgaaaaccaagagtagttggctaacgtccctgttgctgtttgtagttgacgctcgccgtttcctgtacgcatcactacttctctgctactgcttactaccacaagttctgataggtacaactactgtactagtagagcttaagattttttttccccctaaactctctgtctgtctctctctcttctagcaaaaacagaactacgaaattaacaagagttctagtatttgtatgattgtatctgcagccagtggtcagtattaatgagtcttaccgtttatgggagagagagagagaggagataacgaaggagataagccgccaacgttgttaagatgtccatttttatcatcgaacagagtaaataacagagcttaacaccttctttcaggtgattgcttctgctgctcaaacaagtcctaatttcgttgtttcgacaacggaggagtggaccgtccaacctcctacttatgttctgcaagaaaattgcctctgtcactctgttagacttcgccatcatcgtcattaacgtcagtcagtaatctcttgagttgtcatatttagttagttaggcagcagcagcaacatgccaatgttatacctatacagaaaaaaaagttctttatttctgtgcaaagaaggtactactccgtccaattaggttcttttttggacggagggggtaatagtatatgattatatgtcatgcaagtgtttgcgagacagcagctttggtacacggttagaccgcaaccataaatagtgggggtcagcgactctgcatcgtcagcttagcttccttttggagctgctgctgtttctcctctgcctataaaaagggcttcagctctcgatttccatttctgaattatcatcgcctgaagagcaattcaagaggagaggagaggagagctagctaaggcagccatggattactgcaagcagcaggagcgagacgggcaccgcgacgatggcgatgtgacggagtggaagaaggtggccgagctgagagccgtcgtcgaagcccaggaccctgcatgcaaggtatctccttctccttctccccaattagttcatcttcttcgcatgtatgactcacctagcttaggagctttccctccatccatggccttgtgatgatgatgtgaaccaatggtatgatagatagatagttcacaccttcgttgtttttttcctcttatgttcttgtggatggaaggacaactagaggtacgagctagctatgaagcaatcaactaagaacacaaacgcgaaggcaattaggagtagcagtagttaatttcttgaagctcaatcagttaattccttgtaattttccctctttatttaatttccaactatgtagcgacgaccccggatcacagagtagtaattaacttaagtagtgtttggtttggggacgaagtgggataggtcagacctatcctagttttgtgggatgggatggttccagttgtctgtttggtttatggtatgggatggttatagttttttgtttggtagaagggattgaggtgggatgggatggacggatttgtactcaccgttagtgccgtctaggggcggaggcactcggcggcgcccggatctgagaggaccggcggcggcgcttgcgaaggtggcggcggcggtcgtagacgaggcagaggtggcggagtttgtggagatggcggtcacggtgctcgtggaggtggcggcagtcatggacgaagcggaggaggcgccgggcgcggaggcgaggcggcggctggatctgagtggagcggcggcggtgctagcggaggtggcggtcgcggatgagcggcggcactcgtggaggcggcggcggcggccgtggaggcgaggcggcgctcgtggacgcgcggaggtggtggtcgcgggcaagcggcggcgctcatggaggcggcggcggtcgcggacgaggca

SEQ ID NO: 21369 - DNA, 23107 bp, Oryza sativa
aaagtgggttcgtcccatcccatcccatcccatccttgcaaccaaacactaccttagggaccgaattataaaaaaaacgaatgaaatcaaccaggagataccctggctatccgtaccgaatcgaaaatgggattcgcctaacatgaaaaaccgaatctagcacgtccgtccctgaactgcactgcagaattaagaaaatagttttctccaccgttggaagaggagaaacagaagaacacacacaccctgggtttgtttgccgtactgcaggtggttacacacaacataatttggtcgcagatatatatataactcctacagtataatgcaatttggctggtcggcgcagcgtgaattgtattgtaccgtacgtacatgggaaaggactaggggactgggcagttttggtggtttgagactggtggcttgcccatccatctccagctccaggtagttgaaggtctaagccaaagtagttagcggttgagcagaaacatctcgatggccatcacattgatctcactctcaactcgtcatgacaatccagtagtggaggaattcattcatcagcgacactccacctaatcaaccatctgctacatcgatccatccaattaggacaactgagtttactataccaccatcacacgctgattattgattaccaatacaaatgtcatttaggggaatattaattattaggacgtccaatatatacagtagaaaacggcacactgaggtactcccaacccatggtgtccataagcagtgtctatggtgccatgtcaataagacatcacaataaaaactacactctacaactcatggtttcttaaagtaggccattaataaatacaccatctctcttatctactccctccggttccatattaattgacgttttggataaagttgaggtcaaacttttataactttgatcatcaataaatttaaaaatatttagtttaaagaaactagaacaacatatatagacttgtcttttaaagcactataataaaattaaacatgcatttatttattatatatattatagtagaaaaataaggtcaaagatatatcttgtagaccgtgtcattgtccaaaacgtcaattaaaataaaaccggagggagtaccaatcatatttattcttcatctattataaagacactattctctccctatgcaaaacttgatagtgtctagtacataagttctcatgttgaagccgtgtcttgcatgagacccagtttcttcatctcttcgctctctcttttaattaatatagtgccacataagtttaaagttctacgtgacaatgtagttaatgctatagacaccatcttaggacacccacaatggttatctatagtctctctacaagagattcataccagcatattttcctacttgtaagagattaaatgaagagagagcaaagctatctactaacctgaagatggtctatacataaaaacgagacaatggattagagagctatagatactcatgtagacataccattaaagtggtttactattaatctagtctattgctgagatatacatgttttatagatagcaccttactttaccattgcggtactttaccattgcggatcctcttagttggagggctacccagatggtcgtggacacaactaaccagctgcatgcgtaaatatgtggagtggagtgaggcagtattaaatactgtagtataattaaaaagatgaacagtagcatggacgtctacacacaaccattatttaatttggcgatgtgaagcatgaggcgatgcgtcacccgtgccgtgcaaaaagcccttcataaatgttggtcaatactactcccgccagtacacatcgaactggaccagcctagagtagctaacacgagctgaccatcagcaaagcaggcagcattacctagctacagtaattaataacttaattgttggtaattagtactccatccgttttatattatatatcatttttcaaaaaaattcgaccaaatctataaaaaagattaagcaacatttaaaattagtttcattgaaactaccattaaatatattttgataatatattcaatttatattaaaaatatactataacttttttatagatcaaaacttaaaaaatttaattataaaaagaataaaataacttataataatatagtaaaacacagagagagtagcaagacaatgaatcaatgatgatgcatatgtatacgtaggaggaggacgactaccagctgcgccggttcctgcgcgcgagagaccacaacatcggcaaggcgtcggcgatgctggtgaagtacctgcagtggaagcgcgaggtgaagcccggcggccgcgccatcgccgacgaggaggtgcgcggcgagctggcgcaggagaagctctacatgcagggctacgaccggcaggggcgccccctggtgtacggcttcggcgcccgccacttcccggcgcgccgcgacctcgacgagttcaagcgctacgtcgtctacgtcctcgaccgcacctgcgcccgcctcggcggcaatggcgggcaggagaagttcgccgccgtggccgacctgcaggggtgggggtactacggcaactgcgacatccgcgcgtacgtggcggcgctggagatcatgcagaactactacccggagaggctggggagggtgttcttgatccatgtcccctacgtgttcatggcggcctggaagatcatctaccccttcatcgacgacaacaccaagaagaagttcgtcttcgtcgccgacaaggacctccacgccacgctccgcgacgccatcgacgactccaacctcgccgaggactacggcggcaagctcaagctcgtctcgccccttattaatggcgccaccgaatccaatcgccgccggtagatagctctcgcgtcgcgtgcatgaagatcgatatgatgtatgtacacccatctcgagatccaatttaatggtatgtatgtagcacgtgtacggtgtacgtgaatgtatgttactagtatgtatacgggacaggaggacactacgaattcgaggacgtacgtgcgtgctatatacattgaattacggctctgaacagtactgatcatgaatgatcactgttgatgagaaatgcaagttcgtctgcatcaaagcatgcatcttgttggcaatcaaaacatatactccctccgtcccataatataagagattttaagtttttacttgcaacgtttaaccactcgttttattcaatttttttttgaaattattatttattttatttgtgacttactttattatctacggcactttaaatataacttttcgttttttatatttgcaaaaaaattttgaataagatgaatggtcaaacgttgtaagaaaaatttaaaatccccttatattaaacggagggagtacttaattatataatagtatgttgaaattaagcatgcatgcaatgcatccaaatgttgaaacagtatgaattacagtcatagtacgtctcatagacgaggtacggtggtcctggcatcagaacagacagtaacttttaattagttactgctcgcggcggcagatgcagatgcagggaaacacaggcagcccacggaattgggcaaacattaccaccagcagccgttaatatttttcgaccggaatcactgtgatgaaactgacactgaagagagtggtcgatctagttgctcgccgggagatattgaactatataccacttttagacgtggcaattaactatttgccattagactcatatattatagacacatgtagatccacatgttattgagatagatgtagcaaatagttaatcgtcaaatctaaaagtggcaaatagttaaatgccccgctcgccggacttgccgtggttgacctgctgccggcggcgaaccgtcgcaagtgtttcatgcgttccaagttgtcattactcctttgtactctctccgtcctataaaagacgaatctaaaacccgatacaacatattataacactatgaatctccgatactagattagttttttacgtgaaagaaggaaattaacatgggagcgccatggatttgactgacggcaggcctgccggcctgtacttattgggccggaaaggggttgcaatctccgtgcggcccaatgagttgggccgggacggccacgtggcggcactctaccggatcagaggccgttggatcgacgccgaaactgaatctgcaccgtccgtcgagcctgcggtcgtcacaggccggagctctcgacacctcgccggaaaccaccacccaccaaaaaatctcccccaaaaaattatcatcccgccgcgacgccatggccgctaccgtcctcctcctctcgccgcgcctcgccgtcgcgcctctacggccgcaccccaggctggggctgacccccaccgcagtcggacggcctcttcccctcgcctacctcggccgccgcgccgccgccgcgaggcagctcgccgccgtcgccgaccggaacgtctacaacggcgtctacggcccatggaccgtcgaggactccgacgtgcgcgaggtcttgctgtatcggtccgggctggtcaccgccgccgcgtccttcgtggccgccgcctcggccgcgttcctccccgaggggaacgccgccggcgacgccatcaggcaaggcgccgacctcctctacgccaccggagcggcggggctggggctttcgctcgtgctgattcacatctacgtcactccgatcaagcggttcctccaggcgctgtgggtggtcggagtcgtcgggtccatcgggacgtacgtcgccggcgcgcagccgctcgacgagagcctcgtcggctacgttctcgaccacccggctgcgctgtggttcgtcggccctacgtttgcggcgctcacaggcctcgtcttcaaggaaggtaccgtgcaattacacattgcttattactaccaaattggtacgacaattaaggagttctagtgtttatactgaacagatttaatcggagaatttcagttcattgtcgctgctgatttgttccctagctgagtgcttgtgtgtgttcagtgttagaattgttggaaatttggtcataattcggcatattttaatctaaaattttaagacaataaacatgacatttgtaatttgagtagatctagtggcagtgctagatgtgtataacatgagcatgcttaatatagaataagcatcaacatagataagagatcgcaataatattgcgacagacagttgtaggaaacgaagaacgaacggtaatagtgaaacgttataccccgaaaatgaccctccgctggagtttgaggcagtattgccttcgttggtgttgacgagaggctccttctccttgtctccggtgttgttgttgtcatcggttgtcgacatgttggtgaagatgatgcaaagcagtcgcgcttgaagcgctacccaaaaacttgatcgcctgcctacccgtgcaggttctcaagcggacggagtttcggaggcacttgctcgttccgatcacccgtgtgcgcgggatgaacagaaccggagaaacagagagacagcgcaggaacagaaggagagtatcgccaaggaacaatagtaggaggaagacacacactttgagagcctctgccttgcgttatatgtagagagagatctccattaccacacaaataaatctcatttgttgtgaaggttaccacaaaataaatctcatttgttgtgaaggttaccacataatgaatctttcatttgttgtgaaggttacaacaaataaatctctcatttgttgtggatgttacaacacaatgaatctctcatttgttgtggaggttacaacacaatgaatttcatttgttaatggtgattttattctcgtctgttacaaaacgtaagagcagcaggcaggctcggctcggtcggccgcctcgcctcgctacgcccacggccgaggccgactcggcatgcgcgcatgcgtgtggcagtccaaccatcacttcaaccggtcaacagggaatctctaatatcccctatttaagttaggttcttccacctaattttcaaggcagtattattctctctaacattacttgtgggctcttgagattttaattgaattaaattgggcctagcccatttattccaacaagaatgagcaccaatttagtggcctttttcatttttcgttggatgcggattgcatgaatgaattgcttgaacattgaactgaatcgaattattcattctctgacaaagaatgcttctacaggtctctgctatggaaaactggaagctggtattttaacttttgttatccctggccttcttcttggacacctggtaaattaagcctctgttatttttgttacaaattcaatatgttataattagtttcaccttgttcactcctagagaagttacagcaccagggtgcattagatttagagcactcattcatcatttcttacatttgtcttgtcaccacctcgtgcagtctggtctaatggacaacggaacaaaagccggccttttaggagtttggatggttctcttcactgtattcgcagcaagaaaattccagcagcccatcaaggtacagattcctccaaattaaaatgctccgcatctagcttcattactaccgagtacatatgttcgttcctcacttacaacattacaatattgatgatcaatgtcatcctcatgaatcaggatgacattggtgacaaatcagtttttatgttcaacgccctccctgaagaagaaaagaaggccttgatacagaagctcgagatgcaaactgagaccgatggctgaaaccagcacagcagctttagtacgtgtacgtccaaggaagtatatgcaattgatgtacatgtatggtagtttcacagataccggcacatgtcagtaagagtagtaactcagtttatacataggaatgagaatgtactagctagagtaattgcgatgtgtagttgcaaatcagatataaatatatatacatgttgatggatctcctctgggtatctgatcagagaggggtcttaccctgtacaactgtctgttctcatgtgattatcttctctgtgccttacggtgtatatacgtgaatttggttattcctttgtgtgtgtatacctctgatgtgataagaactactccctccgtttcacaatgtaagtcattctagcatttcccacattcatattgatgctaatgaatctaaataggtatatatgtctagattcattagcatcaatataaatatgaaaaatactagattgacttacactgtaaacggaggaagtaaaatttagtccctgatccaaacaggccctgaaaccaatcgagagggggtgccggtacgtgaatactactcatgcattagtaattgctatgaatggtctcttttgatgcataattaattgaatatatatatacaacctagtgctacctccgtgtattgatccaggggcgggcaccgggtgagtcgatgacatccataaaccagtagaagaggttacctcccagcccagcgcatccagcgtagtacaaggtgccaagcttgaacaactcagagcggctaagcgatactctctcatagtcattctccatgatatcccgttgaacgtagcctgttgcgatcatgacaccaatccaacccaactcaaaaatcactctagcaaacggatccgaatctcgatccccagctcgaggcataattaattaattaattaatatcctccgaaatcttaatcttaatcttaatttcctcgctctagatcttctcttgttgaagaggccgatcaatcgattcgagaacacctcacctggctgcatatatatacacatagatcgatttgcctatgttaggtgcatatatattagtataaagaataacactgaagggaatataaaagctgcatgcatgtatgtatgcgttctaatggcaaaatctcgtttaattaatctgccaatcatatttgggggaaaaaaagagcaaagaaacaaacatagatgtgatgtaaaaccatcgatgatttgctgtacctacggcgagcgagcgatcgatcgatcgaacaaaccaataaattattgggagctgggagaggaaattgcggcgcggcgaggcgagatgagatggactccgtccgccgcccgcgcaagcgatagatgcagcttctattctagctagggtgtcaaaacgcaagcgtatactttgagatttatttatacagagaatcgacttttgctgggtcgtatctgatcagaatttcgcaaaaaccgaccggttttcacaagcttgattattggtaattaaactcatgatatttatattcaaatattagtttatgaaattttttcgaaatctaccaaatttgaatacaaatatattccgactggtagatttaaatacaaatttggaatatatttgtatacaaatatacaaatacagatatattctgactgagattcaaatacaaatttatttgtattcagaatatattccgactagtagatgtttgaattcgaatttgatagattccgaataaatttcataaaccaaaatttaaatataaatgtcctgagtttacagataaactcgcgaaaaccggtcagctccagcgaaattccggcccgatacggcccagcaaaagtcgattcgccctgtataaatataaatctcaaagtatacgcttgcgttttgacaccctagctagaatagaagctgcatctatcgcttgcgcgggcggcgcacggagtccatctcgcctcgcctcgacgcgccgcaatttcttctcccagctcccaataattttattggtttgttcgatcgatcgctcgctcgctcgccgtaggtacagcaagtcatcgattggttttacattatatctatgtttgtttctttgctcttttttccccaaaatatgattggcagataaattaaacgagattttgccattaattagaacgcatacatgcagcttttacattcccttcagtgttattctttataatagatatgcacctaacataggcaaatcgatatatggatatttatatgcagccaggtgaggtgttctcgaatcgattgatcggcctcttcaacaagagaagatctagagcgaggaaattaagattaagattaagatttcggaggatattaattaattaattaattatgcctcgagctggggatcgagattcggatccgtttgctagagtgacgtttgagttgggatggattggtgtgatcatcacaacatgctacgttaaacgggatatcatggagcatgcgtatgagagattcccgcttagccgctctgagatgttaaagtttggcgtcttgttctacgctggatgcgttgggctgggaggtaacctcggctactggattctggacgtcatcgactcacccgatgcacgcccctggatcaatacacggaggtagcactagccactaggttaattaatttatcattattatcaaaagagaccattcatataagagtagctacaatagcaggctataagccagctgcaaacatattttaagcagataaatgaggagagagaaggtcagcggactacagatttgtagccagctgtagcacggactccaagatacagtgtgtgtatgacatgtgggaccagatattaatagtgtagtatgcaactattgtataaatgagctattagattggctataaataaattggagctagtagttggctatactattaaacttgctctaataggagtaaatggtactatatttacataccgcctgtcgatttggtttgagtctcatctatactatttggtacatcatttggtttgagtctcatctatactatttgttacatcatccgtgtccgagtcgattttaagttcgttcgttttcggaaatatagatctgtgtttgagttcgattttaatcccgtttgcttttggaaataaaaaaaagtcgtataaaaatcacttttaaaaaaactcgtatgctaacttgagagatgaaatacgtactcaatcacagctcatgattttcttaaaaaaattatccaagcgaattcgtataatgaattttaccctaactaaaccgtataataataataataaaattaaaataatatttacccgttgcaacacacggatatatttttaaagtcttatatataacagtaaatatgatatgccgattgagttgagttttatatctcataatgatgatgatgatgatgaaaagtgtcggtagtttgatcatataataagatactcagttcggccataaatatttaatatttaaaatagtattcagtctttttctttaaaaaatgatcttcaatactaactattaaatgttttttcaaggaaatatataatttggtttgtgttgtaaatatgctacggttgcatattagatttcataaatttattctcacataaattaacttaagagtcaaagtttcaaaaagttcgaccgaatattgtttgaatgtcaaatacttatatataacgtggggagtatattagtagttactactaagctaataataatggagtagttgacaaaaatcaaggagtgaacaaagaccatattaaatgaatacacaaaaatcaaggagtgagcaaagacaatctgaaatgaatacacgaaaaaacgagtcgacaaatgttacaaaattcatgaaaataaattgtcccattgaaagttaaaattgagcgtaaccacgtagtactgttcagaggggggggggctcctcacctgaattttcattaaaaggggcggaaaagtacacagattacatttacatagggggagagatacgaagggaggaagaaatgatttccttccaaacggaaaccacaatcctgtcgtctatcttcagacgctctgcccaatgagcagcatcttctaagcactttgcaactaggcgtgggagagatatcgacatccctcgaaagatcacatcatgacgatgattccacaatccctagaagcagagtaggaagaaaacttggaaatgctttgccggcagacagtggggcttctgaagttgagcgagctccgacatcgagttaatagcagcctggatccccattttctgccagaatgatgcagcgaaagcagaaatggaaggctgtttcttgttcactgttacaaagctcacaaatatctgaggtcacgattttcttcttgaggaggttttgttttgtcgggagccgttctttcacaagtaaccaggcaaagaattgaatcttcggtggagctttacttttccagataaacttccagtttgcacagagaggttggctttggaatgacgattcataaaccatacgagaagagagtaaactccctgcagcactattcgtaatctttctttcatccagggaggggattagcgaagtggaagcaattagctcttggagctgatgaagctgtgagtttcagccttgggacaaaacaggcttgcgagtttgttgaaagaacttggtagactgaggcttgcttgtctagtgcatgagtaaacagagctgtgaatttggtacttaagggaccgcagtcgagccaggagtcatgccaaaaagaagtacgctgtccatctccaatagctactgatgttttggcctgaagaactggaactagagccgccattaaccaatacgaaatttaggacaaatgctacaaaattcatgaaaataaattgtcccattgaaaagttaaaatttgatgctgagcgtaaccacgtaaccaatacgaaaattagtgactagatctcgacacgttcaaaaggcaagctcacattatacttgcagattagacttctattcaggacaaattcgactatgagtgaatatcgatccctgcactccatgggcaaaagcagagaactaaggcctggtttagttcctaattttttctcctaaaaacatcaaatcgaatatttagacacatgtacgaagcattaaatataaattaaaaaaataattacacagttaggggggaaatcacgagacgaatcttttgtgcctaattagttcatgattaaccataagttttacagtaacccatatgtgctaatgacatactccctccgtctcaaaatgtaatcatttttaactatgaataaaatgcttatattttgagacagagggagtattaattaggctcaaaagattcgtctcgcgatttttagacgagttatgaaattagtttttttattcgtgtccgataatactttccgacatccggtcaaacatataatgtagcactaaatttttttttcgcaaactaaacagggcctaatctagctgccaattatctaccaaagaagattccatgtcacaaaattcgcaacacccccaacatgaaaaaatatggtacgcatttgagtgtcaacgcgtactgtgaagatgcaaattaaggagcaggcaatagcttggaaacaccacagcaccagcattatcaacagtcacctcggtcaaaaactaccagcaggttaatgcaataacatgcaagtgatattgacatgatttgggttaaacgaaggaatgctaggaacagaagttttcatcaaatcgaaactagacaagccagattgtttctcggcagttacctgaagcccatcttcaaatctctcactcgtcctttcactcaaatcagcaagtatcggcaaatatgtatgaactctcgaaccaacaatgctatctatctatgctacatttcctctcctttgaatgacaaataggtcgggtcctagctatatatatcctgcatgccgcagcttctggggtctaagcactgagtgaaaggagccttgatccattggattcatgcactgcaggatgactggtactggtggtaaggagccttgatctattgaatccagaaatttgagaactggggaagactactgatggctttaaggagccttgattcaccgcatcaataaacttgaggaagactactgatggcactaaggagccttgattcaccgcatcaataaacttgaggagggctgctgttaggggaaggttcttgctattgttagggctgtaagggggtgcagtgaacccttcaaactttgtcaatgccatgaacaccttgaatgtgggggcgactggtatggcaacctgagagtaaaagcaatgcaattttaaagatattaatgactgtatggcaacctgagagtaaaagcaatgtaattttaaagatattaattaagatagtaataagcatggacagagggctatactttcacgaagccagaaatagcactaactccaaatgattaattcagtacatgatctgaaaactcattatgaaaataattcagggataaatacctgaacaaggaattggaaccctcttccaggaatagcaacattctgaatttcatcgtttgaagaatcactgccaaatacctcaacaaggaattggaaccctcctccagtaatagcaataatattgaattgaaaaccttctccaggaatggcaacaatatcgtgaatggctccttcatcgtctgaagaaccatggtcattgctatcatcaaacatctccaggttcccatcatgccaattgccccaaaaatcatcagcaatgtcgtcccctccattgggatttctattgttgagagcagctgttcttttcttgtaaagaatataggctactatgactcccacaacgcagactgctccaacgatatagggtctcaattttacatcggacataatctctttgaccaagccaagaatgtgctgacttgagtacacagatagagatataggcatgatagtgttgcagtcatttggtgttgatgaagttctttgtaaaggagtggtgagcagggtactctctaaaagagtggtgatctctgaaggagtaataagctcaatgttctctgacatcggagtagtctggatggtttccttaagaacattagaaattcgctcaagcacctcgggaggcagctgaataacctcctcaggcagctgaagagcctcatcagcgcttggcagtggcaactttccctcatcagaaatttcttctcaaacacctctcgaacaatatcagggttgtttttgacttcctcttttacttccctaaagaaccctcgtaggaaagttcttattagggtgttaagagtcgacgacattatgctttagcctacggatcaaatatttgaaaatgtattagaaaaactgaaaaagaaacacaaatgcaacgaaatctcataaaagcgtaaaagaaatcattggatttggaaatttaattagaaaaactgaaaaaaaaatcacaaatgcaatgaaatctcacaaacaagagagtacaaacaaaaagagtaaaatatattgccggtccttaaacttgtgggctgtaaacttgttttaatgtaccacccccagttcaatcgttctttgaccacgtttgaccaccaacgtggcatgccacataggcaacatttttgtactcagtcccccgacccctccacatataccttcacacataactcgccctgacccgtgcatttcaacccaaatcccccaaaatatctctaaattaactagggtctctacggtgaggttagcagaagtaggccgagaggtagcggctgtggcggcctcggcggtgagattagcggcagaaggcagcgcagtgcagcggggttgggtgcagtgccccttgtgcaaggataagatcattttgaagtgcagagcaatgtcaattgctaatagggcgtgcattttctgtacacgcaaggagaagaatgagagggaagaatgatttaaggattttttttttgggattctggtgtcactatatagctacgaggagatatatgcgacgtgttgtgatgtggagggggttgagaacaaatgtgttgcctacgtggcatgccacgttggcggtcaaacacagtcaaatgacatttggacaaggggtggtacattaaaccaagttcacggtcctaaacatgcaatttcaagttcacggatttaagtgacactaacacacaagtttaggggccggccatatatttcactaaaaaaaacccaaagcccaacaaacaataggctagcttaactattgccgatgatggcgtctccggcgttgtcttgcggagtttgatcaagcgcaagagcgacagaaaagttgccgaggatggcatctcgatcgagcgcaatacaactcagaaaatcactagttgccgagcatggcatcttgagcgtcttctcgacggaattgggtcacgagagctcaaaaaaccaacccaagagccaccgcaaggaatcattaaccgggcaattgacgaaacatggctatggcgcgcaagtggagcgaaggtaatccagtccctactgccagatacccgtggtagcacaatcaataatccgtaatcaagaaatttatcttttcgcaccctctactcctctagtggtcgccccctccccaaccacgtactgtttctctctttttttcaattttataagctcctagcctcacggctgttgtatagtgtttccctctcctttaatacgaataggttaaaaaaagaaaaacaacccaagagttcgatggagcacgggagagacgcagaaaaccacaagtagccaagaatggtgtcttttcggcggaattctatcgcgagcgtgcatagcgcaaaaccgaagagaactcatcgaaaaaaccaaccaaacaacaaaatcaaatgggtagctggtcgcagtgcagaagatgcgtcagcgtcggcactcgccgcggcttgcaaactgtgaaccaaggccacggcggtttttgggcggaggcggagcacgaacggaagagaagccagaagacgatgtacgcgcatgaagcgccttggagaggtggtggagacaggaacgtaaaactaacaacaagatcagcaatcatccaaaatcttgccacgaaacgatccaaagacttccgaaattaaatatgttcgagcaagatagctcagtaaaagcaccaagtccatttgcgaaaagaagaagaacaccgcgatcgaaaaactgacagctcgcactcgcagtcgtcacacgacaatatctagctagcatcatcgcctcatcggagcaccaaaaaaacgcaaaatcgacggagatgagtaccacgaacgaccctagcatcaacgaaggggaaaaccacgaagaaacacacacacacacacaaaaaaaaaaaacaacaacggagagagtagcacgaacaaaaccatagcatcatcggacaggaaacaatcaaatgagtagcagcaaattccaaaatgctcaaccaagcgagccgaatttttttttcgaggtacacagaaattctcaaccaacagccgaacaccaaaacacgatcgaagaatcggagaggagagggaggggcggcgccacggcggagggcgctcgtcggcgggctgtgaaggcggaggagcggtcagagaggaggcggagaggagaggagaggtacgcaccaggggcgtcgtcgccgacttgcggaggagagcacgcgggagcgggacgacggcgtcgcggcctcgcgagttggtggtggccggagatggaagtcggcgcgccacgggcgtcgtcgccgtacttgcggagcgagctcgggagcgggacgacggcgtcgcggcctcgcgagttggtggtggccggagatggaagtcggcgcgccacgggcgtcgtcgccgtacttgcggagcgagctcgggagcgggacgacggcgtcgcggcctcgcgagttggcggtggccggagatggaagtcggcgcgccacgggcgtcgtcgccgtacttgcggagcgagctcgggagcgggacgacggcgtcgcggcctcgcgagttggcggtggccggagatggaagtcggcgcgccacgggcgtcgtcgccgtacttgcggagcgagctcgggagcgggacgacggcgtcgcggcctcgcgagttggcggccggagatggaagtcggcgcgccacgggcgtcgtcgccgtacttgcggagcgagctcgggagcgggacgacggcgtcgcggcctcgcgagttggtggtggcgcggagcgacgccgacgtagcctctcgcggtggaggcggaacagccaggcaaccgtcgccgacttgccgaggcggaggcgctgcgctgccgctcgactcgactcgactagtagaactctcgcgttttagtactcacacgtggcatctcagcctcgcttttaacacatagacgcacaatcagtctctaaaataactcaaactctcaaagatacggcctcgatcgtatttacaaacgaaatatgatttataaataaaatttttatacacgtcttcatagtgatctaaaaacaaatgctaaaaaaataaacttcaataaaaaaatccaaaatcaactctaaattgaaaattgaaaattcaaaatttactgctcgctgttaagttgatgggacctccggtgaacttttataatttggcccactaacggtagaatgcacaacctagactcactaaaatcctatattgagactatatttgtctgcgtggaatatttatgattatatgcgtgatatttatgatcactagcgtttaaaccttagtaagtgaaaccatacaaatacaactatcacatcactggtgcttccgcaactgtgatagggtttttaaacttgatatcaatgtttttttcagggaattgtttcaacaccggatcattctttattccaaaagataacaaacaatgttatttacgatcgcaccgctggtattgcagcaaacttaacattataagtgagcctgctatgcgtgattatcattaacacagggtgctccttgtagggctcttacaacaccagggaattcaccatttcacctaggtggcctaaatgactatatgcctgaatcacctttaaacctatccaaattccaaagatacaacaatagcaggaaatgctaagtcgactagtttccgtaaatgacaccatttgggctcacaggagagccattgtgttgaagatcctcttcctcaacttctgacaagaaaccgttctcaaagaatgctgaatgaagggcctgtatacactgtttcgcctcgctatcatggaccaccaatgaaatgttcacctgatcacgcacagtgagtattgtcatacaccctttggtcatttgcacaaaagaatttcgttcatctggggaggagagatggataccttggatgccccttgtgagatcatctggacgttaacgccatttctccgtagaacattgaaagcctggcgtacagcaacaaatgtaaatgattagatgcaaaaaacaaaccagtcaatgccctgcaaaaataaaagtacaccctagcatacaggattgcaagtaatcgtgttcatcaacaatatgtccaaccagagttttcggtggctaagagataataaccttctcaagaatcaatgacgatctctgtacattccctatcagtgagatgatagacctgtgctgcagtagatgaacaactgcaattttttcaagttcttcaactacatgatcaagttcctgccacatcatcccaagaaaacaaatgaatattgaattaagagaacagctggtgcagtacgtattttcaggatgtatcagcaaagtgctaatcctgcagaacaacttgaatccattatctgttctttttaagtttaaattgccctaacaggtttctagatgtgggctatctactgttccaagtatctatattcatcaaagccaaagaaaactaaaaatgaaacacattcagctattcgcaagcaattcaaacttcaggcttttgtacaatattttattcatacccccaaacccaatgtttgacacatcacacatgtatatcgaaacgtgatctgtctcaaactcacctgctggatcaattcacgacaccatagttttgatggatctagtgtcaatgatatactgacttcactggtagccacacaatcaacagagatacctaaatcttcaaatattgagaaaacctgcacaagagcataaaaatatgaacaaattactaatatgcataagtcaacaaaataaacaggaagagcaatgagcatattaaaataccttcgccagaaaaccatactggccaagcatccttgtgctcactatatccagcatagtaatgtttgacttcaatacaatgctggttaatatactctgaaaaataatgtacacaaatcagaaattaacaagaagtatttacaaacagacgtatcaaaatctattcatatgccgaaccttgctcaaatctcttgttttagtaataacagtaccaggtgctcgacggttatatgaattcttaactctaactggtatatcaccttctttggctggtctcattgattggggatgcaaaacctaacaattggcaaacgtatttctgttagggcaacagtagttgaccatgctatctcaatcaccgtgagagtgtcaaataattgtatcaacacatggtaataagctctacaatacctgtgcaccaaagtaggcaagttcagctgcctcctcaaaagtcaagtagggtacaggtatcgcgttcgcacaaatattaggatcacatgtcaacacaccatcaacatccttccatacctgttagagatttaaaaagaaaaagagttataacagccggtaaaacctcagagacaccacaaagcatatctgtagttttcagctgatatggttaaacatctaaccaacttcctcaattgcagaaccagaacgaacacaaaactgaaggaatgatctaagaaaatgtgtttacacatagaagcttaaaggtgttgaatgagttctgggagcaagtggattttcaacaggtaattatcacaaacttaggaacacaaacctggatctctcttaatcccaacgctttgccaatggtggtagcagtcaagtcgctgccacctctgcctaaagtggtgacagcacatgatttccatccctgcatttgatgtgcattatcataaacacaaatataacaaatctaattcagtgcagcatcataaatgcaaaagaataggcgcgatggccttaaacatgagtaatgggaaaatgcatacttttccaaggaaaccagtaactataggaatagcagggtcgtcaatccaatcaccctgtaacctactttgcaacagcaggatatgtcgcttcaagaatgtccgcatttgtgaaatcatcagtagttataaagccaatatcaaatgcatcatactgcaatcaagcaaaatttagttgagacagcgtcaagctaaaacctggaccaccatcatataccaataactgctcgcactgaaacttcatgtaaacgctgcatgcttaggaacttttaggtgttgatggaacaaaaaggtaccaaataacaattaaaatatactcattataataacaatccattaaaaaagactacacacatatagaagcacaataagatcaacttactatggaacaccagcattgttcctatggtgaaatgaatatgagaaattaaaaggaaacaagaaaaaatgaaaagaactatgaaacaagaaaaaatgaaaagaactatgttttagtggattactcatgtatattttataaataaactgatcgcacgccattttttcttagcaggtttcagttggcagtttaaaggaaagtgatcagctctattgataaggaaagaaatttcttagtttgtgctattgcactagcaataaccatgtacaatctctataaatcaaatgagcaagggataaatgtaatgaagtcccccaaattaccttattcctataacctagtcaatttgctacggtagtaatattctctcatttttttcacaggtccagatgttgcttttttagatagaatatttgaattatattatcatgaaaaggatctagaagctaaattgaaacaaagcactcaacaagccttcaattaaactactgcaccaacacatttactagaagcatgtacctgccgagcctttttcccaagtttattcaaatatgcagcaaatattcttgtagacatgcattcaccgaaggaaacaaggtaatcccgtgtcctaggagttagttctttcatcatagcaacacccttaagaagttgttccaattcttccaataaacctgttgatattaacagtgataaatacagtgcttttatagatggtacagtgctaaagaaagtacttccattaaagacaaaagggacgagaaatgctacattgaccaaaaataaattgatgaccaatggataatatgctgaagaatgattggtgaaagtttaaaatggtattatgatttataactaaggatgcagcataccatgtttcagctgtctaaaatctttcatgtttaaaacatggtgggctataaaacaagtagagaaacctgacaggtttagatcatgagagaagccacatgttccatttcattgtcattagattggggattctaaatagggtaattggagtttattttccatacttgctgcatttaaattatttggttgttgtatgtagaaactggaacaaaacaaacattacaatgtgttttcttccttgtgatgtatatcacctgcacttgccatgtcaattgctgcctcatctactttaagactgctcgatgattatgtgtccattgtatgaattcaaagcattgttagaataagtatgaacattactttagaaaccgctactttagttaaaccaactagggtggaggcactaagctataggatacacaagatcaccttgttgcatacagaatagaaaggtactctgctgaaaatgacataaaatgcatgataacgacctcaagtcttgtcaccaccatacaacattaaaggaaaattggtgttcttgtgtttattgacaatcctcaaccacaaatattgtctaacttctgaaatcaaatttcttcgtatagtaatgaggactgtttgtgtagctaaaaaaaaaatcccatcagagggtggtctttagtttatactgaataaaaacagatatgtggtttagtggatgacaatgccctaatctgaattacctgtagttttgatagaccatcttatggcctttaaaataataaggtcttctaaaccttacaccaaccaggactgtgaaatcgcaatattttgacgactatacatgtgccaaaagatggaaatcaatgcatcaacaagattggaatatacattttgcagtgtaggtttttgccaaccaaaggaaaatgggaagcttcagacagactaagcttccagtgatttttgtgtgtgtgttggttggttggggggaggggggggggattttgtgaaagaagcactggacaatacctgaaacaatcgatctatccaatccaagctcatcaatagtcctgagcaaagcaagaaaaattgaataatcaggagtgaatgctccgaaactaacctgaaatgacgaaaaatgaaaaacgaaacgcacctaacatggagctccttgataactgcgagctcgggaatttcagacgccttcggggcgccgcagctgacagccttctctccggcctgaacaaccaatcaaccactcacagttaagcacagaatggcggtagaaaaatccatacatttcagtttcacaatcacagcgagagctagaaatggttaccaggaggaggttattggtggtcttccccatggcggagagaacaacaacgggagtctcctcggggaagctgagtatgagatcggccacctcccgcatccgctccgccgacgccaccgacgacccgccgaacttcatggcgacggtgaaccccgtcgcggaggaggcggcggcggcggccaccgacgccgcgtcgtccttgttgaggacaaccgccgccgccccgctctggcaccgcaccaccaatcccctcctcctcgaacacctccctcccggcctcgccgccgccgcgcacgcgagatactgctgctccctccccaccctggggggagcggcggccgccggcgagtcccgcgcgacggccgcgaaccggagcgccaccgccatgtcagcaccgaccgaagcttctagatctctcctctcc

SEQ ID NO: 21370 - DNA, 3694 bp, Oryza sativa
ggggaggggaaacggacggcggggagaggcgggccgttgggtttacgcggccagtggacggcgtggatcaaactccgacggcgatcgagacgcggggccccaccgccgccgggacgcagaaaaatgggcgagcgaaaggtgggcggggggacgccgcgacgcgagtgggggtgggcggatgggagggcccacctggaagcgacgtgtgtggtggggtcttcacctcgcgccggttttgttttggaatccaccggctgtctctgtatgtcgatgggaacactgcttgcgattcctacgtcccactccaacattgccaccatgaatatgattggttaaccattttttatttttctctctagaaactaaactaaagttgattttgatctaagcttattagtagtactacattttctttggcatgattcatggctacatctttttttaagcattggcatggcttcagtaaatacttgctcgatctcaggagtatgttttctagttaatttagggcatgtttaattggggaaaagaaaaaattttggggtgtcgtatcggatgtttaaccggatgtcggaagaggtttttggacatgaatgaaaaaactaatttcataactcgtctggaaaccgtgagactaatattttgagcctaattaatccatcattaacacatgcaggttactatagtacttatggctaatcatagactaattagactcaaaagattcgtctcgctatttcttccctaactgtctaattagtttttatttttatctatatttgatgctccatgtatgtgtccaaagatttgatgtgatgtttttgagaaaaaaatttgtgaactaaactgggccttatgctatggtgatcttgttactagtgccaatgtttttcttcatgtttagagttgtgtggattgctgaattgcagggtagatcaggctgatcagtcacccaacaatgtaactgttatttgttataatcagcaggaaagctgacaagcacatatcacttgcagacaataaactgtttccatctttttatgaagaaatgatacccatatatactatcgacgaatgcaccaaacgaaaatctaaaaacctgccactttcagtcttttttttttggttttatgtgatactgattgaattggaagaagacaacaaaacaacaatagatacactgtggatataatgaaataaaaatcttcttcttcttcttcttcttcttcttcttttgaaaaattctggccatacgattgtcaaattcttcttacctgattttcactgacaaattgcatccttcatgcatcggcttaagcaaacaaaataaagagaaataaaaaatcgcaacggtgcaaacatgcaatattgatgcatgaggtgctcataggaggacaaaatgctcagtggaaatcaagtcagctggttaaaaaaagaatccaacaaagatccgtctttagcaactgcccctcacccaaaaatggatttatagataaacttttcaaaaggcacactttataaccgtcttgccattttctttttctctgaacattcatctcaagcttcagagtttcatagcattggaaaaaatatatacagcgtaggagttttattagctgaagggcctgttcactttgatgttattttcaaccttaccaaattttggtaaagttgccaaaaaagtggctatatttagtttcctgccaaattttggtaactatataagaaatcctgccaaaattttggcaaattgccaaaatttaccaaaatttgataaggttttttttggcatcaatgtgaacaagcccgaaatatataaaggaattgatttctgagtctactcccactctgaaagtttcatggttctctgaacccagcaagtagagcgtggtgtgatggtgtcttcctctttgttacttgatcaacagaaaattcagattcactttctctgaatacgcaacgcattcatgcttacaccatggcgcactcgtcaaataaaagaagaatcaagggacaaaacagtgaacagacaaccgtgaatcgtgaataaataaactattggcacttggaagatgtatgcaacaagaacttgaactctgttagtatctctttatgaatggttgagactgaacaagtgaacacagaacacttgtacatattgtggactctgaaaagaatccttccatattgaattcgatcttttttctgcaactgcgtcatctgaatctggatgctggttggagctggacttgtggattatttctggtcaaaattcgtgtgcaaactgttaggcctgacctgcttggaacatgccagctgagctgcagtattttccattcttcatgcatacaagaagcaagagtggacttgtctgacgggcaaaaagacccaatactggtcttatgctttatgtaagaagctcatctgcgattcctggtgccgaaagatactcatgtattctatataatataatgtataaactgattcatgctgatgccaactagtaaaagagaaaacaacggtataatttatttagccttgagagaaaaggacaggcaattagagagtgatagatttggttgaaaggtacattggcccagatcaatcagtggatggatcgactgtttttggttcgacagtgttctgtgccaatggcatcattcatgcattgaggtcatttccatgcactgtgcatatgatcgatgggaagagaaactgtagcaccgaattactagtggccacaggaaggcgagtgatcttcagatattctcttgcacacacccgttgtttgtttcagaaatatccatccattctcttgcgcccaaacagcaaggcaatgaccaacgacgcccagattttccgagtcccagttccgggtacaggacgtctgatcatatcaaaatccaatcaaaatcaacaggtttgtttttttcaggccggccaggaccacgtgaactggtcgagccttgaaggagacacctgaggtccaaggacgaatttacctacctgcaacaacgactaaacactaatcactaatggctactcctatggattattggtgctgctgctgcagcctgctcagcagtttgacactctccatgcaatcatgctcatcacattcctggaggagacaacaagtagttcatcatcaataacataagtacgcatagatgattattcaccaactctgtaaactttattactactatttaccaaagctcaaagctgcaattgcaagttcgcaactgcttgttgagactcgaggagcaggagtacagcacgaaatggatggaggggtaaaaggaaaaagcccatgggccgtaacccgtgttactgaagcctgggcccatctaagctggagttcagagagtgttgcgtccgactctaccgagtcaacgctcggcgacttcatcgagcgcccaaccggggatcctcaccgtccgatccgacacgtgtcggcatcgtgcctccccacagcggcaatcgaggagagagaggagcgcgagtctcccgaagccgcgggcgccacagttggtgaagggaatcatccactcttctctcccacgactcgtcttcgcccccacggattacgcatctcgcctcgcccccatggccgatctccacccgccggagcctgacaccaacggcggcagcgccgccgccgccgccgccgctgccgctgccgccgcgccgc

SEQ ID NO: 21371 - DNA, 14950 bp, Oryza sativa
ctagggtttcggggagccgcgacgccagcggcgacgagtcggacggcgtggcggattggggtctcccgaacggccggctccctgggtccatggggtatggtggcgtgaaggcgtggctggatggacttgggctctctcggtacgcgccagtgttcgagatccacgaggtagacgacgaggtgctcccgctgctaacgttggaagatctcaaggacatgggcatcggcgccgttgggtcgaggaggaagttgtatgccgccatccagaagctccagaggagcgacagcgtttcctgagttggtgagctcttagcttctattgcccccaatttttgtttcatttccatagaaagctgctagtttatggcatttgtcaacccaagtgtgtatataggtttgatgaccatctactccgctagttcgaaaggaattgtttgaacgaaatttgaataatgaatggaataaggtgaatcaactgtatttgctcgtaataaatgtgatcattgtttacttggttttgatatactacttcctatgctgatccttgtgctgtgctttcaagatttaaaaggtgttcttacggattgtcaaattgtactctcaaacccagtagaaataatcatgaaatgataatgattttgattagtgcacgacataaaaggctaaatatagcagactatgcctctgtaaaaccagaggcctcatgactcctacatgcctactgaggcctttctttatttggtcacaactgaaggccttaatctatattgtttggttagtcaacctacaaatttatgttggatatagaactataggtcacctttgttgcacacgaaatctagaagtgttatgcattgtgtgttgtgaaattggaggttgctaattgccagttgctaagtactctggttgatatcgttgcgaacctctattttgagaaagcagccaataattgcagtgtagtgataaaatgtaaattatgtggtcaactagtaaacagaatgaaaccaatccaaaatggaaactacttagtagcctcattactcattagtatgtggctatttgcttatctattgggcaactttaaattcggttgtcagagctaacctacttcatgttgtttagactggttttgtgttgtcagctgactaccttagcaagcttcttctcgatgacttctggctggcaccacagttttttggtagtgtagtaagaggtacatcatacaggcttagtgaggggcaagagctgctgagaacattcaaacagcttcttattaggacacatgaatttttttcttgtaaaggtaaggtaggattacagcttcgagtaggaagggcgcaaatcatactcggcaaaggagtaggtatgcacatgcagcaagacagccacacagatttcataaaaatcaatatgctattcatagtttcctttatggcacatcagcgcactttttccttgaatcttttcctgaccatggtaggtatatattctcaaaattgctcaggaccagtttctctattttgaccatacgttttaccagaaatcatgagaaatatgatatgtttcgaaacatgtatacattgttcacctcttgagctctgtttaaggtcattgttaaataatgcataaaattcaaccttgcaaaaggctatgaaaggtcaacacatgatccccatgaggaattattccatatcaagtggggaagactattctttgttgaaatgatttccaacaacagcaaaaaaaaaatcaacatcaggtccatagaaactggtatctaactttgtcctcaagtcaatcaacatttatctccatccgttgttggtctgatatagaatgcttaaacagaactttatggcatgaaagccattgaaaactattttcataaatgctgttttatgcccgtaaggtgttcatatgaaaagtaaggcaggtgattgatatcatcataattgaactaattgaaacagtaccaggctatgttccttatgggttccatccatctaatcagcaaaaaatagctacgtgttccttctgtcctatttaatattcatctttaaaattgttgcttatatttgtcagttcattgttgccttgtttgcctgtccgctcttccactgtacttgtcattgacatttcgacatgcttcaacttttgtttgcctattatcatttctatgtcatgcagacaactgatgtagggagttcatcatggcttattaactttcatttttatcaatgatttcaacatgttaattatcgtgcaaatacaattttcaatgtgttgaatttgtttatatcttggttgtgctaatatataacttgactatcttctcagaaacatgcggaaattctggttttatttgtaataacctttttgcaaatacacataatgatttaatttgtacccttaactgatcgcttatatttcaatgctagaacatgttttagacttgcacatattccttacatcatgtacaatctagtactaccatgcaatgtttctccaacttgtgttaacgatgaggtcaactggctaaaaggtggaaatggggggctgagcaagtacggatggcatgtatatttgaagtaaaagaagactttatgggcttgtaattgacagaaataagtagaccagttattttttagtactgccagattattttttggttgaaaagttgaatcgcattggtaaggcaccagattcaggtagtagaggtttcttttgaagtactcagccaattcttccttcctcacaggttatccttaatacctcctggtttaagacattctggatggcggcctgacatgaaggttggaacgatagggtgagagacattgatacatttcaaatgatagtgagtgggaccctttatccaaaaaccatagttttttgaatgtcacccccaagaaataccgtggttccctaatattatagtcttgcacttgaagaattttcagtgtactccggtgctgctctgttttatatgggcagattgtgtgcctgtgtttttgaaaggaaaaaaaggaaaggctacgagttgagtgtgcaaagctaaataaaaatcatccttgatattttttcaaagcttagatcatatatttttgggaggaactccagaaatactaaatatctaaacaagacgtgtgttttcagccgaagtgtaaccttttgtggcatggtggtggctgatagtaccacaatggcagattggcaatgacagaactgcagaataatacagtgtagccatagaggatgcctttggtacatacaagcgccaccaaggtaatcactgggacgttttgttacttagattgcttacctcattgttggtgttgtgaattttgatgatcactgatggtaaagaagagcaggtctgacatgggatagcataagaggtactcgggtagccgaggagacttgccagtagagcccggttgtcgctctcgacggagagagctgatgacaatggggctacaggcaaatcatccttggctatcgaagatggcctcttacttccatgcaagacctctcttctagtcagtcatctgcacttgcatttgtggctgtgtactgatggttgcatgcctgggcatatatttataaggaaggagcttctgactttggctggaggcagcgtgtttggcacaacaagaatatttggcccttgacaagcaaaaggtggcgatcaacggatcattggcctgctggatgtgagaatgtgagatgtgtatctgtgcaccttagctttttggagggcatccggggatttggattttatattcttctctgcaaatttctcaacgagtttgtcacatttgcttgcttatttgggttgacccatggatggacacccctcagccacttgggttccattccccagccacatgaatgaatttgctctcgtgtgaccgggcatatcgaatatggtacatgtgaaagaagagcatagcatggtatggaggaatgagataagtatcagatcacctacaataaggatcagatcaagccatcaccctggtcaggtccgtcgtgactgtacatgttccgaagaatggcaaaaagtatcggataaaaagagcagatcatcagactagctgagcctggcatgcgttatggccggcttttgaagagcctactaggcgagtagactttcgacaggtctgcctatctaaggattgatgagggctcaattatatgattcactctgtcagtctcctactattcttgttccatcctccatctgtggcaaaacacatttacaggccactctagtctaatctgcctcctgtggaatcaccttctcgtcttgctggggattcacgcaacctcagctaattcttcaagtaattaggacatgacggagcataaactttgttattacacgcagatattagttcatcatatctcaacaaattaccaatccattctaatcacccaatcttaatttatgaagtaggagtacatctgtgaaggagcaataagtatgtagatgttgaacagcaaagcagcaaaacgtaggggagagaggcatgaaatgaaaggcttgtttagttcgaaaaagaaaattttagggtgtaacaataaacgtttgactgaatattggaaggagttttcggatacgaatgaaaaactaatttcataactcgcctgaaaaccacgagatgaaattattaagcataattaatccatcattagtacatatgggttactgtaacacttatggctaatcatggactagttaggttcaaaagattcgtctcgtgattttcatacaaactgtgcaattaattttttattttatttatatttaatattttatatatatatatccaaagattggaggtgacgtttttggaaaaaaaataatttaggaactaatcaaggccgaagtcgcggctttgctactagctaaattccatttcatttgtactcctatagttgtatgtatctagtgggcacgagcacgaggggcgccttcctgtggagcacgaggccgccggactcctccatgctcagctcctccggcgccatccccaccggcagcgcccagtcgaagcagtgcagcaggttggccagcgtgaactccacgttggcggcgcccatggcgatgccggggcagatccgccgccccgacccgaacggcaggagctcgaagtgcccgccgttgaactccacccgcttcgcctcgaacctgtccgggtcgaacacctccgcctcctcccacctcgccgcgtccctcccgatcgcccacgcgttcaccatcacccgcgtcctcgccgccacctcgtacccgccgatcctcacgtcgcgcatcgtctcccgcggcatcagcagcgtcgccggcgggtgcagccgcagcgtctccttcaccaccatcttgaggtaggcgagcctcggcaggtcgtccggctgcaccatgccgccgccatctcggtcgccgacggtggccctgatctcggcttgcaccttccgcatcacccgcggcgaccgcatcagctccgccatcgcccacaggatcgtcaccgagctcgtcccgatcccaccgatgaacgcgtcctgcaattacaagcaaagatcgccgtcacgatcgccatgcgtggcaggtgtttgtgtatttgactagctgacgacgacgacgtgtgctgctgctgcttacgaagatgatggccttgacgttctccctggtgaaccggcgatcgccgtactgcttcccctgcttccacaggccgatcagggcgccgacgaggttgccgccgccgccgccggcgttgctgctgtcagagtcaagatgctgctcgatgaccatctcgaagaaggcgtcgagctgttggaagacgcgctcgcggtgggcgacgaggccggtgaggtggtcgaagaggcgggcggcggcggcgttggggaagaagtcctcggcggagaagctggcgagcatgtccatgacgtcgtcgagcaggtggtggaagcgcttcctgccgccgccggcgaaccgctccgtgccgtagatgctgccgaacgccaccgcgccgatgatgccgtcggtcagggcgaagatgtgatcgttcagctccaccggctccggctccggccgtgtcagcttcccgatcagcttctccacctgccaagtgccaagccatacgttgtatcactgccatatttcaatcatcaacacatctaaggtaaaaccctacagatttcactataataaaaattatggtagtacggagtagtaatatttatgatcgaatcttttattttgatttaaatgttgtcaattatttaagaactgtataactatttgattgatgtttgaaacgtgatgagtaaatgaatgtatatgcacttgattagattgcaaaatcctccatatatcaaccaatacgaattagatactataacgtttgatcatttatattaatttaaaaattagtataaatatgtaaaagtataaagttgagattttaatttagttgatgtaaaaaatcataagaaaataaattatatctatattttttttaataagacggatgataaatataatgttaaaagtaaacaacttcgtatattaaaaaatggaggaagcatgtaagtacattacatgatctgattaaggtgcaaatttgttgtctcctctctctcattaacttataacatctcaactaaactattttaatcatatttatgtttattaaagctggagatgagaaccaagcaccttctagattattaattttaatgtatagataaagtaattcacttgtcaaatccacttgcaccgatgctttccattttgtcaaatgcatgcaacttccccccaacagctagcgagatttccatatatccaataataggtggaaacatacagacgaagacaaaatcgcgaatctgctactcgttatcttcttccgtacccccgtcccacaaaaatccaagttttttatataataaatctaagataaaaacttatttacatttatgtacaagaaaatatatcatgccattttaaattggttttctaagggacatagggagtagctagtactatatctatcccaaaataattgcatttttaggatttaaaatttatcccaaaacagttgtcactctagagtactaattgttccatcaatgatatctcatttaaattgctctcaattttaccctcaaccaccctcacaatctcacatattcaccatttaatgaaggacatctttcttcttgaaccttaatacttaaaactataattatttcggtatggaggtaatagctagctaccagcctaccaccaaccaattatcaacatgtcatcatcaagggcatgtacaatgaaaatgtctccttcacctcaccatccaagcaggcctatcatacatgtgtggaaattttgcccacttggtagatggaaattgtgtgtaccacacagtagggagacaaacaagatgcaggctatcgttgtactgtactgtacctggtcctggcgcgcgcgccatgcggcctggacgcgcggcgcgctgaagagctcggcgacgaacagccggcgcgccgcgcggccgtaggcgtcgtacggcgcgaacgccacgtccttgtacccgtacgacagccgcatcggccccggcgaggacggccggctgcagcagtcggcgtcgtgcgtcctcagcacctcctgcgccgcctccggcgaggacaccaccaccgccggcaccgcgcccagccgcagcatcatcaccggcccgtgccgccgcgccagatcccgcaggctccggtgcggcagcgcgcccagctggagcaggttgcccaggaccggcagccgcgctgggcccggaggcagtctaagatgccgccggcgacgacggccgccggtgttcctgccaattaccaacaggagggaggcgattgggaggaggaggaggagtaggaggagctgccattgttgaggcagagctaggagcttggagagcagcgtcgccatcactgggctttgctattgctctcgctctctcatactcgtcctatcttacgtgtatgaccgacctgccttcccgttcctgctagcttctggtggtatatataggaagtggattttgagtcctggagggaatatttacttgtgtccgtatgttacttaaatatagatatgattttttttaaaaaatataagaagttgtattaacatgtaatatatataagttcaaattcaactctgcatatgcagccgttgagttatttcgcgttgcagatacgaacgcgtgttcttcccgaacctgtcgagggggttcggagttttattccccgaaaaccagctagctatttatagcccatggttctttcagcttactgggcctgtattatttgattgggccttaatgggccaagctccaggcggcccgcctacacctactggattctgacgtggggcccacctgacacgcttactttctcgcccttttggagctccctcccctcttcgacgattcaaaaatccctcttctcctgtccgcttcctctccggccgccgccgctagggtttggtttccgccgcctcctccggctggtcccgtcccgcccgccgccgcctctgctctccttgttccggtatgcctctttgactcccgacaccttcatgcttggattttccggtaatgctgctgggttccgccggcgctgatgaccagcgaccgcctcctccgacttccgtatgcgcgatttcgtcgctgccgcgagctgaggggtcactcctgtagtagtagcgaacgccgatacggtgagtgccgtacggagtggcctaccgagtgactgaagtgtgtatgccgtagtagcgtcctgttttttgatgactgtggggagagtttgacatatattgattgaagtacctaagagctaagttcagtgtatgtagtgagtttgtatgtcattccatgaagttaattttccaatctttgacgtcctgaagtattctgtagttttataccaacttttgtgtatcatcattttaaacaatcgtgtatgaaaattgaaatgcagtttgttgacttgtactgcttatagctgattcctttctcatcttcctctaggtcagcaccctgaaagttgcacaataaccctgagcagtcttcaccaaggaaacgggctgtctgcttgtctgatgtgctattcttgttctggtatataaatcggctgctatttaggacacttcttgattgaaaatgccaacaagaaaaaaaggccttgcaagaaatgccaccactgagcatatcaatcccccaaatagccgaaaatcaagcagatcaactcaggctgcagctgctgaacataaagtcaatgatctgatcacttcttcctccaaaaagcagatcggtaaagtttcccctactattatgtacagtacaaagctatagcctatttataggaatgtatgaaactatgagtatgggagagtaaactgaaaacttccagagcttttcatcctacttgttgtgttctgcagtgctcattatatccaagcttattcctgatgtttaagtgccttttttttgtccactactacaattatgcttggtattatttgggaaattattcttcaattttcctttatctttagttttcttgaaattggttgtggctccacatagatttttcttgattttgttccaaatatgaattgctacctctgcaggtggaggccttctgaagaaaaatcgagctcttaggggtgggaaaaaattgaattctatttatgattctgctggtactggaaatgatgtcgcgggcgtgccaagtagcagtttcttcaatcacaaggtaaagttctttctgctcaaagtgaattttttagctggtcaggtgttgtctatttgtgtaatcatacattttaacatacggtgtgtttcgataaaagcgaaaaaagaaaaaagaggaaagcaatattgtttctgaaataacctcaaattgactgttgctttatcctttacttatttgtctggttgatctttttctattgctagcaatctcatgaaaatgatgaagatcgttcatgtgattccatattttctcccagttttcacaatcagaaggaagatgttactgactgcttgagcgaaggtaccttttgaatataactccaccttagcatttattttctgcactccaagtgtcagatctgtgtttgaatttttcacatgcatttatctagagaataagaaaaacaacattttttagatgacttcatgatagtgtacattgcatatttagatgcactctgtgcatactgatacctgctgcattgcttctccagtttgtattttccaatacgccattgtcattatgcaggcttagtacatgaagaagtcatacatgagcctgttcagaatgctgaatatgttaccaatagcatatcatgcaatacttttgatggtttgagcaaacactcttatgatattcatatgcaatcggcatgtggaagcacgctcgaaggtgatgaattcagtgaattgggcagcctttctcctgaagtgtctgctatatatcttgcaatgcagcactcaaagctagagtgtattgatgaacaaagccaagattctacctcaacagatgggtgtgctgatcctgatgaaactgtagagcttgattattttgatccgtatgccttcataaaagatttgcctgatttatctttggtggttcccaagtttcaacctgttcttcttccaaagcaaactcggagctgtcctagaactacccttgtccttgatctggatggtaagatgtgaatgttgtgcacactttaacttggatagactcttggtaaactcctttaatggaatcattaatgattatgtttcttccaaagtcaataatctgtgattagcttggaaatgttaaagctcatgagacctggattttgcacagttataagtttatgtcaaaatggattgcatattgttattaggatcgtgtaacttgcttattattccacttatgatataattgtaaagcatgttgcttagcttttagtgagtactccctccatcccataaaaaaacaacctagtaccggatgtgacctctgtctagattcgtagtactaggatgtgtcacatccggtcctagattcgttttttatgggacggagggagtagagaacatccaccctatgagatgtgtgcacattcctgttctgtttagcttcaatatctccggttgttcatttacttgatcatatacagtctgtcctgttgtttggtgttagccattacatgtaacctctgtactttatattgtgcagtcaatgttaatgtaccattattgttatgctgtcatgcagagacactggtgcactctactcttgagccctgtgaagattctgacttcacattcccagttcattttaatctcagagagcacacaatctatgtgcgttgccgtccatatctgaaagagttcttggagacagtagcaagcatgtttgagatcatcattttcacagctagtcaaagtatttatgcagaacagctacttaatattcttgatcctaaaaggaggttgttccgccatcgagtttaccgcgagtcctgtctctttgtggagggaaactacttaaaggatctatcagttcttggacgtgacttggctcgtgtggtcattgttgataattcaccacaggtatgtgctaaaactgtactccctccgtactcgtaaagtaagttgtttaggacagcgacacggtctccaaaacacaactttgacttcttatttctataaaaatatttattgaaaagtgatatatgtatacttttatgaaagtatttttcaagaccaatctattcatataatttttacattttgaaactcaataacttgagagttattcatgatttatattcccaaggtttgacttaaacattgtcctaaacgacttcctttacgagtacggaaggagtacacatttcttcctttttaagaaaacacacatctttcattccatgggttttaaaaataatttctaacaaagtagtgggatgttaaagcaaacctagttatcaatagtctctttgcgttgtttagcattataatttgtaatgtgtaaatattgggtgatagggctacatatgttagctcgagggtaaaattcataattcaacattctaatagtagacatggacttgatgaagaaaaagaataaagttttttttttttttgggtcagtgatcaatgatgtttgtattagtcagtttctctgtcttctcctggcagtacagcaaatctatccactggacttgtcactatattctcagcctctcaggtttcaaaatcttcatctgtagtaatagtcgtggaacattcttagttggatatggtatagaatttctactttctgttagtacagcagtgcttaagaaagggctattgctcattgggccttatagtgaaatttctgttggacccgagcaatagtactttgggtgcaatttgattcctttttctttgaaatgaaattctaataagtttgtttctattcatttggaatagcctcagtttcttgtagcctgtattgagatttctatgctattagctgcgatttacctcctttttttgtcacgtcagttttgcaatcttagtagcactagtaataagtagacgaaccaaaagtatagttgctaatacatctgtatcttgctttcaggcctttgggttccaattagacaacggcgtccctattgaaagttggtttgatgatcgtaatgacagagaactcctaacattacttccatttttgcaaagtttggttggggtggaagatgtccggccatgtattgcaaggaagttcaaccttcgtgagaaggttgccactgcaccttctctctctatgcacttttagatgatcaaatcattttctgggatatagagaaataaattgaagtggcagttgtactctatagagaaggaaaacatgggcagttgtgtgaattgctggagaggacccaaggtggtgaattatctgtatctttgccctggtgtaatcctgtgtacttggaacccataaaatcgtgtaaaatatgctctgttgtactaatatttatacctgaagaactagggaatcctgtgttagcattaagttaaaatactctacatgagagttggcatggccttcttgttgtgcattgcagatagaactgctcagcacacaatagattatcctcttggtccagtgagtctgtaattgtcgaaagtaatgttctatccatatgctccagtatgtacttgtcaaaaataatgttgcagatagaataaatccgcatttctattttcactgctttgtttgattgtcagttggtgtgctttcttaccacagcctttctcctaaaatttattttgttgttgtattgaagaaaaaaaaaagaaaagaaaagaaaactggagactagtagtagtgcttcctccatttcattttaagtgtatataagtttccgtgctcaactttgatcattcatcttatttaaatttttttaataattagtagtatttttattgttatgagataataaaatataaatagtactttatgcgtgacttatgtttttaatttttttttaaaaaaaatttaaataagacggacaattaaaattaggtacggaaaataggtggagggagtagcattttatccatttttgtctggtagaaaacgatgctgaacgagtcgatgggggagggggacgccgcctacgccaagcgcgtgctgctcaccgccgccggcgacgacgtctcccgggggatcgcctccaccctcgccacccatggctgccggtacgtacgtacggacctcttgcctcgccgtgctctccactctccctctctaattcgtcctctcccgccgtagattggttttggtcggcgacgagggcgccctggctgggacggcggaggaggcgcggcgcggtgggggcggaggagatgcggtcgctgtggtggggctggatctccacggctgcgacgaggcggccgtcgacgcggcggtgggcacggcgtggcgctgcttcgacggcctagacgccatggtgaactgctactcctacgagggtccgtacactacttctgaatttctgtatgctgttcctgcagagctaattcttagttgttcctctgcatttcaaaagaaaattcctccggtcgacttcaattcgtgtactcgtagctgagaaccacaacatttcgccatgctctaagctcaatccaaacagtctgcccagtgctcacctaattttaattttagagaaaattccctatctgatctttcatagattactacccgagaaaatgtgccttgggcaatgggtggatcagtctgtctgtcaactatgaactgttgaaatttcactgtaaatttctgcaacaataaagtgaattgtatttttatatgtacttcatgtcgcattctccgtagctttcttaataagtgccttagttcacaaaaccagtatcagatagatattgttgtcagtaataggatacaactgaaaggatcaattggttagtgcttgtaccctgtatgcctggtgatcaaacttaaccacgatatgacacaatctggaaccccctacttcagcaaaatggcgctttgttttcatttacaaatgtttgtttttcccaaatgggcaggtgaagtacaagactgcctcaatataagcgaagatgagttcaagaagacaatgaaagcgaatgtaatgacaccttggtttctagtaaaggcaattgcaaagcgactccgggactcagaatccagttgtggagggtctgttgtattcttaactcagattattggtgctgagagaggattgtatcctggtgctgctgcatatggtacaagtttaggtgccattcaccaattggtccgggtaagtcttctgttcaagtactgccaactgactagtaccattgttctcccttcatcattgagag

SEQ ID NO: 21372 - DNA, 1383 bp, Oryza sativa
cagcataactctgtagacgatacgtgcattgcagttaacaattgattcgatccatgttgatctcgaaatataacactcataactgtaagaggtactaaatgtttgttgtgttcttcagctgtcagcaatggagctgggcaagcacaagatgagggtgaacgcggtgtgccgtgggctgcacctgggcgacaggttcccggtgtgggtggggaaggagaaggcggagaaggcgacgggggaggtgatgccgctgcggagatggctggacccggagaaggacgtggcgtccacggtgctgtacctggttggggacgagtcccggtacatgactggcagcaccatattcgtggatggcgcccagtccatcgtgcgcccgcgcatgcgctccttcatgtagatcatcacatcaccgtacgtgataataagcaactactagtaatagtagggagatccataacaataacaaggagagctccatcatgggtttctgctctgtagctgtgtgttcagatgaacaatttgctgtctgtaatgatcgagaagacagtacaaagttgtgttctgagattagtatgtacgccgcaggcaacgtgccatgatctgagccttctggtatatgtacgatctcggatacgtcagctcttatttgaaaaacactctcatagctgtatgtaagatcatttttttttgacatatgacaagttaaatgtatatggttaaaagagttataaaaatatttcgtctaaagtgaaaacagtgattagaaagatccaaagcgtaatatatgcaataaaaagtgatccttcaagtttggtaaaagggagggtgtacatgaatatgaatatgatccaaccgcccttatataaatcaaggtttctttttcgtttttgtttcaggatccgctcgtccaactgcggcgacggcggcaacagattgatcgaccgcctccgtctcggcgcctagctagctcggtgaagtttctcctaccggccgctccatcttggtgacgccggattattagtgtcataaagtaagtcacttgcataagtatatgagctctcagtggtgcatggttttactttacatcgttgcttttaccgtttagcatttgaaagatagcacttgtgttgaagaccactcagagatatactgtattatgtagtgatgctggggtgtttgaatacttttgggtaacaaaactgaaaagaaatttggaaggacgggaaagggccacattttcaacttgcacatcttcaagcggcgccgtgcactgttagtagtagggcctaacaggccgatccttttcaggcccatcaaatttattgggccaaaaaaatcctagctctgagggcccaaaagaatttgtccgcgagaggaaaatgt

SEQ ID NO: 21373 - DNA, 957 bp, Oryza sativa
cctgcaccccgttttgagatgggatagtataatctttctgaattttgttttgttgcctctctctttggatggatgtacttctcattcaatcatagctgaagacatgatgacatctttacatctaaagtactatcatatcatatcatatcatatagtttgcccatcatgcgtatacttgtctgccgtcaggtatacagtaatataacttgaaatcgacccatcaatctacaacaaaccaaaaaaacaaaattcgccctttcatgtgcaaataaagctatcttcctgactgtacgtagcctacaacaccagatactgcccgatcgacaatcaaaatcaatggatgcatttaccaggcacagtccacctggcattgggctttgcccagggtggcaacctggtgtagttcttccagtcagcaagaacacccttgagatcactgatcttggattggaggccgatgcagcagttggcgtgcatggtgcagatcttgctcagatccttgccgtagctgcagaatccgccgatgtaggccgtgtccaggtactgaaccttgagcttcagcttcttcaccagcttcttcttgatgtggttgaacaccggctgctcgttgagccccgggtgcgagctcctcgcctcgtgccactccttggtcatggcgatcgtcctcgcgctcggcttcacgtagaagaagcccgtgtttgggaagttgtcgatgttgtccgggtcaccgaagaacacgtcgctcgagatcgccatgtccgcgtacaccgccacgtgcttgaacggattcctcagccacacaatgtcaacgtcctgatcttgcaattggttaattaatcagttcatcttgatttgcagtcaatggcggtgttaatttcaatttacagttactgaattaccgtgaagaggaagttgtagccgagctggagaattcggcgctggagcttgagcttgctc

SEQ ID NO: 21374 - DNA, 3721 bp, Oryza sativa
cgccaacccccggaactcgccgccctgccgccattgatgatcaaattagcgtgaatcactaggtggtgtaagatcctaggactttctttgccacttttcgtacactcgaaacaagtacaaaaaggtaatcaaggatcgagattaatatataacaaattgattagcctatctctttttcgaagtcaaaatagtagatcaagtctcatggaatgatttctgaattcgtggttatatgtagcatatatcttacaaaatcattttcttggtgcatttggcagacacccaaaaagggttagttgtgtcctactgaaattgaagaaccccctgtttttattatgatgagttgtactgttgagttaattttgaacatgtgaggaaactgtgggcaacagagtgaattcaagacggcacaaatttagcagattactgataccagatgacgcataagaaattaaagaagtgaaaattaattaagccgggagattaatgagaactaacctcttcttcaagatctgtactggttgctggaatatgatgagttggtgaagatgcagtagaggtcgcaggaggcttggttggcggctgctcctcggcgacagcagtagcagtcgtcggaggcttgccggtgatgttagcctcctcgccgccacgtgcgatcaccggcggcggcggcgccgttccattgccgccgcagtgcagcagcagctggtctctggaggtggagaactgcaccggcgacctggcggcgcggccgtagtccggcggcgcctggtactggaagagcagcatgacggtgagcgtggccacgcagccgagcacgaacgacgccgcctgccgccccgtcgcctccgtgaccgccaccttgggcgccatggacgatgagatgaattgatcgatcgagctaagtctctgcagcgggcagagtgctaaactaatatagatcgagacgtgtacgcactgtaccaagacgacgactgctgctgctactactgctaacttcgttccaaaataaatacagtcgtgagtttctgtgtccaatttattttatttaaacatttttaaaaaataaaaaacataagtcatatataaagtactattcatatgtatgaatgtgaacaatactaaaaaattttataatataaaacggagaaagtattatactaatcataaaaatttcaaataagatgagttggacacggaaacttatggctgcacttattttgggctggagggagtaggagctatcagcagcggccgtgtatgtatgtatcatgtatgtatgcagtatttatttgtgtatttgtatacgtaggtgtagatgtggcaatcgatgggttgcagttaacgaggcgtacgaagatagctgccttgccgtttccttccctgaaatagctgctactccactacaagtcgacgaattcgatcgagcactagctgctgttactacgtactccctgctgtaactgacgcgagaaatactccattctcgaccgattcatccaaattggtgccatcactaccctcgatcactaaagaattagactagtccatgctttggaagcttcgctgcaagtagcaaaggagatacctgtgtatgtatggatcgaaaattcgaatttaagaataataaataggtgtagtaaccgtatagtatgcatgagtgtgtactactatatgatattcagctggtaaactgtctagctagctactagctagtgtttaattttgatatgtgcgaactgatgatcgagctgagcaatgcatgggtgtggtagtactaaagtataattaagctactgatcaaattcgatcggcttgagagttagtgccgggaggatgggcgcacatggcgacgaacatgagttggcgtgggtgacggatctctcgctttgactactcgatcgccaccgaaatgtatgtactccatgagtatgtatatatgttcttggcaatacatggagaattcatcaactaactagtgctccatggttacatattgaggtgagcgttgctgcttaatttcccggacggaccgggcatgctgccatgtacacatgcacctcataatctgtagtatcaatcatcagaaatgtttagaaacgtattatctattatattcagatatgccaactgctgctggatccatggcactgctcatactacagtgagtgagtacagcagcttaccgaataaagtgcaataccatttacgtctcaaactcctcctccttgaaaatgctctaattatcctccacttcaacagatgctaattcatggatttcctaactgcactaaactactgcaaggcattgagctgcttaattcaggtatctctctgttcaacgtgatctgcgggcaattaaattaaacagcagactgaccaggcacatactggaagtctggaagtagcaaaccagtcgctggccttttctgcaacagtatttgtatttcagctaacctgtcaattagtgatcgatgcgttgtatgacgtgacagcaactgctacgtggcgttgctgcatcatatatatgaacagttcctcagtttacttgcagagaaggttcgcacttagattagcatagcaataactaaatgctgcacagtgctgctacttaatttggttactagtactgtagtactatgtgtactggtggtagtagcttagctaggatccattgattccgccggttttagagaatcttgtagtgatgtagtcgctgctgcgaagtgccacgaatcattggtcattcatatgttcatctaccatttgctcaacttgttaggtttcatctgcgatgctacttgtttgttcggtccatctgctacctacttaaactactcgatctatcgatgagacgatgacttttgccttagttaattggacctgcgattaattaaccaacatgatggcacaaatttattttgctgtcattagctaattaagttcaactgctgtgtccactacgctgactgcacgtacacacgtctgcatattttattttttttaaagaaaaactagcaatacatgcagtctttgctggtatccacagattgataccgctggatctgtatatcactggtggagaaatgctttttagtcccgtttcgtaacccccctgtagtcccggttggggactacgaatccgggactaaagatcgctatctttagtcccggttcaaataaccgggactaaaaatcaatctttaccaaccgggactaaagatgggagcatctttagtcccggttgataacaccaaccgggactaaagatattttttctttttttttctgcttttaatattgaatattgatttcacaccatcccctcccatatccaaatcatcacatattacagaacatctccaaatcctcaaacaaatcatctccaaatacattaccaactcttaaaaaaattacatcacagggttctaaaaaattcatcacagattcacatctcacacaaaaatacatcacagattcacatctcaaaaaaaaagaaaaaaaatccggccggcggccactgccgcctcccctcctcccctccacgccggccggccagcgccgcgccggttgccgccgagcggccgcccaccgcagccgtccgtcctccgcgcggcctcccgcgccgctcgcgccggccgcccaccgctcgccgccgtgtggtcccccgcgtctgccgcgccggccgccatgcaggccgcctccgtgccgtcccctgcgt

SEQ ID NO: 21375 - DNA, 21432 bp, Oryza sativa
caaccgggactaaagatcttcctcttattaaccgggactaaaaatcatttttagtcccggtttttaatggaaccgggactattgtggatatgggtcgaccgactaaagatggtttctctaccagtatatggcatttgaattagggttgattaatttctccgtgctagctcctaacccgatcctgacacttaagcttagtctaaggagctctctacttcccaaacttaattagccaattatacaatactatatattatcctgacacttaagcttaatctaaggattttctacttatggcccctttgatttagaggaaaaacataagaattttagaggatttcaatcctataggaaaatttcctatgaagccctttaaaacaaaggattgaatcctatctaatcctttgaaattcctatggaatggacaattctatagagattttggaggaaatttagcaagaccttcaacctcttgctaactttcctttgagtctatctctctcatccaattcatgtgtttttcctatggttcaattaaacggtcattcctgtgttttgcaatcctctattttatacttacattcctatcaaaatcctacgtttttcctattcctacgttttctcaatcctgcgattcaaaggggccttagcaaacttaattatctaattagaaaggtgactaaaatgagagaccatgattttatctttgcacttaagcttagtctaaggagttctctacttatcaaacttacttagccgattagagttagaaaggtgaataaaatgaaagaccataacatttttcaaacgaccaaatagattgattaacgttatattaatagaagggagtttagctgggatttgggttgggaagacttttccgctaatcgattgatcatcgcatttatactgttggccaacagtggcgactgcctggtatggtcattatcgactcatactccaatatgtttataccaactattatatttaaatggccagcagtggagtaataagtaacaatctattatttaaattatgataagattcactcatatatgtttatacaaacttgttactagtaagcattagatcagctgcagattggttgcatcaggtgtacgtacagaaatccttccaacaaaaagcatatgtaccatatgacaatatgtacttatgttgttaacttgttctagaattaactttccatcgagagatttaatcggttaatgacactcacgttcccctggtagccgttgtatatcattttcaggtcaagaataaactaagatatgaacatcacatccatacccatccgacgattaagttaggtggccaatcactcttaccatccatatatgcatatgctccattagttagtacggagtacttctttccaaaatagtataaacattgtcaagtaaatagccaggaatgcttattcgtctagttgcacaatcagaaatatttatattttcaaatggagggattactcaacttttacttacaggcaggggaagtcagtactgagtagctagctaattaccccgttgatcatgcaactatgcagtgacagattctgccagaatttggttcatggccgctagctgcagggcatgtgtgatgtccccagtttgaacagtagagagcagccggcagtatgcacatatgctgcatttaaggaggagttaggaccggagtaggagtactagtacttgtttattaatcactcatctattagcataatggtccatggtgaaagtacagcaaaattaggtgaaggtaacgtcgatattagttgtatagaatcatagaccatcttcccaacagtggtactttcagatcatctgtccttgtttccgtccctgttggagagcgacaatcggaatggtcactgacaagggacctctctgttgcccggaaacgacgaaacatccagttcagagttgcagacttcagacagttgccaaggatcaatggaaaattgcaactgaaaatgctggagactgcattgagattgaatattaattcctccaactataattgaatttcatccatatttttggaactagatgaatatgatatccataattgtttttaccctgggtaatctttagacctatgttatttgtttgtttttatgtgatgttcacatccatgttccatcaaaccatgtattcaacctgtattagaggttgttatttggttcaatgcttcaacttgccacacctctttagacttgtgtttggttcattgctatagttgtggcttacctatacttttttatcttgtctcgcatatcatagacttaatctttatctaattttaccatacttgtctagaatgagttatggcaatattagtaaagatccaaacaaccctgatcttcttattgggcttctcttaagtttatatgcaactggtcccttttaggcccgaaagcttgttcagtatgtgtgctgggccgtatggaaccatgacttatagaaacttctggcctgctcgggccctgagcccctgagcctattctttgtcgagactaattgggatgtggccttttgggttttcaggcaatagaacagtgtgagaatgctaccctcttatcctggcccatttattccacgaagctgaaatttattttagccttttgggttttcagaaataaaaaagattatgcaagtgtttgaaccctttattttcggtctctggacctattcagattgtagtcaaaataaaccttaccaatttttggcaatgccattctaaaattttggcaggatttcttatgtattgatcaaattttgcaacaaactaaatgtagatatgtttttggtaactttgccaaaaaaaaatgatgtgattgaaaatggcatcaaagtgaacagaccctcaataacggagtaccggcccatttattttatcattttgttccggcccatttattcctcaaagcagcagcctttaacgatgtatggcccgtatgaactttacggccttaatcagaggcacagtgttaagaccgtaaagttaggcccactacatatggttgagtaattcagtgttgccaccagcgccgcataaatatcttgggataaactaacttttgaatccagaaatagaagaaaaaaatagtctggacacatgcttgatggttgatgcaagctgatgcactcttttatctttacagagggagctccaggatacaagcatatgctagaattaatttttatacatacgtacgtaggtataaatatatggtgtaataacttaatatatagattttcctaacttgacaaaaagaatcggcgcaactaataattgaggagaaagaatttggcagctcgagaaattaaccggcctgcagacgagcgatcgcctagctaaccaagcaaccaaggcaatccgatccagcaatgctgatcaacgcccgtccgccgcctactttttataccgtgattctaaaaatcgaacataactattgttgcaattcattttttattttctagaagtcccgtcaaccgtcagcggctctgcaactatactcttacacaccccgcccgctgcttctcctttttattgtcattgagattttaaaattcgaatatgattatcaatgttgttttttttttaactttctagaagtcccggcaaccgcctttcatgtttgcttcacggcctgcctgacgtccttctttttaatcgtcattaggattctatttggtgttttattaacaatttttatatggcgtatcaaccgccaccaactctactcatttataggcatgttatttaatttatctcgtcatgtgttttagatggtcttttctttcaatagtctttatttttatcaaaaattttagttatttataaattttattcataattgaaatcttttttttttctaatttcagaatttactttttttaaaaaaaatagttgatatcgtattgtgttcttttaatgtttttatttttaattttcaatttcagttgtttcataattgtatttctacttgaactctcttttaattttttctaattttagatattattatattttttattcgaaattttaattaatctcgtatcgggttcttatatggattcttctttcaatattgcttatttttaattctgagtttcagttaattttaaattgtattcctacttggactcttctttattttcttttgctaatttcggatttatttttatttttattctgaattttaattaatctcgtattaggttcttatatggattcttcttttaatatttcttatttttaattccgaatttcagctatttttaaattgtattcctacttggactctccttttcttttctaattttggtttttattttattttattttgaattttgattaatctcgtattgggttcttatatggaaacttctcctttccttttctaattttagattttattttattttatttcgaattttgattaatctcttattgggttcttatatgaaaacttctttcaatattgtttattttaaattcagaattttagctatttttaaattgtacttctacttcgactcttcttttttttctttttcttcgattaacgtagctgaaattcagaattaaaaataaagaatattaaaagaagagtccatataagaacccagtacgagattaattaaaattcggaataaaaataaaaacaaacccgaaattagcaaaagaaaataaataaagagttcaagtaggaatacaatttaaaattagctgaaattcgaaattaaaaataagcaatattgaaagaagaatccatataagaatccaatacgagattagttaaaatttcaaataaaaaataaaataacatcgaaaattacaaaaattaaaagagtgttcgagtaggaatacaattttgaaataactgaaattgtttcagctaattttaaattgtatttatacttggactcttctttattttcttttgctaatttcggatttatttatttattctgaattttaattaatctcgtattgggttcttatatgcactcttcttttaatatttcttatttttaattccgaatttcagctatttttaaattgtattcctacttggactcttcttttcttttctaattttggattttattttattttatttcgaattttgattaatctcgtattcggttcttatatggaaacttcattcaatattgcttatttttaattctgaatttaagctatttttaaattgtatttctacttggactctcattttcttttctaattttgaattttattttatttttatttcgaattttgattaatctcgtattgggttcttatatggaaacttctcctttccttttctaattttggattttattttattttatttcgaattttgattaacctcttattgggtttattgggttcttatatgaaaacttctttcaatattgtttatttttaatttcaaattttaactatttttaaattgtacttttacttggactctccttttcttctttttctttttattcaattaacgtgagaatttctagtctcaacagcgaacgtggtgcctcctttcaaagctgtctttatataatataatataatagatataatagataggtagataatagcctggacacatgcttgatgattgatgcaaagctgatgcattcttttatctttacagaggagctccgggatacaagcatgctagaattaatctgtatacatacgtacgtacgtacgtacgtataaatatatgatgtaataacttaatatatagattttcctaacttgacaaaaagaatcggcgcaactaataattgaggagaaagaatttggcagctcgagaaattaaccggcctgcagtcgagcgatcgcctagctaaattaaccaagcagccaaggcaatccagcaatgctgaacgctgcgtgtatatgcatatgaacatatgatcgatcgatcgatcagtggatgcagatgccggggagcttccactggaacttgcccgagcgccgctcgtcgggcggcgccgccgtgtagttcctccagacgtcgaggacgcctcggaggtcgtgcatcttggcgccgaggccaacacagcagttggcatggagcgtgcagatcttgttcagatccttgctgagctgacagaagccactgatgtaggtggtgtcgaggaactggatggcgatgcccagcttcgcctgctgctcgtgcttgatcaggttgaacacgtcctgctcgtgcttcccgaagaatcgccacctcccttgctgccaactccggtagaaatcgagggtcttgtcgttggatcgcacgaacaggaagccgccattggggaagttgccgaggctgtaggggtcgccgatgaacacgtcgctggagatggcgatgtctgctcccattgatatgtgcctgaacgggtccctgaaccacatcacgtccacatcctgcaaatgcattcatatggattaattaattactgtcagtgcaatccttttccagtttactgttcattcagccattgattggattaattgtactcctggattagtatgcaattcgcaagtcattctctgaattttgcaatcaatcagtgagagcgccatcaggccaggaaaaccgggcatgagcgtgtctgcttcctcttgctcaacggaatctttcagtttcacaggttcagttttttcggtcgcctgtacgcgaaagacaagccacaagttccaatccaaatggacggccgggccgacaacaacacgagtagagtagagtatagacgaacgtgtcaaagtccaaaccaaacggtttagtccaacttctctcgaatcggctgcgtctctgcttagccgaggacatttctgcccagcaactatgatgaaactgtagtgcacgagagctaagctaagctagctagccaagcagagcactagcagccaatgtatcgcccaatccggccaactcaaccaccacttcgatggaacacatagtatattgcatcgaaaacgacatgaaaatgaatttatatattgcaattgaagcgtgaaaagaagaaaataatttagtactgaccgtgaagaggaagttgtagccgagctcaaggatggtctgctgaaacttgttgcgaccccacatcatctcgaggtagtccttgctcatgaacatcttctcggagcggtagtcgacgccggtggtgcggaggaagtagcaatggcggtgcaccgcctggcacccctcgtacgccgcggggtccatggtgacgatcaccaggtggtccagcagccgcgacacgccgccctccccgagcctgaagctctcgaagaagaggtccagcagcgaccccggcttcgtccacgccaggttgatctgcgtcatgatcaccgtcctgtccttggtcgccgctcgccggagcacctcctccaggtcgccgtaaggggacgccggcgccggagcctgcacattgtatatgcacacatgattcatgattggtttctgttcacatttcatgatcagtgcagatatgagatgactacagagttggatttttttgcttcatgatcactacaaactgaactccaagaattggatttttgctgcatgcatgtgacgagttggttgcgtctctatggttcagcattggctgacaagtggggccatttttttttggaagaattgagctatgggcagcaactaaagctgagtatagcagcaatctaggagaagacacgcccatgaatgccatgctgcaactagcaaatgagctcaaaccattccttcattttatctctttttatgcaagattttattttcaacaattgaaacggccaatgcattttcttctgaacaacgacatgtgctacctcacatggttgaaccaagaatagattttgcctgtcagtaagacatactactctgtcccatagaaaatctaattctagttacaaacttttacacacatatgtctagattcgtagctagaattggttgcgaacccgtcttctctctttagccttagagcaggtttaataaagcaggcgactgccggcggtaaaaaacaccacatcagcgatagagataactatgagataactagaagatgggtgtatgtacagctgctggctatacgcacaagcaccaatgaattgattatcatttttttacgcccaatccgtctgtacccgcgcattgcctcgcgtagacccacacgcagccatgggataagctttttctacagtttctttcttcttgaagttcgtgtgtagtcggcgacaatttaggtggtgtttggatccagtgatttaactttagtccctgtatttagacactaatttaaagtattaaatatagactacttacaaaactaattacataaatggaagctaatttgcgagacaaaatttttaagcctaactaatcaataattagagaatgtctactgtagcatcacataggctaattatggattaattagactcaatagattcgtctcgcaaattagtccaagattatggatgggttttattaatagtctacgtttaatatttataattattgtccaaacatctgatgtgatagggacttaaaagttttagccccatttaaacagggccttagtcgtccgctaacaccctctctcctggttttttccatccagctcatcactttggccaggttggatgcgctatcgccggcttaaaccgtatattgtacctgctcttacgcgaaaaccgccagacagaggcgtcatgggccggctgaacatccatcgccgatcagtcacacatggaccgtccgatcgggagccggactactagccgtttccggtgccacgtgtacccatcccactgcgatggccggtgacacgtgtgagaacatggcagcagtggcagtaaacctgtgggacccatgccgacagcagctacaggtaaaaaggagctagtagaacgcgatgagtcaccaggtctagactagttacatcatgtggagaagaagggaattagctgctggtgttaacaagtgtgattagtagtaatagtgtttacatggggagaggggaaagacaaaagtggttgggagaaaggggagaagatgggagcaagaaagcaggtgtcaatggcgagcattagcatagaggcaggaccgtgtctttgtgttgtaatctagactgactaggtaaataaactattactggtatggtaatctaatcagtaatcacgcgggtttggttaaccggtcgccgtcaggctacgtaacttgttcaaagaggattcctcctcctcctcctgttaatgtgttttgttaattattgctgatcgcggcagcatatgtaaatggcatctctggtttttatttgagcttattaaatatcacaatttgatgccatctccaccaccacgcactacttaattagtattactgtttgattattttttattcttgttactgttctttcagaaaaaaaacggatttgttaactccagggaggtagaaacatctgagggaaaataacctcctttgttttttttttcattttgaaatcttcagaaatgatattggtgccaatcaattcgttttgttcatagcatattgaagcaataaaaaaaatggcaaatatgtgcatacctggacgggggcgggagccggagcagcaacgacggtgacgttggcggcggcggcggcggccagcgagtcgttggagtcgacggcggcgtcctgcaacgggagcggcagcggcggcgcgtcgtcggcgttgctccaggcggagatgtcagcgaggcggcgtcccgggctggcggacatgacgaagaggatgcagacggtggccatggcggcgcccagcacgaacgacaccagcgggctaatgctgctgctgccgctgccgccgccgccgcccatcgtctccccacccttcatcttgccgccgcccagcatcgatcgatcaaccaatcaatcaaactatagctgcttcctccgttgatgtgacgaatggtttcttgctcaaattaagagaggttcttgcttcttgtggcaggatggtggaagaggaaggaaaggcaaagcctttgtctgaagaaaggaacaagaaggaggtatagtagtagcagagaggagagggaatgggggtatttgatggaggagcagcagcaacaggtaggcgaagaccagcctgaaagggaattaacgggcgtgatggaggcctaagagacagatcatcatcatcttaatcctctcccactgattgatttactcgtagttttggctttgctggtgtgatgacaacttgtagtgtgatgcgtgcctcttgcttcagcgtgacaggtttcaaagtcgcaacacacggttgctttgctttgatttgctagctgctggagctggaggtcgaggtttggctgtcaggaactcaggatgggttgggttgttggtgccgaccctgtctgcctgtaggttcgcgtttgtttaggcgtagactggacctgatgcgttgaactgttgagatggacgtaataaacccgatccggggtattattctgatttctgaattctctccctgcatccctgcaataactgaatttttctatgctacttacctgtacatgacattgtgtacgcgtctttggaggtgatttttttagtgttgcagacggctggttggttttattctgtttgctcacatgggggagaaacaatatttctgaatttccctcgtactgtgtaggaaaataaggttcgacatgaagaaaagaactgcacaatcaaacgttggatactgttgctaatttgagtacaaaacggtttcatgctttgaatattgttgcttatttatgtcaaaaaaagtattgttgcgtacaaacggcttcatgctgtatggtaaacaccgccaatcattcgcgtgctgagtcttacaaaacgaacaaacattcactatcggtctatcgccgcatgtagaagaaaatgatggtaatttcgacctgcaactgttagagttgattaattattaatttggtgaagattttttctctaccggaaggaaatgactaaggtgctattagcgacttctagctagctaggtcagacgccatctgatggccaccacaccctatatgctactagtatgatgctgcacttgccgtgttaggtttgctcatgtgtaagtcgcagcaaagctcatgccgctgttgccatcgatgagcaaaccttacctactagctctgctatctcatcgtcaactccatctttcgctacttgcatcttcagaaaaagttcagaaaaactcagcctgcctcttttcttgacaaaataggttccttgttcagagttaaattgaactgtctgcagcgtattcttttgtagtttttcgtgtatctagcttgtcattttgaggtaagcaagtaagcaccaacttctgtcattctcggtatataaacaaattggagaagtaggcatctaaataaagggtagcgtgagcctgtcattctgccgccaatttcgggattgcatgcaagactaagctttgaactataactgaacaagtaatctgatggcgatttgtcggtgcagcgatttggtactagcactgctaatctgaagcacaacagaaggattgttttttttttttacctagctttcactctgcttttgcaatcttgcatgctcttgggtgcaaactaccatccatcaatagctttggccgatacagtgctatatacttttgtgtgtttctgtcagatcagtctatgtgcaacagtgcaagtgttcttctcaactgctgaaaaagccaatgccggaggaactatttttaggtggaaacatatactatgcagtattgcagtaaattaactctccacacgggcgggtgaataaacttgtttacactgcctattattaattatctaaaaacattattcatccattttcctatagacagacgtctctattgaaggcctaaatacatctttgactaactatcttattctaatcattttgggtcagggaaaacaacatgtacaaaaacgtgcatatttccatggaagttagcagcatatgcaacacatattctgttaactaatcaggtcgggttcctgtcccgatcatgattcatgagccgaaatgtctaatagaatggcctagctgactgattgttttgcctaaccatataaagactggccgggttgattattatttatccggtattttgtcttaataatcaccagatacaagctgcttgccaaaccttaggcgcagccatgtacacatttttgcctttcctgttgttggttgaatcataacattagcaccaaactgtctgtttaccagtcttgaggaagaacaacaccgtaaatcacgctggaaatgctgcattttgctagccattcttatgtagttgatgatattatatatgctcctaggtttatggcaagttggcagagttaatttgattagaacgacagatgttaggacgattactgtgttggaagtttcttggattgacctcaaacgtgcaagcagatataaggctggcaacttgactatagttattagttggattctgtagtctggtctgcacatataatattatacaggtaatcagacagcattatatattgatatatactactgaataaaggaactaagaggttcagttttaacgaatccatgattgcgacatgaacaagaattaatctattcatatctagctacttgctacgatacgagctaacatgcacccaaatgaaaaaaaggaagagaaaaaaaagaagatatgatgtgcacaacagtacagatggtatatgtagccgtttgcacatggcttctcaagaacaaaatgcagtggcttgccaaaacttaggacagttggaggctctgcatttgtgtagcgagtataatattgggaaatcttgctgtttaagagtaaaccagctctgcatagctatatgaaaaggagtatcaggtaaccggctttgcaggggacctcacacggagagacgacgacagtggagaggttgctgtttaggtgcatgatgccattgctattgctgtattaggccaaactcaactcgctaggatgacaattattgcaggtgaagcgtgcataattaaagcatgtatagcaccaaacatgcatgaacctatcagttatatatatgggttttcagactaggcaggagaactatttttcagagaatgccctgtggatgtttaaaccaaatgaacggatcaaatcagcagcaggagcaggtaatgtgcctgtgtttgaggttgtaacacgtctcaatagtattttgcagtaatgaggtcacaagatcacataatcatatggattaatgggagatggcgaagaatcatgtttccttgtgtcgcagggcagcacatgcattgcgtcgccgccgttgctgtcctccgatttaacaagtcaaaaggcagaaaaaagaggaggagaaacagtagtttaaacaagaagaaaagtgcacaacgaaacgcggcgttctcgaggcgctttggctacctgatgatatatactaataatccaaattaaggaggtaattagaataatatactaatatagaagaatgggcagctagttagctggtgatatgaaaagaaaaaatgaaatggttggtggttgtaccggaagaaaggaaggttctgcctgcctggatggattacaagaaatcgtcgtcgtctttctgtgctaggctgcaactattgcaaagccaaacacgtacacgggtctctgcttttgcttccgttgccgttgaggttgttgctttggtcgccgccggcacaacgtgctttacctccaccgacacctcatcattttctctgaaaaatttgcaccgactcgttcgtcatattctcgtgtgaaaaaaccaactcccaggtgaaaatcatgtgctgtattttctctcctcttcttctgaagaaaaaaagggaatgcagagaccagtaaaagttctgtggagatcatgtatttatattcttgcgtgctgtctttcgaccgacaagacaataattgggttgaaagaatagctagtcaacgtccaacaatccagtgaggcagtgaccagtctagttttccatacatatatacagtagtacccccatttcgttcttcagaatttcagaaacagcaggacgaggtctcccatacttccaccgttcaatgaaactgccctctcaagaaacgcgtgcatttgtccaagtcggtgccaccatatttctgaattcccctcgtactgtgtattaaagctataaaaactaggatgaagacccacacagattatgcggttagcatgattatattttttttctcacataatagcataaatacttatgcattttactattagaatatattgaaatggcagcataattttaaattatgtactaacttgaccaaattaactaacatgtaatattcatatgtatatacgtgatagttgttaattattttctaattctaaattttagttatttgtaaatagtatttctatatggactctatactcctattcaaatatctcttaatttttaatcctgaagttcctttattcataaatttaatttctataggaattctaaactcttctttcaatatttcttatttttaaattttgaatttttcaatatttcttatttttaaattttgaattttagtcatttctacattgtattcatgtatggattctatactgctttaggaatagctcagtgccaccgagtaatgtataaaaatatatgtatatgttaatattttgttttgtgcaactacattacactctgacaatgagagcagaaaaatagaggaccgcatttgcagttcagatgtgtatgggtaatggaattcattgctattttaattttgtgcagctaatgaaattcgtttgaagacagattatgttaagaaattttagcaatccatacataagagtatagatgtctgtttgggtatctagagaactgaacacatctgatctataattggggggaagagtaacttttatttgtgaaacaaggaacggttgaaatgcttaaggtacagtcacaggactgtgtgtgtctgtattgtggtcataagtgaagaggatgagataaacatgaaaatggattttttgtgttaccagcagtttttaaagagtacgcgtatgttatacatgttggaagttgtcgctattgcttgtgacacaattgcatttttttaaatgttccgcatccttttgttggtggtgaacaagcaaatgtgtttgtctgatatggcaaataagatataaacttgtaagtaacgttctaacaaaagcagataagttttacagtgtttgcattccaaaattaataaagatccaacgctccacaattaaaggtactaccatataaaaggtatttaagtattgttataaatacttccgaagaaagggtaaaaagataattttcttaagagatgaaaaatgatataattgtcataatattagccggaggtatattgataccataatttaccataatgcaaattaccataattgccatcaacagtagggttctcaacattgaaaacatctgcaggttgtccagcaataagaaggcacaacgtcctcaaaggtgatccagatacaaaatggtggtaagccattttcttcactgaagagcctctttccttctaccagaaactaggggattttgaacctccttagcagtagcctgcaatgaaatggttgccacacccagggttactatttttttcccctgaagctgatgttctgatagaaataagaattacctgaatctggttttctgacggaatgtttttcatgcaatggacaatggctccatactctcccttatgagcaccactgctcttacaagatgagaaaagttttgtcactgccatctctggaccagctataccctgtaaccaagaattcgaaagaaattcaatattcctttcaaaagaatataaataaattaaataaaagatagctagcagttatatgacaaacgctgattgaaaaataaagtgatctcaaggaagaatagatcttttcatttcacaggtccagtttaacatgcatacattaattcagtgttgctggttacatgcttaaaatcctgtatggacaggccattttccatgtgagaaattaatgacaaggggatgcttttaactgtggtaatgaattatctaaatattgtagagcagtacaaaaagcaaatacctcctgcgatggatcagacccaaaaggtgaacggagcttccatagtgtcggcacaatattttaagcagtgaaataagcaacttctgatcatctcctccatggaactccctgatagaggaatcatagcctccaataatctcatcaagccacttgttcacatcctttgctgcagcacttccaccaacatgggggccaggaataggttgacaacacaacacatggaagtaactaagtgtgctaccattaacacagggttcagtatacaagatataatttgagtaagaaggaaaatatcaaaaagtaagctgtgcatagcatgggcttgaacacagcctttggggatggaggacgatgttacttgccacagaggaaggaaaccgatttaatgtcacatatgtgtgagataatcagacatatgggaaaactaacatttctgcatatgtttggctcatccagggacaacagttttcctgttcagctgttgtaaagcttgtggttggaaaacaactccaacaaaaatacagaagccaaatattccagttttccactgatcaactgattgagcaacaatttctaagagtcaatccaactgtaaccaggattctttgtaattcttctctcatacatcatactccttatttctgctgatttagtccaatcccctagagaagcaagcccactggacagttgcacatacaagctgggatgtgacgattccatctccatcagcttcttcgccaccttccgcatcatggcctcattgccctgagctttgcatccaccaataacagttgtccagctaaccgcatcagcttcaaagggcatattttcaatgaattcaactgattcctctagccgacctgcgcggactaagagatcagtcacacatgcgtaatgctcagctgatggactcacactgaagtccgcttgcatccggtgaaaccatgtcagtccctctttcacgagtccagagtggcagcatgcagaaaggacagcaataaatgttcgttcacttggttttatgcccttagttttcatcaactccaagagttccaatgcttcatgtccatacccattggaagcatgaccaatcagcattgagttccataagacctcgtctggcttatcgatttcttcaaagatcctgcacccatttgctaggcttccacatttgcaatacagatcaatgagtgaagacgcaacaacatgatcagattgcaaaccaagaacagtggctagagaaaagatctgctctccaaaactgatagagcaaatgctgctcgatgcactcagagcactggctatagcaaccttgtcaagccgcaaaccaagccgatgcatctcacagaataacccaagtgcatccctagcatgcccattctggctcaacccaaccaccatagaattccatgagatcacactcttaccagtgatcatatcaaaaattcttctcgcctcttctatctgcccacagtttgagtaaacagtgatcattgagttgagcactatggtatcatgaaacctaagctctctaaaagctctgcaagcatcctcccagaggccacattttgagtagaaatcaatgagtgcacttgctactattatgtcattgactgctccacattttagaccacacccatgaatctgttgcccaggattcaccatgactgaaaaaccacatacattcaaaatgctggcataagttgaagaatcaggtaacacatctgatcgcatcatccttgcaaaaagagcaaaagcatcatttccacaacaggcaaatgcacagccactgataagagaattccacatagcaatgcttggttcctcctttctgtcaaaaagtcgtatcgcctcatgcaaatgtccacaagaagcatagccatatatgagtgcagaaagtgagaactcatcaacctgagttaaaccattaaggacatagcgagcagaatccaaatccccacatttgcagtacatgttaactaatgcgcaactcaacaccaaatcctgttcaatcttggaaaccaccatccgagcatgagcctgcctcccaaaatcatacttcatccaatcagcacaagcaccaacaattgtcgcaagcacaaaagggtcattccatggagaagaggcatctgcaccactgcattgaccaaccgtcctgagtaatgcaaacgcctcatccgcccggccacgccggacatacctatgcaaaacagcattgcaagccacaggatccttgacaggcatttcaatcagcagtgaacgggccatgtcgagattgcctgtggacacaatgccagttatgattgtattccatgagaaggtgttcctctcgggcatggatcggaagatattaagcgctgcatggtggtctctggaattgaggtgggaggtgataacagagttgtaggagaagcagttcttgacgggcatttcgtcaaacaggcggcgggcgtcgtgctggtggagtggggagcagcgcgcatacatgaggagcaaggagttagagggcggcagcgatgatgggacatggccagacttgagaaggagctggtgcagctgctggccggccacggcactgcaggagcggaggagttggatgcagttgcggacgtcgatgatgacagacatggagaaactgaacaggacaggaggccctggaagcaagctgttgttctgccttcactgaatcaccatatccttagccactggccaccaccttgtcgagatcatagctgccatggaggacctaggacaaaacattacttatgatggactcttgcagtggggaagtgcactaagggtgtgtttagttcctgaaaaaagttgaaagtttgaagaaagttgggagtatgaaaaaaaagttgaaagtttatgtgtgtaggaaagtttttgatgtgatatgatatgatggaaagttgggaatatgggggaaactaaacacggcctaatgcattatccctcgctctctgacccctctcgccaacagagtccctacacacagagaaaaaaaaggaaagcaattgccttatgtccacaaattatatatcaaaaccacagtaagaaagtaagttggaactgatcagcatattaccaagtcctaaagtattatcaactcaagaaattaaaatattagagcccagtgccacatttcattttaaaaaaggtacttgataattgataacccattattttgttctgatagtattcctaaatatctactcacaatgaaaaagaaagtaaacacatagctttgattagttttcaagtttataatattaacttcccaaatgccaggcttactgtccatatttgatctgaatatctgagaattgataatgtttaggagaatacatacagctctaaggagcagtggcgtggccaaggaatttttggttgggtagtcctacttcacatcacatgccagaattttcaaacaccgcaaatcccatatatgagaataaatttagttaaaaagttatacaaatatagcaataacatcttataaaatcaataatcgactaaatttgacaagcaggttcaaaatgtgcaaacattacaatatacatagttcgatagcaatatccctattcctcaaactacaatggcagcaaatcaacagcacattcagtaactacaaattggcaaatagtaaaggcaagtggcagaaagttcaaacacaataactcaatgagaataatgaagctatgagctagactgctagaggtataacctgcaagagctgggtcgtcgtcttcccaagaggacaggacttgacagtgacaggaacagcaggtcggcagccaatggcgacgccgcgacagccaggggcaggaccctcctggtatttgggttgaggcagaagtggagagggaggagaaccctgtgggctgtgagggagacggtgcaggatgaggatttgagagccggagggcacggtaggccttgatctgtgcttgtcaaggacattgtcctcatccttccatgcctgcttctttccaaccttttgttctcgtcaagtgtatggttcttcgatctttattcaattcgattgaaattcaacttgtgtgtttccatcgagtccaatctcacatctatgtatatggttcttcaatttttatatctattttattctgttttcattgggacatattggaatgtgcacaggatactaacgatggtctcgcgtagtagagtccgttttgctcgaacaaaaaatcgcgtactgtgcggatgacaaagactacggatgaaaaatctcccagaaggcttacgcattttttaattaggtatagattgtttaattttttgaactaaaacacgaagttagtagttagtactatctatgatgcttgtcacatttcagccaatagagcaatattactcaaccaagtaatactaaacatttcttgagttggacaagggtaaaactctagtctgggctgctcctcatcatgaatcaaacttgggctagccttgtaggttggcccttaatcaaaatttgtcttggcaggagctatattgggggctcaggttgctatgaatttagcggggcttaaactgaattgaacataggcccaatttggtccctaaaaagatcaagtctgaatgattgcactataatatttacaatcagattagttatcctttgtttaggcgctctacctcaagataggtaatgtatccagtcagacagtttataattgtctcaaaagttgcatttctgctcattgcaacgcaaatcagtatcatataagagatgtattatcccatatgggccccaaaaagaaaacgctattgtcctacaaagcaaaagagtgtcccagttaactgaacttcacataacatcattgcacaaaaactcgcactcgatcgcacgaaacacatatatggtatgatgggtttcctaacacaagcagtcaagcacaatgccatcaacacaacagaaccatcagaagctttataaagctaaaagatcaatgatttacagaataacaagggcaaaaacaagtattgctcaatccaacaactgaaacctccccgaaacaaagcatacagatatgcaggaagtacaaggaactgtattacaaaatcacataaaagatttataaatatctaaccacagcaacagcttatgaactgactaagaaaaagtctggcaattaacagcataataaaaaatgtaacgctaaaattaggtttccacaagtccacccacaaatt

SEQ ID NO: 21376 - DNA, 9503 bp, Oryza sativa
gacggacctcttcggcgagcccatcgaggcgcacccgccgtggttcaagcccgactccttcctccgccccgacttcgacccggacgcctacgtcgccgacctccgctcctacgtgcccctcgacagcctcgccgccgagctccgctcccacctcgcctccctccgcgccgagctcgtcggcctcatcaaccgcgactacgccgacttcgtcggcctcagcgcccgcctcaagggcgtcgatgccgccgccgcgcgcatgcggcccccgctcgccgagctcagggacaaggtcgcctccttccgcgccgcagcagccgccgggctcgccgcactccgctccggactcgagcagcgcgcggctgccacggctgcacgggagcttctcgagctgctgctcgacacctcccacgtcgtctctaaggttcgatcctactccgccgctcctggttaaacgcgaatgtagcttattcctattagctaaatttccccatcagcactgcattggtagatccgactttatatgggatctgtgacatctgtctggaggtcaaccatcaaccttctgaaactgtgcccttccagtccccttcccatcgatgttcgcctgttcattttcatgaatcatatgaaagcttatagtgtttgactctagttcaaactaggaaattggagaggtttagcacttccattttaatgcagcaatagtacatcatattattgctgtgaacatttttttgtccctgtatgcggatgatccatatgctaactctgagtattattttatccatgaatgtagatgcaatgatgcatgtacatgaagaaattggcgtgattaaacctgtcatagtgctattttctaccatgttagaaaaattgccctatcttatgactgatggtcttctcagattattttgtcaaggtttccattggttcacaatttgcaacatcattcaattgtataaaccatcacctaaaggtgttactgtcaaggcacctgaaatccacattttcctgttgttcctccaggttgagaaactgatcaaggaactaccatccgccccatctgattcatcaaatgttgaggctgtttctggtgataagggctactcaggcaacgttgccacaccaccaaacatggatgatgggacagatgttagggagacacaaagcattctcttagaaagaatcgccagtgagatgaaccggctcaaattctacatcagtcatgcacaggtttgtgacactaactcaccaataaatactggtccatttgcacctctcactcacataccttctctttttctgttccgttgctgagaaaaaccattagggaaaaattgtaacacaaaaatgacattagttgtttctccggaaaggtttatttctgtgtcacaattgaccattgaaagtgtagtatacacagcaatacaacgatgtgatataacatcttgattaataactataagaaaaatgtctacccacatgtcatagatttggttgtcgcaaactgctgaagtgtcaacatggtttcatattggtagcttttgttttattgctacctgatgctaccttttgcatctcagtgccacttatatttatgattcttatcctgttacattatggcagtacagaacctcccttttattgaaaacatggagaagagggcccaaggtgctacaaaactacttgatggtagcttggagcgttgctttgtggatggtctagaacatcgtgatgacaaagtaatatacaactgtttgcgtgcttatgctgctattgacaacacatcttcagctgaagagatattccgtacaacagtggtgtcgccgttgatccagaagattgttcctcaaaactatgcaaaagtggttgctggggtatcttctgatgacctagaagatgattatgagcagataatgcaatgcgtagaaaaagattgcaaatttattttggagatatcctcgttgggtaattatgatagacgaatttcattaaaaagctgcatcattgcttagtattttttaagttgaatactaaatgctgcataaggacttagattgacacatcatctaattttctatcgattgatttgcagcaaactctgggcttcatgtttttgattttctggccaattcaatactcaaagaagtccatttggcaatccagaagggaaagcccggggcgacctctcctggaaaacctaaacagttcctcaaaaactacaaagcaagcttaagattccttgattttctggaaggtattgctaaattatgttgcattgtgattattgttttgtatttaaccagctaagcctactacaataaatactatgcttgctcgcaagttatgctggtttatacatttgggacagccattatataggactaacaaggaatgtggttagactgggttaaagatatacatatatgactattgggagttgctattgattgaatatttggtcctgtaggttactgttcatctaagcctgctgtaacaaagttccgctccgagcctgcttatgccgatttcatgcgacagtggcatgttgctgtctacttcacattgaagtaagcataaatatttaggctatgctgctgtcaaatgctcttcagaacttcatttctaacttgacttcaactggttcaatcataagatttcaggacattgctggtggtcttgattctgtgcttacagccacaattactcctgctggaatgcatgacaatcaagcgaagccgcagacactgttgttgaaacaaagcgttaagctcttagaaagtttgcaggcctgctggagtgacgatgttcttgttttctcccactctgataagttcctccgcttgtctttgcagcttatttcaaggtatagctactgcagaggattctttgccttatcttttatgatttaacctatggtgattgaccctttttgtattctacattttacaataaggtatacaacatggctttcttctggtttggctgcacggaaagcttctgatgggggctcaagttctcctgcggatgctgaatgggcactatctgtacctgtggaggatttcatttatgtatgtcatgtctacaatactccttgaattccaagtgtgttatttcagtcatctgaacctactgcttttcatccttcatcatgaactttttggcttaagactgaaatagtattgtcatcttagccagtgacattgagatggttgcatagattagcaataatttgagactcacactaaggtttaagactataagtgcttaggagggcatcccaaagatgacaccttgcacttctagcccaacaaacattccaggaacacatatactgtggttactggttagttagaaagtctacagttggtagcggtgtagcatatcaggtatgacttgtcccttttttttcatgtgtaaactggaaatagttgttcggcttgttcttcatgatgtgctctagattggaagctagtcaatattgattattacgtaatcttacccattattttgggccctgattctcatatttcttataaaatttgaaacatagaagattatggccatcaggcatattttgtgaattgcatttaaattctgtatttgatgcacaggtaatgcatgatgtaaatgctgtaataagcgagcttttggaatcaggccaatttgtggaacatgtaaaccaattgctagcatcatgcccaaccgaagtacttgctctcgtgaaacacagtatactgcaagctgttgagcctttaaaggagttgttgcctgctataatgaatgtcatgattatggtgatagttaaaaggtctaatgaggtgagtacacctaagtcagcagaagagaagcaatgtcatcatttcttactgtatctgtggttcatcactcgtatggtacaataagacaattttgagtcatggtccttctgttcttaccaactatatttctggttgattgtaggacttgaagcacctaaagggaataacagcaacatatagaatgaccaataagcttccagtaaggcattctccatatgtatctgggattttgcatccacttaaggtgaatggacatcctgttttacttctctgctttatgatttatgtttctcaaaagtgaagcatcaaaagttaactacttaactggtagcgtctatgtcctaatggctgcattcagtatgtgttcttggcgatttttaagtgccatggtcagtatctagtacccattagtctgatcgttatcaccctcaagaataacttatgttttgccattttgcaggccccgatatttagaaacatgtgtttatgctctttttgcctccatatttcatatgtgatgttcctctgttcttgtaggtttttcttgaaggtgaccgtattcactatttatcagaagatgataaagcaaagctgcgccgtggatcgacagataagatcacttcaatttattatgacatggtgtctgaagtagtcactgtggtaagtaaggaatgcttaactgcttatgagagctcatatctgcttattggtgaattaaaccatttttattgaatataaaggcaaggaaaactgaatcatcattgcaaagactacgtcaaggtgcacaaagacgagtaggagctaataccgatacctcggataacatcatttctgatactgacaagatctgcatgcagctatttcttgacattcaggtttgatatctgtcctttaattttatgctgataagggacatattatatataacggatataagatttattttagggtgtaaattttgcatcaaatgattttttttaagagggtcattgccttttggtttcatcaaagacccaactagtgcttatggttggcttattcaaccttaccattttctgtggaaaacaactttagcatgtaatctgaatgtttctatgttggccatccaatacattttttttttgcaaggaccaatgggtattagttatatgatcaaacatgatacctgtttatgatggatgcactgcaccacatctgacatttctttttttttttttggtttttcttattatgcaggaatatgcacggaatcttcgtgcaataggaatagatgcaagggaaatcgaaacattcagagctttatggcagtgtgttgctcctagagacaaacaggataacatccagttttgatgtaaagatcaatttgagtacatagaagaaaattgccttaggtccctcaatatccgtagatacgtctcgtgttgttcgtttaggatggatgttggaatgatttttatacatagagctctggattttgattgtttcattttggacggtctcctccggattatacaagggtcaagggtacatccaaaatttgagaagtgtatcaaacctcatgttgttggaaacacaccgattctgttgaaagattgttttagtgtcttggtatctaacctttttcttgttcacgcatatctgaagagaacatctattcctttatttttcttattaggcccttgcagttaccaccgtctttttgagtggctgcgtgttcatataggctcgcttcttctcaagtgaattcgataagatgcacatagataattccatcaaccgatctggatcaacagaagacaaatttctaattcagattctagagttcatgacagcagagcaggacactacttgacagaggactgacagaaatttttatttgagattacgagagtacatcgagaagctcagccccgagggagagtatgggttagcgagggatgcggtttgggcggctcagcgcatttccggcggtccggcggcggagggaaggcgcggttcgggcagcaaatcgcaaatgcggcaagggcggcacggctccctccaggtccggtacgcttcaaacctcttcatccccgccgccggcagtcttgtcgataatgctggtgcatggctagtcgtcatctcggtattggaatccggctaattcagatcctgcaatttgacataataatatattactccctccatatatttttatagtaatatttccaaatctgacaaatttatttttgataggtatatttcaatccaacaacctatcatcttaatgactttctcggatttaatgcatgactctctattcttccacacaagatgggcattgagaaatgtaaatattaataaatcgcttgtttacgaggaatgactagtagcatgtttaaatggatgataagtagaattatttatccttgatctgtgtgtcaagataaaaatatgactatcaaaagcagataaagggagtaactagcatggtgcctcgcgtggctagcgttcgtcgaatttttaatttcgtattttagttatttctaaattatattttttataagctttaaactctacttttaattttattattttctaattcaaaattcaaatagttctaaattgtaaccggtgtgaactttaatctcctctcccattattacttattttttaattacgaatttcagttatttttaaattagatttttatatgtactctattgttttatttttctccgattaatatgataatttcaagactgtgagaaccaaacgtgtagacttatttttctattgttttaataaaataataataatagatactccctccatctatttttgatatttatattttcaaatctaaaaaatttattttttgataggcatatttcaatccaacaatttatcatcttaatggctttcttaattaaatgcgtgactcttcattcttccacacaagattggctatatgagcattgagaaatgtaaatattaatgaatcgtttgtttacgaggaatgactagtggcatatttaaatggatgataagtagaatcacttatctttagtctgtgtgctaagataaaatatgactatcaaaagtagatggagggagtagtatattaatagggcaccccaaaatgtccccgatactacctgcgctgcgctcgtctcacataaacaattactcccgattgctgagtaggactgtaggactagttgacttctagtatcgatttagaccctgtttagatgggactaaaacttttaaatccctatcacatcgaatgtttggacattaattataaatattaaacgtagactattgataaaacctatctataatcttggactaattcgcgagacgaatctattgagcctaattaatccatgattagcctatgtgatgctatagtaaacattctctaattatagattaattaggcttaaaaaaattgtctcgtgaattagctttcgtctatataattagttttataaatagtctatatttaatactttaaattagtgtctaaatacagggactaaaagttaagtccatggatccaaacaccatcttaagaactttacagaacaagatctacaaatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaataactgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctaaattaataataaagtgaggagtatattgtagcaatcgatgcaaccaatcaaacccatccacttagatccagaaagtcaaatagtacttacattcagtctccattttgcacaaaagcatttgctcatactccttgccttctccacccccacccagcaactttgcttccccctgtgttcttccttagctcgttccttccgatggcggagctaatggccaccatggtggtcgggccactggtgtccatggtgaaggagaaggcctccagctatctcatggagcagtacaaggtcatggagggt

SEQ ID NO: 21377 - DNA, 3482 bp, Oryza sativa
  unsure (1)..(3482): unsure at all n locations
ggaatgggggggatgggcaagaccaccttagcgcagctcatttacaatgaccctcaaattcagaagcattttcagttgctcctgtgggtgtgtgtctctgacaacttcgatgtggattcgctggccaaaagcatagttgaagcagctcgcaaacagaagaactgtaatgaaagggctgaatttaaagaagttgtgaatgggcagaggttcctcctcgtattggatgacgtctggaaccgtgaggctagtaagtgggaagcgctcaagtcctacgttcagcatggtggcagcggtagctcagttttgacaacaacccgtgataaaacagttgctgaaataatggctccacctaaagaagttcatcatctcaaggacttgaatgaaaactttataaaggaaattatcgagagaagtgctttcaattcagaagaagagaaaaggcaatctgagctactcgaaatggttggtgatattgccaagaaatgttctggttcccctttagctgcaacagcattgggctctacactgcgtacaaagaccaccaagaaagaatgggaggctatattaaggagaagcacaatttgtgatgaggaaaatggaattttaccaatactaaagcttagttacaattgcttgccatcatatatgcggcagtgctttgctttctgtgctatttttcccaaggatcatgtgattgatgtggaaatgttgatccaattatggatggccaattgttttatcccagagcaacaaggagagtgccctgaaatcagtggtaaaagaattttcagtgagttggtgtcaaggtcattttttcaggatgtgaaggggatcccatttgagttccatgatataaaggactctaagattactgctaagatccatgatcttatgcatgatgttgcacaatcttccatgggaaaagaatgtgctgccatagattcagaaagtattggaagtgaggacttcccttattccgctcgccatttatttttgtcaggtgatagaccagaagttattcttaattcttccctagagaaaggatatcccggtatccaaacattgatatattcctcgcaaaatgaagatttacagaatttatcaaaatacaggtcattgcgagcattagagatctggggaggtataatcctgaaaccaaaatatcatcatcacctgaggtatcttgatctctcatgcagtgaaattaaagcacttcctgaagacataagcatcctatatcatctgcaaacgctgaacctttcccactgtagcaatcttcatcgacttccaaagggaacgaagtacatgactgccctccgtcacctgtacactcacggatgtgagaggttaaaaagcatgcctccgaacctcggacacctcacttgcctacagacgcttacatgctttgtagctggtgcttgctctggctgcagtgatttgggagagctgcggcagtcggaccttggtggtcgactagagctaacacaactggaaaatgtgacaaaagctgatgcaaaagcagcaaatctcggaaagaagaaaaaactgaccgaattgagcttaggatgggctgatcaggagtacaaggaggcacagagataatcataaagaggtgctggaaggtctcacgcctcacgaggggctcaaggttctgagtatatatagctgtgggagcagtacatgtccaacttggatgaataaactacgagacatggtaaagcttgtgttagatggttgcaaaaatctcgagaagcttcctccactgtggcagctgccagctctacaagttctttgccttgaaggactggatagtttaaattgcttgttcaacagtgacacacacacacccttcgcattttgcaaactgaaggagctaaccttgtcttttttttttgccgggtcggccgaaaggttcggtcgaccaaatttcattaaggaaaaggggaacaaattacaaatgggctttatatcgacaataggatgtcgagattaggctggggacaggtcccccccaatcaaagccatacacaaaagcccgaaggctacaaagaaagtatgatgtctctattacataatctgaaaatagcctccagacttccacatccaaacttcttctttgatgtcttccagtaactgctccacggtctgctgcttgtgctgaaaaattctggcattgcgctccttccaaatcagccaacaggtcaaggcgaaaacgctgtcaaagttgctcctgtagctgcttcgaaaatggcatcgtgccaccatccaccagcctatcagcccctctcccgcttgtcctggcagagggaaatccacattgacccatgctcgcagcagctgccatactcgcctggagaaatcacaggtgacgaacaagtgtaggcaatcctcctattcgcgttggcagagtacacagtgatcttcatggggccatcctctcttcgccaagttgtccgccgtcaagcatttgccctttgttgctagccaaagaaaaaatctgaccttcgacggagcttttgtctgccaaattagctgtccgcaaggagaaatctcacgagccatgaaaaagagatcataagctgaggacactgagaaagaaccatccggagtgagcttccagcgaattgtgtcctcctcctgactgagattgatttgttggatttcgtcccaaagctgaaaatactgcatcattgctatatccgagagagatccttgcaaatctctcacccatcgatgtcccaggagtccctgttctactgtgagcttagttctaccaataaaagtcgcaagggtgggccatctccaggcaatgcttcctccacctagccaattgtccgaccaaaatttagtgtctctaccattgcccacacagaattcagatgcagattggaagattttctcgtcatctgcgctcagtctgaagtcaacaagggtccagggcctatccttctgatgtaagcgattggctggccatttcaggcgcagcgctttgccgaagagctccaggtttcgaatgcccaagccgccattttccactggtgtacagacatctttccaggctacaaggcaatgtccaccactcacctcctgctgtcccttccaaagaaatccccgacatttccgctcgatgtccttgattgcccactttggaagttgcaatacagacatgaagtgaactgggagggccatgagaacggatttaatcaagcagagccggccatcaggggacaacaacttgggcttccaacctgccactttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21378 - DNA, 591 bp, Oryza sativa
gttccttgtcagctgataaattctgtgggcttagcactcagcatgttgttttacccgtgcatatatgagttataccttccattatgatcattatttaatcagctgtttaactgttggttttcttcttcagtaaaaccggtaagggtgatgcccttttgttcttcagtctccaccccgatcgcacaccagattttgcaagcttgcacggaggtggccggttcattaaagttcaaagttgttcgccacttaatggatccatgtgaggtccttcgacatttctgtcaagcagggagcttccactgacgggtgcgaggatgagaacgtcctctgcccccagtgggctgcagtaggggagtgtgccaagaatccgaactacatggtgggtaccaatgaagcacctggcttctgccggaagagctgcaatgtgtgtgcacagtaagttactgatccacccttgtgatacatagcagcacgccctcgataattgttgccgcggtaccgggtgtatataggactgagcatagcatgtgtaacctggaaggagttaagatgtactaagatccatttcgcctatatgcacctagaaaaggg

SEQ ID NO: 21379 - DNA, 686 bp, Oryza sativa
cccgcgttctgctgccgcggcgcgcacggcacggcggagacgtgccgcggcagcgcgtactcgcgggtgttccgggacgcgtgcccggcgtacgtcagctacccgtacgacacggcggcggcgaggtgctacgcggaggtgtacgtgctcacattctgtccgtccagatggggcgcgggggcagatcgtgtggcccaggcttgacggatatgatgtgagacgtatcgagtagacgagtaacactccggcatgcgtgtatctaagtaggagtagtatgtactatatacggagtatgtatttatacgtgtactattacgtatttacattcattatcgggcgaacactttcgttatagggttaattaagtgcttcctcagttttaaaatataaatatttttagctacaaaatctaaataaataattatctatagatacatagctaaaatgctcatattttaggacgaatgtaataagttgttaaagttcagtagttctctgtaaaaagaatatcacgtacgtacacatggcatttcatagtcgcatgcatagtagaattaaaatgcctattatatcctcacctataccatagaaaaaataaagggaaaaaaaagcttggtacattaccatgcaattaattaagtaattactataacgaattaaaacactggatttgatagatttcttat

SEQ ID NO: 21380 - DNA, 637 bp, Oryza sativa
aggatcagttaaatgttttctttggacaacggatttggactcattcaggcctcgtttggatgtgtcgaaatccgaaagcccagtccatatatgcatgtatgggatttcagttcacttttcatggcttacatgtggatggactgggattgaggcccatccaaaagatatgccttgggagaactatgcaaggtttacatgaaattaagatgcatccacatctctgaatcttgatgcatggctttagtattacatgtttgtcagggtgacctatctttaattgactttttttttggtgggggaatgggggttgggggttttatacaattcttcataccgataaacagtcttgacttgatgcattatggcgtcatgggggtcgcaggtctcatcactttttcaactgttctcactctgcaggcaaatacacacgtaaatgtccatcaagacctcaaagatgtgaagctgtgggaggtctgtgccatcacattttctttatgctagttttgtgtaacatcttagaatttcagattgacactgtatggcttttgcaggttcaaactctcctaaaagggttggaaaaaatagctgttagtgcggacattccaatgttggtctgtggggatttcaattcagtccc

SEQ ID NO: 21381 - DNA, 709 bp, Oryza sativa
actcatgatgtttttaagcggccccattgtaatatcactttctatagaaggaaagatctcctgagagagagacatttttatgacagattcagatgccatcatggctaggccatttcaaattttcaatcccttctcttctagtactatactgcagtttttttacccaaccctgatcgtgcagtgtgtacttgttggaacttgtcaaacttttatggcaaattttagttgttgcagggttgacaaatggggagatgaatggttggtgctttggtgggcacctgatgtcttggccatttatacaggtactgtggttttgctgtttgtacgtagtatagatggtagttagccttggtgtccatgtgccaccgtgtcatgagttggctggaacatgttacatgtatttggcttattctaatttggcttgtctgatctgatcgccaccaaacgctcaacatttaggcgatgaaaacagcgagagatcgctggagataacataaccccgtggtgttaatgaccatcgggtatcaagctcaccaatcttgatttggtcatggacattactaatcgtactcttggaagtttctctcttcgttggttggtcaggtctattgggacccacttgcagcgagaggagtggtgggcccacccctcgtggcgcaggtcgatgctggactgggagtgacgggcgcgaatttttgggctgcaggaa

SEQ ID NO: 21382 - DNA, 2693 bp, Oryza sativa
gtcctattattgattaagatagctaattgaatccataggaatcctctctagctaatcctatcattgactaagctagtgttgatgcgaaaaacacacactggcctgggagatctgcttagctccagtgcaggtccaaagcttgatgagatgcgggcgtgccagtcagtttgatcctgcaactgacaagatatgtaaacagtagatcaatgagccgatcggctgacaagccgatggagtagttccagtcgatgccgataatagctgatgccgaaaccagccgataacgatagggtttaaacaatcggctatatgtccaatgtagataatgatataaaggcaatcggctaatgatgatgtaataaaataacaatatgatccagtataaaccaataggctagcagtgtgatatgatagaataagcattgatccgaaggataaagcatgtatcggctggaggtccgatgttataaaatccacaagattagattaaacagtgaaacctttgttgtcattggctaaatccaacttatatatacaatccttatgagccgatgcaacgtccagataattcattggctgaaaccccaatgaaacccttcttggcaatcaacaagcaggctagagattatggttctaagcacgacttagtagatcaaacttaactgatgcagcactaagtatgacaagaaacataatatctagataatcaagccgttgactgagttttctgggtggtagatgtctaagctaatctaatatagcaacgcgatttagccgataccggcagaaaccctaaagcgagaagtagccgatagagctaaattgatatgctaagactagattaacagagacatatgataaataggtaggcaaatataccatccaaaccagagcaatccaagaggtcgaatgtactgatgcagccttgaacgacgccgacgtagatgatacaattgcctgggccagcggaacataggacttaacccttcgccggagatcgaactaaaccgatgcagcctcgcgttaggtgccaggttccgtcggttgataagtaaaacctcaggaaagagggtggcgatgcaccgagagtagttgtgttgatcgagattgataaattacatagaccctaggtgtacatatttatacccatgggttgatacaagtccttgtcagacaggaaagaaactttcctaaagataaaaggaaaacataaagtccttatcggacactaaacacaccttcctaaagataaaaggaaactaacaaactattcctaattaatagataaactgccatgccgcatccttcttgaacccggactcttctggataaattccctttagttgatccgactccatcgagaacacggttgctagcgatttgacgacccccatcggctgattccataactctgaagccaatgctgactctaagccgatgatgactttgggcttaccaaatttcgtcgttaacacatgccccccagttttggagtatgaggactcatgctccaaaattctcttgtctgatcttgataactccaaaatcgatcttcccttgattctcgcaatcggctttcattatccggtactgtctgcattaaatgagctagactatcaaactcgtggcaaaagaatctctctctgataggtgctgacaatccttggaatgcaagatctgcgagttgttcatcacttagactcaatccatagtcgattctccttcttgctgctcaaacgttattaaatctgaaagcttcaactctttgattctagcaaagaagtgtcatgaaattgcttctcaagatcagcccatccttggatagaatctgatggtagcgatgaaaaccatgtgaaagccgatccagtcaaagacaaaggaaaaaatctaactttcagagcttcttcagccgatgcctgcccacattgtgctaagaatcggctgatgtgttccattgtagatgtatcatcctgcctgaaaacttggcgaaatattgaactttgtatcggtgtagcaatggcaccctatcaaaccactcaggatatggcagccgatacgcagaagtatgttccttatgtttgattccaaactgctcttctattatctttgcaattctatcagccaaatcattgttatattgatattcttcatcatacccatattgacgaagttcttctggctgatattgatatgcttgcccccgagctaattcttttgagcaactatttcaggtactatcttcttgatcacatcttgtagtgtactcaccaaaactccagactgatcaaataatgtgtgatgaaccgtgtcgcttcccaaatcgaccctaaaatacatcctctaaattatgcctagaataattaaaatgcttgtgaaagccttcaaaaattaaaatgtgcaaagttaaaagtcaaatagggcttggaggatttttgtatatttcctaaaagcctaaaatgtgtaaataaattttagtggaattttcagagcacaaataataattattcagaaataaacaaagttaaaatgattttataaaaagaaaaaccctaaaaatcacctctcccctctaatgggccggctcggcccatctccctccccctctctcctcctccccgcggcccactcggcccttcccgcgcgcgccccgctgacgggcgggcccgcccgccacccttgttgacgggtggggc

SEQ ID NO: 21383 - DNA, 15664 bp, Oryza sativa
atcatgcacctggcgcgcatggtggaggcgtacgatgcggcccgtatcgacttccatcatatggtgcgccgtgggatggtcgtgaacaacatgaagatcctggagctgcgtcaggagaatctgcagctgaagaaggacctagacgcgctggaggcgcagctatgtcagctcaaggtcgcctagggagaggtctgccgtcccaagcgctgccgcgtctgccgtagccagaagatcaccgcccgcaagagcacctccaggcctgagcttgttcgtcagtccctggcgtggacctgcttcgtggagacccctcgtgccgagcccgcgcccatggttcctcaggagggggaagcctccggcgttggtagcacggaggatgcgctgctgctcaccttccgccctggcccgtcgcagaagtagacgagcagttagtaggcttgcgcgtgtgttctttctcgtttgtcttcctgttggagtcgtgtggggcatggttgtaccggtgtgtggtatgactgtgtcggagcctgtctttattttattggcttaagcaacctgaacattaatgaacctattttatatcagtaataagttcaataattttggtagtcgtgggtggttagttttaatagtctgttctctctgtcggctggtttgttttggggtatttcagatggtgacaaccaggagaactgctgctatcggtgatggcaaccaacccgaaggtagcaaccccaacatccaaggcggcccacctccacctcctcccccgccaccaccaccaccaccagacaccaaccccatcctcactcaaatcctcgcccagcaggccaacatgatggctgctttcctccaccacatccaaaatccaccacagcataatgctccacctccaccaccacccccgcagcattctaagctcgccgagttccttcgcatccgcccgcctaccttctccagctccaataaccccgtggatgccttggattggttgcatgccgtggggaagaagttagacaccgtgcagtgcaacgatgaggaggaagtcatctttgccacccaccagctgcaggggcccgcatctctatggtgggaccacttccaggctacgcagcccgaggggcagcctattacctgggcccgcttcaccgccgctttccggaggacccatgtgcctgccggagtcatggcccttaagaaaagggaattccgggagttgaagcaaggcaaccgctctgtgatggagtatttgcatgagtttaacaacctggcccggtacgccccggaggatgttcgggaagatgaggaaaagcaggagaagttcttggcaggaatggaccctgagctatctgtgcgtctggtctccggggattatccggattttcagcgtctggtggacaagagcatccgcttggaagccaagcacaaggaactggagtcgcacaagcgtcgcttggcgaattttcgcaatcaacagggggctaaccaaagggtccgctacaccaatccctatctagggggatcctcctcgcagcagcagcagcagcaacctcgctccgcgccccgaccccaattcgtggtgcgcgtcccacagccgcagcaacagcagggtcagcaagggacccgtgcaccccgtcctcctgcgccagctgtgtagcctggtcaaggccgcagagacgctcaaggacagcagcgtctgtgcttcaactgcttcgagcccgggcactttgcggacaaatgcccgaagccgcggcgccagcaaggccaagcgcctccccgccccaacaacggtggtaaggacgtcgctcagggtcgtgtgaaccacgtgactgtcgaggatgtgctgacgactccggacgtcatcgttggtacgttcctcatacattccattcctgctaccattttgttcgactctggagcttcccactcgtttatatctgtgcctttcgtgggaagaaatcaactgggggtagaacggcttaggaaccctctgctcatcaccacccctggaggggatatgacagcaaagtattacagcccggccgttcctatagaaatccagggaatcccttttccctcggatttgattcttctggacaccaagaacttggatgtgatccttgggatgaattggttggctcaattccaaggtgtagtggattgcgtaaggcgcacggtcactctgtaccgagggccggaacaaccagttgtgttctttgcacccccaacctctgttggcagttcagaacttcatcagataggactgtcagaaatccctatcgccagtgaattcggtgacgtgtttccggaagaactacccggtatgccgcccaagcgggagatcgagttccggatagatcttgctccaggaacaactcctctgtacaagcggccctaccgtatggcagcgaatgaacttgccgaagtcaagaagcaattggaagagctgaaggaaaaggggtatattcggccgagcacttccccctggggtgctcccgtgatttttgtggaaaagaaggacaagacaaagaggatgtgtgttgactacagagctctcaatgaagtcactatcaaaaacaagtaccctcttcctcggatcgatgatctgttcgaccagctcaagggtgccaccgtcttttctaaaatcgatcttcgctccggatatcatcaattgcgtattcgtgaagaagatatcccgaagaccgcattcaccacgcgatatgggctgtatgaattcacggtgatgtcgttcggtctgactaatgctcctgccttcttcatgaacttaatgaacaaagtgttcatggaatacttggataagtttgttgtggtcttcatcgacgacatcttggtgtactcgcaatcagaggaagaccatcagcagcatctccgtttggtgttgggaaagttacgggaacatcaactgtatgccaagcttagcaagtgtgagttctggttgtccgaagtcaagttcttagggcacgtgagatctgctaaaggagttgctgtggaccccgaaacggtgaccgccgtcaccgattggaagcaacccaagacggtcactcaagtccgcagctttttgggtttggccgggtactatcggaggttcatcgagaacttctccaaaatcactcgacccatgacacagttgttgaagaaagaagaaaaatttgtgtggagtccgtagtgtgagaaagcattccaaactcaaagaaaagctggtttcctcgccagtgttaatcttaccggatactcgcaaggacttcctggtgtactatgacgcttcgcgccaaggattggggtgcgtattaatgcaggaaggtcatgtggtagcctatgcctcacgccagctacggcctcatgaaggcaactaccctacccatgatttggaattggccgctgtggttcatgctctaaagatctggcggcactatctcattgggaatcgttgtgaaatatatactgatcataagagtttgaaatacatcttcactcagtcagatctgaatcttcggcaaaggagatggttagaactcatcaaggattatgatgtgggaattcactatcaccctggcaaggccaacgtagtcgccgacgctctaagtcgaaaaagccattgcaacactcttggcgtccgtggcattccaccggaacttaatcaacagttggaagccctgaacctaagcatagttggtcgtggattcttggctatgctggaagccaagcctaccttgctcgatcaaatccgcgaggctcagaagaatgatccggatatgcatgggctcctcaagaatatgaaacaaggtaaagccgctggtttcacagaggatgaacacggaaccctatggaatggaaatcgggtatgcgttccagacgtcagggaacttaaacagttgatacttcaggaagctcacgaaagtccctattccatccatcctggcagcacgaagatgtacttggacttgaaagagaagtattggtgggttagtatgaaacgggaaattgcagagttcgtggccctttgtgatgtgtgccagcgtgtcaaagccgagcaccaacgaccggccggactcctccaacctctacaagtgctagaatggaaatgggatgaaattgggatggattttatcaccggacttccaaaaacccaaggcggatatgattctatatgggtagtcgtggatcgactaaccaaggtagcacgattcattcccgtaaagaccacctatggagggaacaaactagctgaactctacttcgctaggatcgtaagtctccatggcgttcctaagaaaattgtatctgatcggggaagccagttcacctctcatttttggaagaaactccaagaagagttgggaacccgattaaatttcagcaccgcgtaccacccgcagacagatgggcagaccgagcgtctgaaccagatcctcgaagatatgcttcgcgcatgtgtcctagattttgggaagacatgggataagagtctcccttatgccgagttctcctacaataacagctaccaagccagcatacagatggcaccgtacgaagcgttgtatggccgcaaatgccggacaccactattgtgggaccaagttggggaaagccaagtgttcgggaccgatatcttgagagaagctgaagcgaaggtcaggaccattcgggaaaacctaaaggtggcacagtctcggcagaagagttatgcagacaaccgacgccgtgacctggaattcgcagtggatgactttgtgtatctccgggtaacgccgttgcggggtgtacacaggtttcaagcgaaagggaagctcgcccctcggttcgtgggtcctttccgcatcattgctcgacgcggagaagttgcttaccagttggagctgcccgcttccttgggcaacgtgcatgatgtgttccatgtgtcgcaactcaagaaatgtcttcgagtgccgtccgagcaggccgactcagagcagattgaagttcgcgaagacttgacctacgtggagagaccagtgaaaatcctggacaccatggagcgcaggaccaggaatcgggtaatccgtttttgcaaggtccaatggagcaaccatgccgaggaagaagctacttgggagcgtgaagacgagctgaaggcagcccatccagatctcttcgccagttcttccgaatctcggggtcgagattccgtttaaggggggtaggtttgtcgcgtcccaaatcgaccctaaaatacatcctctaaattatgcctagaataattaaaatgcttgtgaaagccttcaaaaattaaaatgtgcaaagttaaaagtcaaatagggcttggaggatttttgtatatttcctaaaagcctaaaatgtgtaaataaattttagtggaattttcagagcacaaataataattattcagaaataaacaaagttaaaatgattttataaaaagaaaaaccctaaaaatcacctctcccctctaatgggccggctcggcccatctccctccccctctctcctcctccccgcggcccactcggccctccccgctcgcgcgccgctgacgggcgggcccgcccgccaccctcgctgacgggtggggcccacccgtcatccccttcctcccgccgcccccgccacctcgcccgcgcctagcgccgccgccgccgccgccgattccgccgcatcccgccgtccccgcgtgcattaaagtggggggaattattccccgggatcctctccccctttcgccccatttttccctccctctctccctcggattcgtttagaaacctctcccctaacctcaccggcgccattaatggcggccgggtctcccgcgcccatttccccctcctccggccgccctctctcactcccaaccctatataaaccctccccgagctccccaccgtcgtttccgccactcaccgccctctctccccgccggaatcgagctcgcgccgtcgctctctctctccgtcgtcgccgccgagctccggtccgccgccgtcgtcgccccggaccacctcccacctcggcgccgcctccttcggcttcgccgcatccccgccgacctcgtccacctctccatttcggtcgccgaccgccggagcgccgccgaccccgtcaacccgagccacgccaccacctccctccgctccggccgcctcctccatcgccgccgtcgccctcggggtgacgcgtggaccgccgcctcctttcccccttccctcccctctctcggccgctgctccgccgtgccggtggtcgccggcggcgaccatcggggcgcgggcgccgcctcccgccggccgcgccaacgtggccgcctccgggcgcgcctagcggctgccgcgtggggcccggccgtcagccgcccccgccctcgggtgcggctgacgcgtggggcccacggcgccggccggtgtgagccgggtgcacccggtccaccgtggaccgtgaggctgccgcgtgggccccactcccgtggacccggtccgcgcgccctctctcccggctgacgcaataaatctatttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcccttttcttttccgttggtcgtgtagacgctgcagcttcgaaagatccgctcttcgtggaggttgaagccgacgtttgggaaagcgagcaaggcaagtcacatcattctttgaacatattggatcccactttgtgaaattactttgatttaaattattgcattatcgctttatttaaattcccgcgttatcgctgttttatttagccatgcctatttacctttgttatgaccttattattattgctattgttattattaccttgttcaccctagaataaacaaaaccccagctagtggatactctattcatggttccactagtatgaatttaggtagatgcttcgctgattaactaggcaacattaggtggttttataactctagactttgggaatattcatatcacttggacactatggaatggttggattattgtggaattggatgcacacctccccctctattcaaaaccctcaaaatggttttaggctgggctcggggtgcatggttttattagtagcacctcggccacataaggaccggtcttcgggcctctgttgcaaagcactaccgtactttcacatgtctagtgggtaaggcttagtttgtggctcagtctggttataaacaaaagtacacggatggagatggacgaagtcgggggtcgatggacatctctaggagaaatgaaggctatacgggctgcggcccggtagtcgagatgtcatggcacagggctggtgtcctgctgctaggggctcaattctgcctgcctgtccgggggttccggccgtaggtgggttgggtcggtactcttgtctatggctaggatgggttggaaactatgtcatgtcttccgtccatatgccgtggtggtatgtggcacgtggttgcacgtgaggaagatgtgtcttgtgggtaaagatgtacacctctgatcagagtaaaacctattcgaatagccgcgccctcggttatgggcaagcctagcaatgtacccaagttagtgtttttaattcttaaaacttgcttaataactaaaatgtggaatggttggcctgggttggcttgggacgagctgggacccagggtcgggttgccagttcggtctgaatcatcgtagtccttgggttaaggcaggttcgtgtaggttcacggccttgtttaataatattaaatagttctaggatcgtgttttaaatttagctttgagcaactaagggtccttcaaatgctgtttattgcaaaacctaacccctatatgtcacgaccggaaataacccaacgggcgttccttacgtgcgtgtattattccttgtcccaggaggcaaggtacaccaaaagttgatacaatttagagtttaacaagtggaagcgtaaatagttaatttattacatgggcagcgaaggcccagcacacacaaagacaaacgagaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacagccacaagtgcagaataaatgcaagggagtacaaaggagttatactataaagggttagggttgcagtaaacagcatttaaagatatttagttgctcaaaactatttagtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccaccttttagttgttaagcaggttttaagaattaaaacactaacttgggtacattgctcggcttgcccataaccgagggcgtggctattcgaatagattttactctgatcagaggtgtacatctttacccacaagacacatcttcctcacgtgtaaccacgtgccacataccacctgtcgtaggctctccggaccttccattataattgagagatgaaatgtataattcaagtcattatactagtataatgaaatatccgacgcctcgagagaggaatattggagacattgccgggcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatctagttctcaggatgtgcactagattcacactttcatctcaagcatgattatacatagcaaacacaaataagatgaaagcgattataaactacatctaatttagatacattggccgactggccaaaaaaaaatatatatatatagaacagcggaagcttgtctacccaatccacaagcacaccgactaggggtttaccccattaagttcaagtcctagaagaagcagtcgatcacccgcatcactcaaaggctaagtctaaaacctgcaagcaaaaggttaattccacagcaagagtcagtacattattagaaataatgtactggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtatttgacatattgggcatcaaggtaggcattaatcatgtataaatatgcacctcattgccttccatggctgcaaggagatcattctcaaatctcatcacaatttgaagttaaatttcagcatttagaagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaatgccgttgtattggacagacttagtcacctaaactaccacgtcggggtaaatagaaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcatcatatgtgcaccacttgaggcccaaccctaaaatccatgttttccaccattttatttatcaaatacttcatttattcatatctgtcccaaacttaataaaatcatttttcatgttaatatgagcccaagtgataagtaaaactattctaagcatggctaagcaatatagtgaactagtgacaatgtaactcatattccaagtagtactaggatatgattcctaaggttaggaatgagggagatggatatatgtggggttaaggtgataatgcaaataataggagtttgtctaacaagtttaacaagattttaatgtattagtgtagaatcgacatgcaagatttgcaaacattttcaataacctccaaaacataggttcaaagtgatcaaagagagggaggtgggacttgccttgaatcaggaaaatgtcagcacctaaatcacttcttcaccgattaagcaatcatctatacaaagtacacgtaatgcaattaaacaccgaaatatgcgaaaaatccaaaatgttctaaaatgcatgatttgtgcacagagaataggtactggtataaaatgaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatacgtgttttctaagactaacacatttggtttcataatttttagagttaatatgaattatttatgtattttacaagttttaacgtgttctaggcatatagtccctatgtgtacatggctttggagatttaggtccagaacttgctctaacttgctagtgttgtataaaatgtgtattttagttaactaatctaatcttagtttataaaatttagtgttcaaattactttacttcacattttataagctaggggatgttctatgttagaaacttaacatatcaatctggagattattatatgagttaaggatactaagttttggtggaaggggatggatctatgccttcactggttcaacaagttttatttggatttatttggagctaccatgcatatatatactttttcatatgtattgtttaaccactactatgtgtttagttcctattctaccaaattaaggttcagagccatggtctgtaaagagggtgctataattcactctactaagttgaagtatattacttgctggttctatagaaaatttggttcacttcattttgactatagatgaattttctacaaatgttacaatttaaggtatgctccatgttgcttattccttacttaaatacttaggggttttcgttatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataagtttgtgcatgctttatgtgtgacttaacttggataaattttagaggctaaatttgtactgtgagtgcaagtttttattccataacactaaagttcacaatttggtgagttcacagaaatttgtatcatcttaaaatgagctatatttaattttatatggattttacaagttttaggtacttttcttttataatttcagatttttgtttccaaggggtccactgtcagtgaaatattaatatacaaaaagatccctgaggtttctaagaatcaacccgcagacctagcctcatatgtcagtgagttgaagagttgcacattaatccttatagttgtttaaattctcgaaacaaggtccctgacttcttttctcacgcacagaggcagaacagccatggctgagctcgatctcgagctcaccggcgacaaacgatggctcgtttgggggtgcgaccaaaatacaaaatgaagatcatgttattgcgattccattcctctacttttctcggttagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgacctgaggtggagaagacggtggacgatctccacactcgtagcaccatccttcgagattcttgaggggaaatggagaggaggtcgaggcgaagacgctggcgcgacagcttggcccggcttggtgcagataagcgggaacggcgatgatgtcactgcggcggtgcacagagcgcgctccagagctccggtgtgcactgcagcgtttccgtcgattggctgcaccagagaggatgaaatcaaaaggagaaatattcggcatggtgaggagagtatggaacgcaagagaagaggaaacgaccgcggctcatcaacgattgcggccatcgtcttcttcgcggccggcgatggagaaccagtggagaagagcagcgaggatgctctccctcggatggatcggcactggaatggtgggtgaagagtggcgacgcgtctgggagaggcagaaatggagctcgtcgtttttagggtgtcgacacgtcgtagccacgcgtcgcgcggcgtccagagccggtcggcgctcgatctctccctctcagtgtttctcggtcagctagggaagttgcacagaggaagggcaagccagagggactgacaagggggcccaggtcgaagtaaactaggtggaagagagatgtgtagggagaaacatgggtgagcttggtttttggacgaatttccggaattattttctcctctaattttgtagcttcaatacttaatgtgttgatcagattagctagtgttgattttactggaggtaggtgtatgtacctagtttccattttctttggttgcactcaaaaattatggatagattactcacagaaattagaggaatatgggttctttggaaactagttcgaatttttaggagacctaaacagagaagataaattctggaaaaattatttttattcatgataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttctctttcctaaatgcatgtaaatgtttataaaagttatatttggactctcattaacctgaggtgatgttgatatgttagaattacagtttaccttacacatgtcataagctccttccctatttatgcataagtttactttagtattaaattaagagaatgcttatagagatgattaagatagaatataccctatatgatataatttatttgttcactttcatgttcatgacatgtcttcagatggatgtccaaattagttttgtgaggcttgacattagccatgttgatatttttttttaaggtgtatggtttctatgtattattttccattagttaacactaggccctaatggtttagttgtttatctagatcttagttaatattcatgagacctattatgaaatgcaaatcgaaaatccaaatgcataagaaggactcaagtcaaaatatgatttatgcaagtatgcatgctttcacttgggttgcatccaagtcctaggttaaagatgaaaaagtttttaatttgttctcaaattttattcatgcaagagttggatcaactccacctaggtttaaaatggaaatttttggtttacaaaattgaagaacttccctttcaactagttttgatggaaattccttaatcctagaattcaggtatgttacaccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacatcttccatctccatccgtgtacttttgtttataaccggactgagccacaaactaagccttacccactagacatgtggaagtacggtagtgctttgcaacagaggcccgaagaccggtccttatatggccgaggtgctactatcaaaaccatgcaccccgagcccagtctaaaaccattttggggattttgaatagaaggagcggtgtgaagccaattccacaataaccaaaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttattctagggtgaacaaggaaataataacaataacaatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccatgctcgctttcccaaacgtcggcttcaacttccacgaagagcggatcttccgaagctgcagcgtctacacgaccaatggaaaagaaaaggcttttactctaataaactccatataacaagcagaaacaaagcacaaaaatcattttctaaaaggaataatagaattaattaaaatttggaaagaaattggcaaacactaaaatacgtacaagaaaaattcgaatgtggcccggagaatttttgttaaattctccttggtcaaaaaggagccctcaaattttacttgaattt

SEQ ID NO: 21384 - DNA, 8740 bp, Oryza sativa
accactggaaggtttctctgaaaggcagcaggctcaagtaccacatcgtcgccagaagcatacacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaagcttcagatttggcagggtaacgatcaaaccataacaagtccagcagtaaagtcatctggaaaggcgtcaaagcatgtcaagtgggataagttgactctgttgagaaacataattgaaaggcgaaaattatcgaccctcgcatcgaatagcagaagtagctagcacccggagaccaggaaagctaatatgaggcagtttgtggcaacttagaagtaaatgacaagcatgatattctcataatgacaagcatggtatcctagtaatgacgagctgatctcgacgcataacgtgaaatgggtaacttctatgaggttgacgccaaaaatatgaactatacgaagttctggaactgaagccccatcttcaagtgccgcaacccagacgaagtcagctaaaggttcaaccagggacaagtcaggtgaagagaagattccatctgcaacaggagatcgagacaagcagtacagagtggagaagttttgctaggcaagtttgttatagaagacgcgacggaagaagtcagataagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcaaaaaggagccctcaaattttacttgaattttcagagcaccggaaataattattaagcaacaaaaacaattatcaaagtttattaaaaagaaaaacctaaaaataaatcctcttcctcctttgggccaagcccagcccaaagtctccctctcctccctctctttctctccctctccttctctccctcctcctcttgggcctcctcccctcccggcccactccctcctccctctctctcccgggctccctcgccctcctctcctcctgggccgcctctcggcccaagccgttccgccccctcccacctgggccgcctccgggcccaacccgagcggcgccccccctgcctgagccagccgcgtgcgcacgcgcgccgcacgcgcgctgacgccgcgcgcccgcgtggggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgctaccccctcgctccgttctatcgttttagccccctcccgcgatctcccgtggtccctagccctctccccgccgtcctcctctctctcccgtgccgccggccgcctccagccgcctctccctcctcgccggagcgccgtccggtcgcgccgtcgcctcctccagcatcgcagtggcctccccttccccggcttgccctccgtttcccgcggagaccaccggagctgcgttcccgccgtcgcccttccctttcctccgcgccggccgcctccagccgcctctgtctccctgcctgagcgccggtcgacgtcgccaccacctccctcggctccacgacgccgctctcatcaacggcatcacctcctcctcgcccgaatttcgccggaacaccgtcgcccgcgccggcctcaccttcctcctcgtcgacgtctcctccggcaacccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcacccgtgcaccggtcggccgcacctccaccaccttcggcatcgcagccgcgacgccaccctcggcctcgcctccccttcgaccgaaccccgccggtgttcgtcgtcatcgtcatcgttcctcctcgccggctcgtcatctcgcggcgccgcctccgtcgtcggcattgcagcggcgtggaacacgccgtcctcgtctccgtgcagccgctgccggctgccctcgtcgcctcctcgccggctccggtcgtcgtcgtcgtcgtcctctcgtcgttcctggtttcgctcgttgtggcgttcgtccctctgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgctgaagtcgttcccttgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcattcgcttgtgcgtgtggtgaccgtgttagtgtgcccgctcggtagccgcgtggtttccacgtgtgcagcccgtgtggtgtctagtggactccgtttgtcggccactcgcctcggttgacacacgggatccgcttccatcgacccgtggaccgtctctgtgtactcggtctaccgcggtcctttttgttgacatgtggggtccgcatgtcaacggcgcagccttcctgtcttttccaggctagcgcttacacatgttttatagttgcaaagcttaattataataatccgcaaatctccatatgacagcattaaacttcggatgaccatgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgaacatattgaatcccagtttataaaattattctgatttaaattattgcgttatcgctctatttaaattcccgcgttatcactgttttatttagccatgcctatttacctttgttatgaccttattattattgctattgttattattaccttgttcaccctaggttaaacaaaaccccaactagtgggtactctattaatggttccactagtatgaatttaggtagatgcttcgctgattaattaggcaatattaggtggttttataactttagactttgggaattctcatatcatctggacagtatggaatggttggcttatgttggaattggacccacacctccccctctattcaaaacccccaaaatggttttaggctgggctcgaggtgcgtggtttggtttggttagtcgtacctcgggtactataaggtttaagctcgggcctctgttgcaaagcactaccgtacttccacatgtctagtgggtaaggcttagtttgtggctcagtctggttataaacaaaagtacacggattagagatggacgaagtcgggggtcgatggacatctctagggcaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcattgtaggccttgggttaaggcaggttcatgagggttcacggccttgattaataatactgtgtagctctaggatcgtctttataaaatggctttgggcaactaagtgacttttaaatgctgtttactgcaaaacttaacccctatattattatccccttgtactcccttgcattaattacgcatctccggtgtggcttgctgagtactgtggttgtactcattcttgctctatctttctcccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtagatattatcgatataataaagatgtgtcttttatatcatggttgtatggtgtaccccggcttttcctgggacggggattaatacactagcgttcgggaaaatgaaattttcccagtcgcgacaagctggtatcagagccatctcgactgtaggataagccaagtggataaaacctaaggacatattttataaatgaaactatttgcgaaagttcctttttcctcctttcccctatgctatttgcaaaatgtttactctttctttcttcttcaaatttcaactagtacgagatggttagttttgcgaagaagaagatgtcgccaattgtttgccgaagctccggaagaccgcagggtccgctagcgaagtggaggaagcagtgaagccagctgtgaagccggagtgaagatcttggagaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtaaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattccgagtatgctgcttagttcacagctaccattggttcgaagtcaagaccagaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaaatgctttcctcctagcctttcgtaccacgtggggtcacgtactaagcaagccaaaggcaagaagagtaagaatcagaagagaaaagcgtcgatgcgaactgaagaagaagtacgtaagatggctattagcagcaccgaatggcctcccgcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatctcggtgaggaagagatggaatcaaaggcatgcacccgttgtggagaaattggacacattgctagcaggtgtctcacactctgccctcgttgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagctagtcagctccaacagcaacatcgacgatatcatccacagcaccaatgctcctcctgctgcgcctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatgcaatgtaccgatgttaagcaccttcccttcttgtttaaggcaaggccttgtattcatgtaataagggagacatgtgtaataaaaacaagttctatgaggattatttcggaagatgctgatatgggattatgtgtataattgtttactgtcaaaggagacctagggcctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagcttttgacgaaccacttgaaggtttctctgaaaggcagcaggctcaagtaccacatcgtcaccagaagcatccacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtaaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattccgagtatgctgcttagttcacagctaccattggttcgaagtcaagaccagaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagaaatctagatgagatcaaacaaccagcaaatgaaacgatattttagaaaaaaaaaaccagtcaccagataaatctagaaatactaaatggagtgtttttttcattggtaagtgaacacgagtttttagtggtataaaagtaaacatgtaacaaatttgatattatagaatcatatttttcctttttcccaatgtgatgcattttcatggaactttagaagtaaaaccacaaacagcaaattgaaaaggacatcttcgaaagtcaaaaccaattaattaataagtagaccttttttggtatagctgttacaccaaatcgaatcgattaatatttcctttagcttcataacaaattttcacgtgattttcacaggaccagtactcttacg

SEQ ID NO: 21385 - DNA, 2364 bp, Oryza sativa
tgttcttgtggttttgtaacttagggaagtttgagtcgtgtccaatgtggaaaagtttgtactacgggtataaatacatgcctagagtcgtgtattaaaaaacaacaatcgttaaatatactctcggcgcatcgcaaccttttacttatctactttttcgatgagtttttgcttcgaatcagggcatcgagtacaattttctgacaagaggcatgacttgtctcagcggtttaagttggcagattagggcctcgctttagatgttctaatttatcttatacaaccgctggttaccatatatcttagctaatctaactggattattcgatttagttatatcggtgttaacagcaaaatttggcaagatactcagggtcgaggaacaaatcgaggcggatttggcatgggaaggagttgtttccaaatctggttgcgcatcggctaaaggctatcactggtggagaaaccatctttcgtcggttggccgaattccacaatagtcccgaatgcaataaaaactggggctaaagatgatctttagtcccggttcaaaagggtaacgggcatatttgatctttagtcccggttggtggactaaagatgatctttagtcccggttcaaatgctgtcagggcatgtcaggcccccctgggatcaccaaccgggactaaagatcgtaactttagtcccagttggtaataccaaccgggactaaagatcccggggatctttagcctcggttggtaacaccaaccgggactaaagtcccaccccctatatatatgtcttcctcctcctccagctgcccgagcaagcttcaaaatttcttcaaaaaagaggagaggtcatgccaaaatttctagtgaatttattttggtgattacatacaaatcggaggtgcctaaaaggtttgcaacttcatcctccaatgttttttttttgtcatattacatttgcagcaatattttgcacacttttttgtctccaaaatttagttgtaagttgatgagagagaaaatttgtgtggggaagaaagaatatatagaaatttagttcatttgctaaagaaggttttataaaatagttgagaaggaaaactctagtgaaaattaatcttaaataatagaaaacaaattaaaatgaaaattaaaagaagtaaaacacattaaaattagtttaaaactttagaaatagtaaataagaattattttgtgtaatattttatgatttttgtatgaataaagatatgtcattattgtatgactgttgaaacagtttgtaattatcttataattattgtatgactgtcattattgtaggaataattatttgcgtacggttttttttgactcatgtagatggatcgacaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatacaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccaaggaggtctgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgcccgagacaacgtacgaggctaagaagatagtctgcctgctaggactggaagttcagaagattcacgcatgtccgaatgattgtatcctatatcgcggtgaggagtatgagaacctagaagcatgccatgtttgcaaagcactacgatacaagattagacgagacgatccaggaaaagttgacgggtagctaacaaagaagagaattcctgctatggtgatgtggtatttcccaataataccacagctaaggcgtttgttcaggaacaaggggaatgctagaatgatgcggtggcacactgaagagcgtcaacaggacgggatgctgagacaccccgccgatggttcgcagtggcgaaacatcgacagaaaatttaaagaatttggaaaggacgcacgaaacatacggt

SEQ ID NO: 21386 - DNA, 6942 bp, Oryza sativa
tgcatgaagaggaagtacataatgatgtcgattattattcaaggccccaagcaacctggtaacgacatcgatgtgtacctaagaccactggtcgaagatcttaaactgttgtggaagaaggaaggtgtccccgtgtgggacgaggacaaacaggaggagtttaacctatgagcactgctgttcgtaaccatcaacgattggcctgcactcactgcatggatgaaacagaaagtacgtatcttaagcactgtaggaaggttgtatacatgggtcatcgtcgattccttgcagcaaaccacccagtacggaagaaaggcaagcacttcgaacataaggccgaccaccgtacgaagcctaaacatcgcagcgggaaaacagtgttcggaaaggggcctggaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcaaaagatacactggaagcacgtaatgatctaaagcatatggaacaacgaggcgaccttcacccggaaccaaaggagaaaggaagtcattacttgagtgcagccagctacactcttagcaaggcagagaaggaaagtatgtttggatgcttggagagcataaaggtaccatctggatactccacgaatatcaagcgaataataagcacgaaggagaagaagttcacaaacctaaagtctcatgactatcacgtgttgatgacacaactgctaccagttgtaataaggggtatacttccagacaatgtccgggcaacaataacaaagctatgtgcattcatgaacgcaatttcacagaaggtcatcgatccggatagattagaagcccttcaaaatgaagtggtgcaatgtctcgtcagttttgagttgatatttccaccttcatttttcaatatagtgacgcatctgctttgtcaccttgtgaaagagatcagtattctcgggcctgtgtatctacacaacatgtttcctttcgagaggtacatgggcgttctgaagaagtatgttcgtaaccatgctcgtccagaggcaagcatcgccaagggttatggaacagaggaggccatcgaattttgcatagaatttatcgaagaccttcgcccaatcggggtacctgaatcacgccatgaggggagactacggggaaagggaactctcggaaggaaagcaataatgacggtagacaacaatttattccgcaaagcccatttcactattctgcaacactcttcattggtagctccttacaacgaggagcacttggctctagttcgcgccaggaacatcggtaagtccgatgcatggattacacggcatcacattgatactttccccgcgtggctacgacaatatctcatgggcaacgagtcgatcaaccaacaacttgccttcctggcgaggggaccgtctgggtcgatcgcaacattctagggatatcagatcaatgggtacatattctacacgagagcccaagacatgaagagcacgaaccaaaacagcgctgttcgtgtcgatgccatgggacacgatggaacaactgccacgtattacggtgctatcgaggacatatgggaatttgactatggtcctctcaaggttcctctgttccggtgccaatgggttaggttgactggtggaggcgtaatgattgatgacagtgggatggcaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaacactgacgaggattacgatcagttggatgggcaaccccctttcacggtgacgattgaccctagcatcctcctatcaattgaagacaccccttactcatatagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggttttaacaagtttaaatcatgtatatgctagttatatgtgatacttacaatttttaaaagttttaaatcacgcaggtggcaatttcatatatatgttcattagagtttttaacatttaatttactatcattcatatgctaattataattgactagagaatttttaaaagttttaaatcacgcaagtggcaatttcatatgttaattagagtttttaacatttaatttactatcattcatatgctaattataattgactagagaatttttaaaagttttaaatcattcatgtggcatttacagatgttaattagagtttttcacaatttaatttactatcattcatatgctaattatatatgactattcgaatttttaaaagttttaaatcatgccaggcatttacatatgttaattagagtttttaacatttaatttaatataattcctatgctaagtatatatgatgattacaatttttattaattttaaatcatgcagtatgtacatacatatgttaattagagtttttaccaatttaataatatcattcatatgctaagtatatatgattattggaatttttattaattttaagtcatatatttgcttattaagatttatccacttaatttattacagacaaaaataatttttctaagtaattgtcattaatctttgtactttaaataattgtaatgcattatcttctattttagaaacacatatgtaagggaaataatatgcagtgctataatcagtagtcccggttcttaaccctaaccgggtttaaaaagaatttggaaatagcgggaaaagatcattagtcccggttaatgagaacaaccgggagtaaagatctctttagtcccggttgttactcccggttgttgagaacaatcgggagtaaagatctttcctttagtcccggttgttctcaacaaccgggactaaagatatctttagtcccggttgttctcatcaaccaggactaaagatccgggggtatatatattcccggtgggccctcgtcttctccaccaacacttagacgttttcggccgatcgatctctctcggcctctctccttcgccgccactgcctagggcatccccgcgccaacgccgccgtatctcgccatcgtctcgagctcgtcgtcctcgccaacgcctccgcctcctccgccgccgccgcatctctggggtgagagccgccgccgccgcctcccttcatctcgctctctccgatctcgatctctctccgtatgtcacgccgcccgccacgagacgccgtgccacgagacgccgcgccacgacgacgccgcgccacgacgacgccgcgccacgagaagccacgacgccgccgcggcatggcaccgtcggggcgccgccacgccgccgcggtgccacgccgccgccttcggcgccgcgcaacgccgtcgccgcaacgccacgccgccgcgccacgcgccggcctgatgccgtcacaccgccgttaacgaacacgtgaacgagaacgaacacgtcaacgtgaccgagaacgtgaacgggaacgagaacgatcgaacgaacgtgaacgagaaggagaacgagcgaacgaacgtgaacgtgaatgagaatgagcgaacaaatgtgaacgagaacgtgaacgagtgaacgaacttgaacgcgaacgagcgaacaagaacgagggaacgaacgtgaacgtgaaccagaacgagggaacgaacgtgaatgagaacgatcgaatgaagacaaacgagaacgagggaacgaacgtgaatgagggaacgtgaacgagcgaacgaacgagaaggagcgaacgaacgtgaatgagaacaaacgaacgaacgtgaatgagaacgagcgaacgaacgtgaacgagggaacgtgaacgagcgaatgaacgtgaacgaacgtgaacgtgaaatgcaatatatatatgttacttcgcgtttatcctaatacatctttttgtatcttgcagaaaagacgtgttgtcggagtcgtccctcaagccggagtggaagagctagccctagaaggaattcgtgcaggcaagtgacgtaataatataaatgattgttatatttgtaatgcaattaagattattatatttgtaattagacttagcatataagattgtgtagtgttctaatattatttgagttttaatataagattattttatttgtaattagacttagtatataattattgactatgaattggtgcgactcctagcaattgactattttagtgttaattagacttagcatatacgacagttacacttagcatacatgactattttagtcttagcatgtaatattatttgagttttaatataagattattttatttgtagttagacttagtatataattattgactacggaattggcttgtgcgactcctagcaattgactattttagtcttaattagacttagcatatacgaaagttacactgagcatacatgactattttagtcttagcatgtaatattatttgagttttaatataagattattttatttgtaattagacttagtatataattattgactagctagggtcgtataatatacgtcacctagacttagcttatatcatgatttgtaattagacttagcacgtaaggttgtgtagggttctaatgtacgacagttacacttagcatacatgacttagattgttaaaacataaatgtctcatgacttagcagatgtttcttgtatcaacagatggctgaccgcgatgagtaacagatattatacggtacaatcgcgaagggaagcagccagtactagaatgaagaagagtggaacgaggatccaaaccagtacttgaatgaggaagggaacgtggagagggatgcggaggggaaccagcaggggcacgtggaaagggatgtggaggggaaccaggaggaggaggctagtggaagtcaaccctccgttggacagaagagggcacgcgggcaacgaggtgcagcgaagaagcttgagggtcggcacatcataacggaagtggaagaagatggacgtcctagtgccccggccgaagctgccaagaactatgtacgtcacagcggttgggttgtgcgggataacgtgcctatcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgtatataagacaggtgaacaagggcaggtgatgatggaaagaaacaaagaaaatgccgccaagaagaagtaccatcaccacttggggtcaggaggctatagcgtcgcgatgccgaagtgggaggagatggaggctagcttgcttgagaggggtatcgaaccggcaactgctaattggccgaaacgatcgaagttctggtactatgctcacggtggaacgctcaacccagctgatggctcactggtcttcggcgatcagatacgagaggctgcgcgacgactaacagatgtagtggaagcctcctcacagggcacattccaaccggacagagatagggacgagctgacactcgccctacagactccagagcatctaggacgaacacgagggaaaggggtgattccttggaagattggtttcaaggaggacatccagacgtacaggagtcggatgaggagcaagagagataccgaggcgaagattgcagatttagagtcctgggtatcgagctatgagctcaacatgcaagaggaggtggcaaggaaggttgatgaacgcatggccgcacatcggtcccatgatccccagccgaccattcctcctgcaatgttgagcccgtcaggaaaccatagcagctacgcctcaacggggcaagtaggatcacagagcatggacgccatgcaaacccaggatgaatcgacctgtcctgttgatgacatcactcagcggacaccatgtgagctgtatattcctttcaagaacttatcaataaaggtaagctcgtagtttatatattttagatttggccattccgctagttgctgcttatatatgttgattactaataaataatctctcacgacatgaaggtggcgtcgggcatggccatcccaacggacccttcaggtacttaccactgcaggccgattccagcaggatactcgaaggtcgaagttgagttggtcgaaggagcgtacgaggacctcgagctagattaccctggaggagacggtgagacgcatctacgagacacaagccatgccattattctatggcacaggcggtacatcatcctccctgggcgacaagcggcgtctcatggaccatctcctccggctccgccatctcctcctcaggatcctgcaccgtctcctcctcatgctccgccagcaccgtctccacttcaggctccagcaccgactgctcctcaggctcctgcaccgactcctcctcgggctcctacacctactcctccgcaagctcctcttccggcaccttcaaagtcaagggccccctccagct

SEQ ID NO: 21387 - DNA, 2851 bp, Oryza sativa
tggattttgtaagtatatcgttcagttagatttcttaattactacgtctcctttaattaattaggtccttgtatataagtagactatataaaataaaatactcccttttatcgttgtagaatggagattcaaagggcctgacggcggagggttttcgatactggattcatcgaccctcggaaagtaaacgtcgcaatgctcgaccaatatccgcaagacatagaggacaatctcgtccatctccttcaggcgcagcattacaagacgttcatactgttgccgtacaacacagagttagtttaattttactatcttcctatataccaaatttcattcctgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtactgttataagttcctctgttaattaagaaattcttgttatgttaattgctactatgaatcatatctttaaactccatgtagggcttggtatcagttccgtcatttggtccgcggcaactggagagaaagacttaagcggaagttcaaatttcctgtgggtaaacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgtagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattttactacgacggaaacacaattcataggtccttagcttctgagctagtgactactactacgtcgaaatcgtagctagctaggacatataatggattgtaattaatacatgactacatatgtttctatatatatgtgtaaacattttctataatgtaaatatatatagtatatatatatatatatatatatacatatgcatttgcataacatatatatatgtataaatacatatatattatgcatgtacatatgtactgaaacatatatacatataataatatatatatatatatatatatatatatatgcatatatatgtattgaaacatatatatgcatggtttatatatatatatatataaaccatgcagcaacagggccatgcaaaaaaaaaaaggccagctctatctttagtcccggttggtaacaccaaccgggactaaagatggctcagccggccacgtggctgagccattaccaaccggaactaaagatcgatctttagtcccggatatttcacccaggactaaagatagcgatctttagtcccggattggtagtcccggtttagaaaccgggactaaagggggttacaaaccgggactactacaaagggtttctccaccagtgtatactggcctaaacagaatcggattcagccagccgatacaagtaggttaggcgatacatatatttttgagtttaagttgggttcgtatggaagacttggaaataattgccatacaaggatagatccattacaggtatttgtatatattaattaggaatatttatgagtcatgttagttagagattttggtaagggcccgccataggggattgtccaagtgttttgtaacttagggaattttgagtcgtgttcaatatgaacaagtttgtactacaagtataaatacatgcctagggtcttatagaaaaaaacaacaatagctcaatatactctcggcacatgccaactttttttacttttctactttttcgatgagtttttgctttaagttgggcatcggcttcgatcttccagcgagaggtatggcttttcccagcggcatgcatagtccggatataggacgtcttattaaatctcttactacatcatcacaaatcatatgtatgtgacagctcaattgatttaaggggcaattgcacctatgccccactttcacagccaattgctgttttaccctcagtttttagggtttacagttttacccccactttttgaatctgaatcagccgtgtagcccactcctaacagccggtttaaacggtgttagttgtaaaaaaaggacatttatacccttggtggttattgcatttttgccctttttttcagctttgtgtgattttgccactattttgtgatttccgcttgtgtgatgagcatttcgaccaaatatttgcatctcttctgatgtttttgtacatgagcatgcgttggtgaggaactgcagcggcggcgcgaggtagtcgaggcggaggcgcatccacccggcataggaggcgacgaagagacagtcaacggcgaggagcaatgccacctcctcgaggtgccaccattggaggtaggcggcgacctcgacggcgagtagcagcaagggacaggacaaggaacacccgatgcagccgtaggagcgcacccgcagcgccgtgctctccctcgccagccctcgacgcggccaccgccgcctccgcacgcacccgcagccgcctcgcccacccgcgcgcatccgtagccgccgcctcgccctcccgcggcctcctcctccgtgcgcgcccgca

SEQ ID NO: 21388 - DNA, 4019 bp, Oryza sativa
tggtttttaaagtgggggaatagatgcaatttttccttgatttaaaaaaggatcgtataggggaatcatcgggcatgccatggaagccttgtttttctaccagtacgccaaataatggaaagtactgtttcacggcttaatgactagtaatgtactgtgtacatgaggaaaacacaagggaaatatataaggccaagccatgttggtcaggatgtgccgcatgcagctggcagctggcagctggccagtgatggtgatgccctagcttcgtgtccccctacgtacgtctccatggacggatggaccaagcgtgtaccccctttcccattatacatcgacgtcattttttttttcaaatggttttctttaaagtatttggttggaatttggaagaaaaatatatacgaggggacatccccttagggattaaaatccatccccaacttaattcctatccccctaaatacttactctctccatcacaaaacaactccatttttagcatctaccccatccgtctcattttaaatgaaaccaggagtttccgtgtccaactttaaatgcttatcttatttacattttttttataattagtatttttattgttatgagatgataaattataaataatactttatgcatgacatatgtttttaatttttttcaaaatttttttaaataagacggacgatcaaagttgggcacgaaaaatcatggctgcacttaaaacgggacagagggagtaaattatatcaaaataagcttatattttaagcaactattgtacgtattggatttcataaaggttaagaacaaatatattatggctagataaagtggacatttacattggagtttgattaagtgaaaaggcatatgttttttattagagtgtgtgaaatcaatgaaaaatgaagttattttaagacggaggtactacaaccctttctaaccaaggaatatattatatgcacacaagttttccgtgcaaactctgtgcacaccaactagcaaatgtcgtaaaaaatttagataatattataaacatacttcaaataatattacacctacatgtgaaatcttattttcgaatccattatatttttgccttaaaaaggatataatcctgatagaattttactattacctgtcaaagttttcaatttttttgttacggttaaaacataattattgaatatgagactttgcatatatgtgtaatactattatgagtaaatattcaattttttatagaatttttcgtggcatttgctagttattgtgcaactgtgcacgaagtgtgcacgtgaagtttgtgtgatatgttttcttctaacccttttatattttcattgcgctgcctaacatcgatctatatacccattaacagcaatcaccaataagtaatggaactacaatcatcatgggctactttctttgccgtcgtgcttgccaccgtcgtcttcctcctccgggccgttctgctccgccgccgccgagcttacaagctgccaccaggaccaaagccatggccgatcatcggcaacctgaacctcatcagctcgctgccgcaccgctccatccacgagatatccaagcgccatggccccatcgtgcagctctggttcggctcctgccccgtcgtcgtcggctcctccgtcgagatggccaagctcttcctccagaccaacgacgcggtgttcgccgaccgccccaggaccgccgccggcaagtacaccgcctacgactgcaccgacatcacctggtcgccctacggcgcctactggcgccaggcgcgcaagatgtgcgccgccgagctcttcagcgccaggcggctcgagtcgctcgagcacatccgccacgaggaggtgcgcgcgctgctgcgcgagctgcacggctccggcgcggcggggaacgccgtgcagctcagagaccacctgtcaatggcggcgctcggcgtgatctcgcgcatggtgctcggaaagaagtacgtcgagaagcagccggcaggaggcggagcggcgatgacgacgccggaggagttcaagtggatgctggaggagctgttcctgatgaacggcgtgctcaacatcggcgacttcatcccatggctggattggctggacctgcaggggtacatcaggaggatgaagaatgtgaacaggttgatacaccggttcctggaccgtgtcctcgacgagcacgacgagcgacggcggctacagggggatggctttgtggccagggacatggtggacattctcttgcagctcgccgatgaccctaacctcgacgttcagcttaccaggaatggtatcaagggtattacccaggtaattcaatttgatatatatcgaggttttctcaccattttatgtcttgggaagtaaaattttgtgcattccttctattttgtaacttctattttgtaataagttaatctaatacatgatacgatatatctcgagaatacttataattggccactcgattcacgggataagaatcggacgctctctggcagaacagacaacagctagctaatttatctccttcctttcttctctcttttaagtacttttttcttctaaattacttatccgatctataatccaatcgctctgttgtattcgttgtaattaaatctttaagatatcataaattatattctgataaaagaaaaacttgtctttgaaaccattagaacttaatgttccatacgtgatagagacatggctcaacgtgtgttcactgtgttaaataaaattcacgcagctaactgtatgtactctctccgctccatccatgcaagcgcttgcatgcatttagtgacattcaaaacgatttttctactaaactagttatctaatctacgatccgatcccaacattttattccttgcaattaaatttttacaacaagatatcgcatgtttatattctaatagaaaaatatgtttcaatatgttaacatggaatgtttcatacgcgatagcatcatatttcaacgtgtctgcattgtttttcacaaaaaagttaaatgttttagtggctgaaattttttcaccattataactccatgtttccatggtaaactgaaagtctgaaacgcttggctgtcaaattttttaagaatcaatcgggcgcccgatttgaattttttcgatatatctcagcactactaatctggataaggattctatagattcaactaatgcgtagaaaaacaattgaaacgaaaaaaaaacatagtcgtgttcacaggtatattttttttgttcatgtgcatgtcgaatttgacttttctttctgataaatatagtaaatttagattgtctaatttttattctattttttcatataagtattaggacgacattttcatacagtgcaccatttggcatatgccttgcgcaggaccttgtcactggtggtgcggacaccagtacggtgaccgtggaatgggccatgtcggaggtcctgaagaatccggcgatcctcgccaaggccaccgaggagctagacaccatcgtcggcgtcggccgcttggtgacggagggtgacataccacacctcccctacatccacgccatcatgaaggagacgatgcgtatgcacccggtggtgccgctgctggtaccccggatgtcccgtgaggatgcctccgtcgccggctacgacgtccccgctggcacgcgcgtgctcgtcaacacgtggaccatcggccgcgacccgtcggtgtgggactcgcctgagcagttccggccggagcggttcgtggggagcggtatcgacgtcaaggggcgcgacttcgagctgttgccgttcagctcaggccggaggatgtgccccgggtacaacctcggtctcaaggtcatccagctcaccctcgccaacctgctgcacgccttctcctggtgcctccccgacggcgtcaccgccggcgagctgagcatggaggagatcttcgggctcaccatgccacggaagatccctctcctcgccgtcgtcaagcccagg

SEQ ID NO: 21389 - DNA, 1542 bp, Oryza sativa
attcctgcagccctaaaatgttgtcaccagcgctatggatgtatgatagtatgtcctatgttgggacggacatatccagtccctccaccctgctaaataaaagggattctatgtttgccataagtttgatgataaaatctatctttatgtttatctttatctatctattctatctatctatctatctatcttatcttatcttatcttatcttatgttaactaattaaaaaatctacataaactgcctttatccctaggaggttcatcatggaggggtgtgtgataatacatgaggtgctccacgaaaagagaaccaaaaagctgaaagggattataatgaaaatagactttgagaaagcttatgacaaggtgaactgggactttctgatacaggtaatggtgagaatgggttttccaaacaagtggattagctggattaaaacatgtgtgatgggagggaaagtttgcataaatattaatgggggaaagaactgacttatttaggacttgggtctctcccctctcatttgtaaccttgttagtgatgccttctgcattggcacttccaggagtgaaggagttcaatatgttgatgatacagtcctcttcattgccaatgatgacaaccaaaattgtggcaacaaaattcatcttgtactgctttgaagagatggctggcttcaaaatcaattaccgggttttcacttttgggatggttatctcgttgtcttaatactttgaaagaccaaacctttacattcccgtgttcgacctaccactgcttctattcattctccttggaacctttaaaagttggaccttattgtttttagggtttattgtctcattgggtttcatttttataatgcatagaagtctcatcaaacactgtcactatactactctaaagcccacccgctacctcttccctttattgtcatcgggattttaaaaatcgaacagaattatcgtttgggttcaatttttactttctagatgtctcgctaaaccgtcagctgctttgccactatacttctctacggctcgcccgctacctcctctctttattgtcactgagattgtaaaattgaacatgactatcgttggggtttattttttactttttagaagtctcgccagccgccgagaccatgctgcttaatggtctatccgtcatccctccttttaactatcattacaattttatttagggttttgttaatagtttttagatgtgccatcaattattaccactctactctttttcaggcatgttgcttggaagtcccgtgaaatgctaccactataatcctctacaacccatccactgcctcatctctttattgtcatcaggaatttaaaaatcaaacataattatcatttggattcatcttttactttctagaagttccgccaaaccatcatcggctttgcaattgtacttctccatggctcgtccgctgcctcccctatttattgttattgagattttaaaattgaatgcgactatcatcggggataattatttaccttttggaagtc

SEQ ID NO: 21390 - DNA, 9572 bp, Oryza sativa
aatccattgctaacttaattcctatccccactaaatacttactctcttcgcccaaaaacaacttcattttttaacatctaaattataacaaacttatgcttagatatctagggaaaagagtttatgcttagatatcttgagaaacaagtaggtatgttggagatagtggggtgttccaggcaaatgaagctggtgcttcacacttttggcgatggattttaagtatcagaaaatgatttgtcctaggggctgaatggaaattaggatcaggtaagcacatttccttcggggaagatatttggttaggtagggaattaagagtaaattgcattgggggtatataaacttgtgaggtgagtgtaatctagtgcatgaacttgtagaacgcttattttggtgcacgaacttatcaagtgtgtgcgaactagggctaaaatgacattacattgttaatcttgataatttaggtgctgattaggatactagacgtaaatataaatctgagaaaggttgcaatttaaacatacatttagttcaattaaaagatagaatgaggcagtgattgtcgatgaacatatgaaaatcgagctatgatacaaggataggaagatatgaaattcattatttcaatgatgaaggaaagtagagaccaagtttataaatatagcatgtgttatgcactcactgcatatttgaacgtcacatactaatcaacatcaacttggtaaaattaatcttgctaagacattttggtcctagtttgcacgaattagataagaccatgcaacaaaacaagcgttttacaagtttatatattaaattgcacccacctaacgagtttatgtccatccaatgtgatttactcgggaattaaatttgaaaatatattgttcatcttttctcaagaatatgcggaatgtaatttgttcaatagaaatatactattgatcccgcgtaaccgtgacgtgaaaatgaccacatggacggtctcgcactatcacagcgtgagaccgtgcagtgtcgcacggagaggctgctagacagtccatgtcatacggccgtttccattcaattcattattcactaatcagggtaattaatccctaattaaatggacgttcgctgtcgctgattcgatatgcgagaccgatcagtcttgttgtcctgttctgcgagaccacgcggtctcgcctgtcccagcgctatatcacttgtgtcatcattttcgctcaatagtctagtgagattgatggtatatttttgccaaacaaattgctttctcaatatttatgtgaaaaagataaatgaatagtatatttttaaatttaattcggtaggtacatgccctttgaaaatcagatttagggaggtactagtaatatacccgtgctaaacactacggtgcaattctatttgtctgcatttttaaaaaaaatttcatgtttccaaaaaatatttttatatgatctgtgtatttgaactttaattaaattcatatcgtacgttaaatatatttcatgtaaagtacagtactatgatattacgtgggcatagtaaaactctagaagacttaattatatataatcacttaagtatacaatataaaagggcaatatacgcataaaatatgttaaagaagtatagagtttttccattatttgttgcgggcacaaaataaagcatttgttacatatatagaatacaccccatagataaataactatcctaatgttttgcatttgcgatacactgaagaaaatcttgtacgccgctaggaatgttgatttcgcactcattgtatactaatgttgctaatgttgcttccgtgctaatgttgctttcgcactcattgtatacccatgtagctaatgttgctttcgcactcatttgcgatacacgctagttatcttaatgcacaatagtctttgctacttaaggaggaagatggccaaaaagtgagagaaggttgcttgattctagagaaaagagtttatggctttttcgcaatgaaggggtggaacttaagaaaaatattgggagactaatactctcttgttttcttgtatggtatggttgaaactttgtattaactttctaagaattgctgttgctagagcctaagtgctagagcctaagtgctcgggtctagttgcttgagatggtgttaaatcttatgtaagggtgtgagtctatgtagtcttgtaagtttgttgaggctgtgtacatccattatctaaaaaaatcctaatgttgcttccgcgagcgacgggaaggcgacagaggacgggctcgcccttaactggcgttgaccccatcgccagcaacacgagcctcaacaacgccgattcagcccatcaacattttccaaccttttccaaccggaccgaattcagcccaaccgcccagccagagtatgttcccattagaagcatgtgggagagacagaagaaaaagaaaataattctactttcgtttataatattttttctctatattttcagatcactacttgtagatatattttttatacgtattagtgtaatgcatttagatacacgtagttatataaattatcatgcacctatattttttaatggaatgaactgtgagttttttatttcattgtgacacatttcatttctcaacggttttgatataaaatatttattcatctcatgcacgtcctttttttgtgagtggcatgcgcatggttatatctatgggcgacattataatgcctgcacgttgttgatattttatacggtctatacatcctatatttatattataccgtgaataaaataaatatatattcatttaagttgtatggatgaaccatacagaagatatagaacaaaaaattaataagcatgcatctattaatgtatacaaaaaatttgtctatattttttcttcatatctactcggcttcaaatattttcccagtatattgagatcgtgttcctttgctggaggagttgggaacacatctggcagatgatggcgtactgtacaaaacaagaagacaatggtgagtaacattctgattactaatttactatcttctggattatgttttcaaattaattttgatcttgcgaacctacctttgctcaccagtcaagaacgtctttatagatgatattcttggtgctcttccctgcagggtcaacttctttctcaggcttagccaaaatccttgttgtttgtcacgacacactgttgacaaccaaatttggtaaattataaaccaggttcgacattgggatcgaagcggattcgataacgagattgattcgaagaacagagtatgcatcggctgcgaaggcatcggctggagtctgcgtcagctgagatggatcggacagaggacagctgatacagccggtagaggtggtgcagccgattccgatgatgatgatttcgaagatgcttctagaatcgatcaaggtgcttcacgaggattgccgcgatggagataaagttctcggataggtaattgtatctattaattaggatatttcatgtaatttccttggagatatgtttggacaaaagtctgccgcaaagacttacggtattttagagtttgttagagatagatgtcgtgtccggcacggacatatcttgtatcacgggtataaatagagcccgaacccatgtaataaaaaaacagacattcaatacaatctcagcgtatcgccacccttttacttttgtttattttcgacgagttcttgctttcgggttgagctgcatcggtttcgatcttcaactagaggtaaagcttgttatggcggcatgcgttctcgggattagtgcttccatctttacgacactctaatcttgtttatgtaattcgtcgagttatcatatatcgtatataatctctgacaatattgttatttaaccttcaatcggctaacatctatcgttgaaggtagccgattaggttaaataccaatattgacttagattatataggatatccaccatcctatgaaacatccaacggcttgattgtctagatattttccttcttttcatacttatagctgcatcagttgaatttgaccttataagtcatgattagaatctcaatctctagcctgctttttggttgccgattagggttttatcggggtttcagccgttcttacctgatttaactaccttatatcttacatgcttgattgatatgttaaatctgccctttatgttaagatcttgttgcatttaggtatattaagctttctgtttgatatattttgcttgctttaatatcttaatatagagtggtatcggagtattacccgatacatgctagatctatctgattggctatgctgtgattgcttataatctccttgttaatatatatttcgatctaagtgatttatactgtctcggcatggcgaccgatctatcctaaccacttgatttaagtatatatcgacgaaagtattatataccattgatatctgcagttctttcttgcctatttataactgccgatcgattcaaatatgacatcggctcaaagataaatgatacgtcatcggcgactggctgatcggctatcatttatggatttaaccgctattttcctatctttatttcttgttggttgcaggatcaaatcaactggcacgctcacgaacctaaaggcaagatttttggacctgcactgaagttaagcagatcttccaggcgagtgtgtgtttttcgcatcaacacacaccccttgacaatgcgacgtataattgaccttgtgaaaatacgggttctagaagatagatcccaacatttgggatggtttgtccttgtgatttatttatggttattgcaaactgagacgtattgaaaattgcttcctcttaaatttgaaaggaagagatatgtcatcagagggagacagtgggatcatgggatgaatacccttttgttggcgtgctgtccaccaacaatctcagcatcaattgcattgtcttgaattgccttgaccattagtcttgttctgttgcatagtccattgttaggaccaagggcaattgaccttcactttaagctcatgtggagggaggccatttggagtgatcgtgttcagaaagtccaaagagtagctattttggggatcatcatcgactgaatcaaagctgaggtaaatcttttcctttccaggaaacctatcaatcatcttcgtgttcagcttatccacgaaatcattttttgttgagaggatggcccgtgtgctcatatattccacggaggtcgtatttctctcgtcatcaagcgaggggaacacatattcaatcaatgtgttcactgaatcttcattgtccgaataaccaatgacaatttcatcaggcagacggacgtcatcatctgcgatcgtgttttcagtcccgtttccaatcctaagtagataatccgaaaaccaagggtcagattgtgccctcatattacgcgaaaggcatatcttccttatattcttccataaataagatctctacaattcagcatcaattatctgtgcccttgtcccacatgtcaccacgggaagaacttatctgaaatcaccaccaaatcaatgacctttcctccaaatggcaataaatgtccataataagggtctcaactgcctgacgctttgtcatttcagcttcatcccaaataatcaaagatgccctgcgaagtaggtctgcggtgccactctgctttgtgaagttacacatgctattatgagcaagcttgattgggattttaaacctcgagtgagcagtacatcatccgggcaatattgacgctgcgatactagatgtcgtagttgcaatggctattaacccatcagatcgcaccctagcaagaagtgccttgtaaaggaatgttttcccagtgccacctggaccatgaacgaagaaaacctagctcttcttcttaatacatgttgtgtgatgtcatcaaaccctgcacgttgctcatcattcagatatttgtatatatctagatgctctgggtctattggcacagactgctcctctttgacttcaatcggtgtgtcattggaaaaaacatctggttgacgaaagcataacatgcgtcacgaattcattgatgataaaaataaagacaattaaggtcaacattatagaacacactcctctaaaatattacctatatcagtcaacttaggaagaccatagtctgagatatcctttcccatgaaatgaagtatatcccgtatgtctctaagcaccatctgctctactaacatcgggttgcgattatctcgggcataatcttcagacattgactccttatgtttgtcgcacaaagcacatttatcagtaacctcacaaaaggcaagtataatcgcaaacaagcgacggagtgcaaatggcatttggaaagatgccgcttcgatcaagcagtcgtcatgtgacctgtctgtctcaacaagcccactcttctcgcatgcttctctacaagtgaagtaagtgattccacatactgttcttagattctcatgcaaggttggacctctaacatggttcagatgcaccctaagatagtatctttctcccaccgcggggtgcgcatacacaatctgtccaacctggcaagtcttggtttttcttttctgccatacatttttccctgcaacccatctatagtgctccggaaactccttgtacagtaactttcttgcctccgggtctttgcgattcatttcaaaaaattctgtaagtgttgtctttttattagatggttagttgacgacatcctcaagattaccagaatcatcataggtgacatattgcatgtttggcaaatgaagttgtagctgcaaaaccgtcggatatataccgaatagtggaaaaccaagaatcctatatatagcctctggcggtgaaacatatctggcatctctatattggcgtatctcgttgatttctctagatggatcgactgagaacgacacacagtcatggcctttttatacatatttatataggtacttcacagatttgatgctggcgcaagcttcaacattgatgtggcaattatacctcatgagcaagccaggattgtatgggaccacccacctattgtccaacactgcacctctaatttttacacgccacccatcatctctcctcctgtatgaaggatacaagtccttcccttgttgtgttgcttgacagaacggtcgaggaaagctgaagcgacactctctgtccaccatgcaggcgcactttttgtttagctcacctcacgggatgtgcaacatatgctttatgaccagatgatgtagcacagggtatttttccttatctggtatctctgcacagataactttatcataaccatctgggtttgttaactcactgcatggattcatggttaacaggatatgttcatgtaggaggccccgcttctgaaactcagtaacatgagcatatgcctgaacctcactgaaatactttttcttggtgaacaagtctaacatgtatcgtagcttggccctaaatacccttgcaacaaggtccggtcgatcttgcggctgttggctacgataaagattttctgttatctccttccagtttggattacaggtcatcgtgatgaagtagtctggtctcccaaaatgttggacaagaaccattgcattaagaaaccgctgttgcatgtcgcgattgccaccaggaaaagaccgaggtagcacaatcctcgttcctatctctgaaccccttgtctctccagaattgatcacatcgactacaccctacaaaattagtatcggtaaaatgagcatacattgtaagcatcgctttttgaatgggatatggtttaatattattgaatatgaattttatttcattcacctagtacagctcagctcgtatcttgttttggttcttagggttagaataccaatcaaggcgcatagactctatctttacatacatgtcaacggcccattgctgaaagagacgacctccaaataaaataatgttgaaaagtcccctcctaacctatagcctaaagcaatagtactctcttgcagtgacaaatctatctttcttcgcttgcatgacctgttctccacctcattagtgtcttcatcgtataaagtatcaccaacgtcatcattctctgcaacaaaatcaagaaatctacttaattccaatggaataaaagtatataggcattgacaaggtctcatacaagctaggtgtgtacttaccaggaggctcgacaaaagtgttttcttcactgaagtgcacgttaccacccattggtgcaacacttggtgcatcaatgtccataccgtcaggaatattggtgggtgtttcgtacggcattttgagattccatctggtttcgccgttagggttatataaaggatatgccaataggtcattgcaaccatggtatgctttgatatagtaggtttctctcctttggcacacaccatcacatgcttatcaaaagttctcaccggatcatccccttctagccaaatagcagcaactagagatgttgtaggcacattatatcttcgctggtcaggggtgacattcgtgttgagctcaatcttatagttcatggggagcgggattgacgtcaaggggtgggacttcgagctgctgccatttggctccggctggcagatgtgccccgggtacagcctcggtctcaaagtcatccagctcaccctcgccaacctgctgcacgccttctcctggagcctccccgatggagtggctgctggcgagctgagcatggaggagatcatcgggctcaccacgccacggaagatccctctcctccccatcgtcaagaccaggctgccggacaatctctatgccgagccattatgacgggccatgcgttgcgtgcatgcatggatgtgcgtctgttggtgcttagtttgatcgaggtcattgcgtcttctgcattaattccaggaagctataggctccaattcaaggatatatataactccctagtgcgtagttgcgatgatttgcgaataatatcactagaatggtttcgtattgtagcactgcaagatgcaaactcaaaatgttgtcaccagcactatggatgtatgatggtatgtcttatgttgagatggacatatccagtccctccaccctgctaaataaaaggaattctatgtttgccataagttcgattataaaatttatctttatgtttatctttatctatctatcttatcttatcttaactaattaaaaaatctacacaaattgccttcatccttgggacgtttatcatggaggggtgtgtgataatacatgaggtgctccatgaaaagtgaacccaaaagctgaaagggattataatgaaaatagactttgagaaagcttatgacaaggtaaactgcgactttctgatagaggtaatggtgagaaggggctttccaaacaagtggattagctggattaaaacctgtgtgatgggagggaaagtttgcataaatattaatggggaaagaactgacttctttaggacttgggtcttagatagggagacccccctgt

SEQ ID NO: 21391 - DNA, 26013 bp, Oryza sativa
agttgctgcccgttctttgttacctcatctttatttgcttgctcgatctaccactacttctattcattctccttcgaacctttgaaagatgaaccttatagtttttagagtttattgtctcattgggtttcaatttttataacgtatagaagtctcatcaagcactgccactatactcctccatagcccacccattacctcttccctttattgtcatcaggattttaaaaatcaaacagaattatcatttggattcaatttttactttcttgatgtcccgccaaaccgtcagctgatttgccactgtacttctctacagctcacccgttgcctcctctttttactatcattgagattgtaaaattgaacatgactatcattggggtttattttttactttttagaagtcccgccaaccgctgagaccatgctgcttaatggcctatccgtcatccctccttttaatcatcattagaattttatttatggttttgttaatagtttttagatgtgccatcaaccgtcaccactctaatctttttcatgcatgttgcttggaagtcccgccaaacactaacactgcactcctctacaactcgtctgttgcctcatctctttattgtcatcaggattttaaaaatcaaacataattatcatttggattcatcttttactttctagaagtcccgccaaaccatcattggctttgcaattgtacttctctactgctcgtccgctgcctcccctatttattgtcattgagattttaatactggatacgattatcattggggttagttttttaccttttgaaagtcccgccaaccgatgtgattgtgctacttaacggtctgtccgccgtccctcctattaatcgttattggaattctatttgggattttgttaatagtttgtagatgtcacgtcatctgtcaccactctactcctttagaggcatgttgcttcttccatctttattgtcatttggcatcgttgtgttctaaataaatatttttcttcaaaattttgtattttttattccgatatattttttttataaattatattcctacttgaacttttataattgttttaatattttttgaatttttttatttttattcagaattttaattaatctcatcgtgggttctagatggtctcttctttcaatagtctttatttttctattagcaatttatttatttataaattgtattcctagttaaaatgttatttttctttttctaatttcaatttgttttttatttcgaattttacttgatctcgtactgtgttttatacggactattatttttatatttcttattttcttttccactttatgttgtttcaaaatggtattcctacttgaactctacttttaatttttctaatttcagattttattttattttttattctgaattctaattaatctcgtattggtttcttctatggactcttctttcaatgttggttatttataattctgaattaccgttatttttaaattatattcgtacatgaactcttcgttatttttttctaatttcgtattttagttatttttttattccgaattttaattaatttcatattgggttaattattatctggactcttattttaaattccaaatctaagttatttttaaattttatttctactttaacttttttcatttttctaatttcttattttattttatttttattctgaattttaattaatcttgtattgggttcttatatggactcttctttcaatattgcttatttttaattccaaatttcaattatttttaaattgtattcctacttggattcttctttcatttttctctgattaatgtggaaatttctagcccccaagtgaacgtgatacctcctttcaaagctattataataatataatagataaatatcattactattcgcgatatcggttagatgccactgaaatttttcaaaattgaaaccgtgccatcaccgtcacattttaaatccttccgacttcttccttcttccttctcttctcctctcctgccttctcttcgtctcttctcctccctatagttcggtcatgcctgctggtcctcgatgaacggctgccacgcctactgctcctccccccactgccctggtgcgctcaccggccgatgccgtcaccatcttcaactcctcctcatgcgagctccggggaggccgaatccaggcgtgcgtgctccctggccggcatcattgccagtgccatctgcaccacctgctccttgcacgagctctagggaagccatatccaagcgtcaccgtcatattctcttcacctcctcctcctcgtgtgagctccagggaggccagattcaggcgcgcgtgctccccggccgacatcaccgccatcttcaccacctcctccttgcacgagctctggggaggctggatccaagcgtcgcataatcaccttctcctcgtgctagcttcgaggaggccgcatctagcctccaccgtcatcagccgaatccaggcgctgctgccatcttcacctcctactccttactgtggttggagaggtgatggtggtctccgttgtcgtcacttgctgctctgccttcgtgatcttcacgggtgccagttattgccgtcatcgcttgttgctccgccgtccccgacgccatcctcaccgcgccatccttctctgtcattgactttcctcgctccttaggctttggcgctggcggcctcgcctatttcgtcggagctcgctggtcggcctctgacctctctcgctccatgggctttggcgccgccagcctcgcccgctccaccggagctcacggcttggcctctttgtagacgaccgcttgatggggagaagaaggaagatggaaggggtggaaaatatgacagtaatggcacggttttaattttgcaaaatttcagtggcactcagctgatatcgtgaatagtaatgacatttttctaaagctatttaacaccaatcatctctcatgatgtcttatgtgctgtgtaaaaccaaatctcatacatgatctagttattttggtttttcttagtaaatctcttactttacatatgtatgtcacagctcagttgatttaaaaagggatcctaggggaatcatcgggcatgcccttgaagtcttgcttttgtacctgtacgtcaaataatggagtagcatttatcccgtgcataagtattgtttcacggcttaatgactactagtgtactgtgtccatgaggaaaatgcaaaggaaatatataaggccaagcatgttgatcatgcatgatgcgccgcagctggcagctggccagcgatggtgatgccctagcttcctgtcctcctacgtacgtacgtctccatcgacggatggaccatgcgtgtaacccttctcccattatatatcgacgacatttttttttcaaatggtatcttttaaagtatttggttggaatttggaagaaaaatatatacgaggggatatccgatcagtagaaaaatattttttctagacgggccaaaaaaggttttcgtgtgcggaccttcggcctgtctgctcggaagggtctgcgaaaatccaatttttccatgtgggtggcgtatccactcgcgaaaaatgtgcggtgcatatttcgaccgcacgcgaaaacaaaaatccaaaaaaaaccacaaaaatcgagcgtgtctgccgctgtcgtccgccgccggggtcctcccgcaactgccactactacaaaaatcgtttttctgtacgagggggtcggtaggttccatgcgggccgcttgtggcggcgcctgcaaaaaccgccccccccggggcgggttgattagccgcatgcgatgatccgccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacaactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctgaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacatcacaaaacagtgggatccgtgtcgaagcgattgacacgagtggagaaaagaggtcgtattatgggaccattcaagaaatatgggaactggactatggcctaaacatccagatccatgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtccctaaagccgcccgcatgcgatgatctgtgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgccgccgtcaggacctctcccccctcgccgttgccgtcgccgccgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtataattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaaatgggacctatgttaatttgagatttatgtataattgggacttatgttaaattgagatttatgtataattcggacttatgttaaattgggacttatgtcaaattgagacttatgtcaaattgcgttaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggttagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacatattcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtatctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtgcttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacaattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgtgccgacgcaatttgctgctgccgtccgccgctgccgccgccgggctccttacgccgccgcgtgtgacattccggcccaattaggatgagacatgtgtggagctttgtgcgcatgtttagtaccattttactagtttagcaaagctgaaaccaacttataaggcttcttccctttaacgatatcactcttgagttaactcttttatatgaagcgatgacaaaagtgtaagtggagtggtatgtgtaagtgggtctgccgatcggttgggctgggctatgcgatcctgaaggtagggctgtttcaaatagtattagagccgaccctcgtggttgtacgtaagggtcagtgtacggtcatatggcgcatggcgcatgtgggctttgtgtgaggtacatggcatgacatatagcaccagcactggacgtacgaacgtgtgctaagagggggtgagttgaaccgacggggagtcgggtcctttgagcgggtgtgtatgtgacatcccggccaaatcagtgaggcctatatggtccctgagagcagtgtacgcatatttagtaccatattgttagtttagtaagggtgaaaccaacttataaggcatcttccctccaaccataccgccaccgtgctccttccgttgtcacatacggctcctcctgccaccgccgtcggatctaggagggggacagccaccgccactggatatgtgtggaggacggccgtcgccacacgcccaacaccgcgcgcccaatgtcgccttcaccacgctcatgccagccaccgccaatctcccaaccaggagagtttgagagagtgaggagtacgaggagaggagaggagataagaatgagataaggagagatagaagggatgacttgaaaaaatttgaagcgtacactaaagagggacagaagaggtaactcagacttctggacggtccgcttgttaaaatatattttttcgtgcggctgcttatgtggcctgtatggaaatagctctagtttttatacggctccctaagagggcagtctgcgaaaatatattttcacgtgtgggtctcttaaggagtcatatcgaaaataggacaacgaatttttcctgacgcagatacttatgattcgtctgcaacatgcttatacacgaaaattgtttgtgtattactgtccccatagcgatgagaatccattgctaacttaattcctaaccacccccccccccccaaatacgtactctcttcgcccccaaaacaactttattttttaacatctaaatctattactatctactaaaactccgttaaacttcctacaaacgctcctaaaccgccacgtggcgtcgtacaaacactcctaggctgccacgtggcattatcaaatctcaccatcgattttcatttaaattggtggacccatcattttataccattggattagatctattattgaaaaaaattaactttctctttatatgatttaagcgcttctactattggtttatacgatgtcttctcccgtacgtacgtacgtacaaaaacaaaacaatagtttacgtactgttcgctggaaagaaaagaaaaaaccatacgcatatgcataaaaaagacgacaaaaaatacatcataaaaatccatgatctttatataaaatatggttttctaaaatatattacatcacaaatatgaatatatatagttaaactaagatctataataataatataaaatatccaatcaatgttccttgaaccatcttctaaattatttttaaattatatatctaatttgtgattccgttattttcctttaattaaattataaaaattatatggtggtcctaaatatatcacgacacatggggctgatatataatagtttgttttttttataatctattatatactaaaacgccattaaacatccttaaaacgctctcaaaccgttgtacagctttctacaaacactcgcatctcaccatgtgtcactctagcaaattataaaaaaaaaccaaaatatctagccgtcgattttcactaatatacggtgcacccatattttctatcctcggattttacttaaagaaaaaaaaagaaaggcccacaccccaccgctgccatccattatgttacattaggtatatatacgtagttacgtttcataatccctgccctcaccctaatacatgagggcaacatgccctcctattttcaaacattttcttaattaatattagaaaacgtactttgtaataaattattttaaacaactatatcatataaatagctattttttatccgtgcacaggatgagattatttacaataaaatttagaattcaatacctaaattaactacattttaaaagtaaaataaatgtatttctttgggtcatataatgctagagactacctattggtcactcgatacatatttagaaaaatcacatagatttttaaaccatatgaatggcaacatttagcttatattagtaaatacaacacccaacacattttctaataggtctataattatatatatattttaaaaatagataactaaagactaggatccgttggaatatgtctcagaaaaaaatatatccatctctcgtcctgctgtacatatacctcctctgatcctctcgccttatattttttaactaacaacctaatattaaaaaaaaagctaaatggcttataatttctaaaattatatttggtttttaatttgttttaactattgttttatttacagttaattaaataattcaatatccattatagttgtattttactatataaaaattaaaatactccttcgcagggcaactgaatgaaaatgaaaaattataacagaatgaaaacatgtatttttcatattaaacaatctacgcaataaaaaccaattaaacacctttagagcacacttaagtcaccatatgtcacattttaaattataaaatatttcaattaaatcgatagacccgttattttcaaccattagatttaatttacaaaaaaaatcttacgccgccacgtgtcatgtcctgaaaatcataaataatcttagaaattttgagaaaaaattaaacctgtcatcattgattttaagttacattatttggagaagttataaaaataaatcacatctaccgcctcgcccccttcacatgcgcgcagaccactgccaatcccatccctatttttgggtaggactaaaataaaagagaaataatcaatatgttaaaacaaccagaatttttaagctacatgtctaatttctaatataattgttgctctgtttataattaaactaggaatttaagatccgtatccttatattttcctatatacaaaatatgacattcgaccacattcagcctgcgtgctttgcataccatccaaatatgattgaaataccttaaacaaattggctgcacatattacatcactatacatcattctgcaaacatgtatagctaaatcaaatcaatagttatccaaacaaaaattacaaattgaactatgaaacatttttttattaaggaagaacacccctgcccttttacatgtcatttgaattgctgtaaaagaattacgaaataatccaatacaggttgcatcatcatatatatgttgtttgtcagacatgcatagctaaattagatatacattatctaagcaaatacaactaactaaaatatgaagtccaaaccacccaatgcatagaaaatccaatggctttagttagagaaaatccgattattacttcatgattttttttaaaaaaaatatgctaaaataatccaagcaagctaaatgatctatcgtatatctgctttaaactatgttactatctaattgactttagatggagcttaatgcacttttagtatatcattgatatatgttcaagcgtgttgttctagcgccttctaagcatttcgggtaactccgtttattttctttgtgcgtagaccattcaaaaggtgaatcatccctatatatgaacattaatcgtctgcaaatatatttttattgtatatgtatgtatatatatatatatatatatatatatatatatacttaaatgattaactttggagttcatttagattttacgatataacaagacatggaaataggagtaactaagcttgaccaaaaatgtgatcacaacaaggatgaatcacaaggcaacctccgtaggtgcaataaccacatctcaacacagtgtctaggagctgcataaagccatatagcgggggaaaaggaacaatgaatttagctaggtcttacattttcatcacacagggcccaaagcattcaacaaaaaaagaaaaaatacaacttgcttttaatttaataaacatgttttctaaacaaattaggtctaactcctttttagataatgatgaagattatatataattgcttatacatattaattaaaaactatatagtatatagcatagagaaattattaaagtgatgcaacgatgaatatttgctgaggaaatgcacttccagaacatggcagaggctatctgattaatatgatccgttttcaaatgcagcgcacgatgcttgcccgcgcgaatgcacggactaccttcctagttatatcaaatttatgcttagatatatagggaaaagagtttatgcttagatatcttgagaaacaaatacgtacgttggagatagtggggtgttccaggcaaatgaagctggtgcttcacacttttggagagggattttaagtatcagaatatgatttgtcctaggggctgaatggaaattaggatcaggtaaacacatttctcggggaagatgtttggttaggtagagaattaaatttgaaaatatattgttcgtttgttcttttcttaagaatattcagaatgtaatttatttgatagaaatataatgtctcgcacgatcacggcgtgagaccgtgcagtgtcgtgcggagaggctgctaattaattatttgattaattagttgctaatcagggtaattaatccctaattacatggacgttcgctgtcgctgattctatatgcgagaccgatcagtcttgttgtcctattttgcgagaccgtgcggtcttgcctgtcccagcgcgatatggcttgcgtcatctttttcgctcaatagtctagtgagattgatggtatatttgtgacatgcatgctaaatactccctctgtttcatgtctagattcattaacacctatatgaatgtgggcaatgctagaaagtcttataatacgaaataaaatagaggaagtatttatatgaacagtatatttttaaatttaattcggttggtatgagatctgtaaccaacagaaagtcatggttgcagggaaattgaaaaatggcctgagctacctaacgttcagacgagctaattttggttccctagagagagctgtctgggaggagtcagcgtcgcagtgacttgagtagcattctatgataatcatgagtttaaatttttatacgagcgaatttcttattgagttatttgcgaggctacgttcccaatttaaatgaggttgtttgtcggttcaagttctgatttaaaatgttacaaatatctggttggacatagatgctgggtaaaaaatacatttctctaaaaaaaatctatctactttttataaaagcagagccaagagccttctctctaaaaaatattatatcaaaataagcttatattttaagtaattactgtattagagtttgtacaagttagaacaaatatattatggctagctacagtgaaagacagttacactggagttgaataacgtgaaaaaaatattatatcaaaataagcttatatctatctatctatctatctatcttctatctattatatactaaaagtccattaaactccctagaaacgctcctaagctgccacgtggcgttcctacaaacgctcctaaatcgccacgtagcactttctaatctaaccgtcgattttcacttaaactggtaggcccattattttagaccgttagattggatctattttaaaatccctggttcatcttaatgtccgggtaggcccattatctaatcacagctgcttcttaatgtccgatatatagaagagaaattttcacgagaaaagttaacgtacactataattggatattacccatatgtattgttcacttcaaaaaaccaaacaaacatacgtatctacagctataaagccagaaaaaaaacatactatgctgtatgctgatagaacggcggttttaaagtagaattttctatattataaaataaaatttattactccgcatatatccatgtatatgcacagtttaaacaagattaatataaagtatcaaatcaactgtctttaaatgttcatcttttaaattatttatgaaatatatatatgtaacttataatctattatattccttcaattaaataaaatattgatcacatataatagttatattgtagtgctaaatacatggtgccgtcatataatacttaatgtcataattatttttaaataatttagccaacatataataattaatgtcataatgtcatgataattttttaaataatttcacatgataaaatggatcaacttggtgtcaaatatccctcgataaatatatcgcagtggagaaataaagcctcggcgactacggtcggctttattacctgttaaagggggcattcatatttgattttaacagtgttatcttattaaccattaggaacaataattatagaatatttattcatagatttagaaacaagggttgacataaacatttatgtttgtagtagatataaatgttttatgtattaataatatattgggcttattttagtggtatagatgcagatccatttatttaaaatgcatcccgctttaaggataataaaaacaagtaagaatgataatagctgagttgacatgtaacgtggacaaaataaaaccctacctatggactaactattagtttctcaagacatatttatgaccattagatccatcgttttcttttaaaaaatagaacccatataccaacctccaccacggccccgtacatgggcgcttactcattcatccaccccactgcccacaccctcaaacacaccatacctctcttttcctcctattctcatgatacattacttagaaatcataatttattattaaaaaaatagagaacagtatcatccaaagcatatagtgaatttttgatcgacttatttttgttatattatttataactaaagttaaagacacatattcacaatattcaaacttttgaaataaatatgtttgattttggtttatattcttacacttttgcgtacattcaaacaattataaaaaaaattatgaaaaacatttaaatgttcatattttaaattatttatgaaatatatatctaacttataatctattgtattcctttatttaaataaaatattaatcacatataaaagttatattgtagtgctaaatacatggtgccgacatatgacacttaatgccatcatataataattgatgacatgaaatttttttaaataatttcacatgataaaaaggatcaacttggtgtcaaatatcgcttgacaaatatattacactaattcaaatctacatgcagggagaatcatatgatcatcggttttacttaaattattcaggaaaaagcaggaaaataaagtctccaattcctcaccgtccccataacatgcacacaacaccaaacgcccccttcccctttagcttaggctcttcgcactccactcctccctattcctactttttagctatcaaatttaaagacaaactatgaataatattgaaaaacccatattttaagctatacatctaatttctaatctaattgttgctctattaaataattaaacaacaattcatgatccattatgcattttgaacataaaataagagttgtataaagtaaattagaaaaatagaaaaattccaatagggattgaattaaatcaattgggcagaatataataaatttgtaaaaaatagttattacttttcacaaattggaacaaccattatatgttccatcgccataaccatgtttaagtgcttagatgttaatgaccatccatctatcttatatcatgtcattatgagtttttcaacgaattattacatatataaaacatatagttggttaaaaagttatctatatgctactattaactttaagtttaggactcatgttgactaggtatgtttttagaaaaaacactaaagatcacatatataatagggaagcgagctgtacaatatgtatatctcctatgtatttattgacgctttttttctagaaaatgaagaattactgataattgcagcttatagtagtgaattaaatattatatagtttaaaccttacagatatcttgtaaaaaaatatctgagcaatgtagatgaagaaaatttataagaaattgtattttttcaagagtggtgtgtcacccggtcgatattacaccttacaaaagcgtatcttatatgcccgcgcgaatgcgcgggctacctttctagttgaactaacgtgtgaaaaaaaaccagcaaaatctaaatcgagagacatctcgttttagtgctaacaagtgacatcatcagatgttgtccaaatatactacttgtctatcaagtaagtatcaaatatgttcctaccacctttgcttcaaataaaattttctcttaatttacttatccgaactacgatccgaatacactattgtgtccgtaacaattaaatctttacaacaagatcttacatgattatattttaataaaaaaatacaaattaattttagattttactaaactacatcttagatatataaaagtaaatttaataaggcctaaaagcaatttatatatattatagcagtaacttaagaaaaagaaaataacttctcacggcattagaagtaaatcagttgtggggtaacacatcaattaaatctaatttctagatagacttatgtttttaccccacaacatatttacttttaatgcgataacaagttactttccttttcttttaagttacttatatagtatatgtaaattactttcaggcttcagtgaatttacttttatgactaagaagcaatttaataaaatctaaaagtaatttagataaattataaaagtaatttgtattttttcataaaaaatataatcatgaaatcggatcgtaaatcggatgagtaatttaagagaaaattctataagaacaaaaaaaaaatgcatgcacttttgggtgtactagactaatagtaacaatccagcgtacggtttcgtcgtagactaatagtaacaatccagcgtacggtctcgtcgtagtcacgtgaaaaaaaaataatagtgttcacagcttgaaattttccctctgtgcaagtcgaatttaacttttctttctaataaatatagtaattttgtattgtctaatttttatcctattttttgatataactattaggacgacattttgatacagtgcaccgtttggcatatatgccttgtgcagaaccttgtcgccggtggcgcggacaccagtgcagtgaccgtggaatgggccatgtcagaggtcctgaagaatccggcgatcctcgccaaggccaccaaggagctagacaacgtcgtcggcagtggccgcttggtgacagagagcgacatcccgcacctcccctacgtcgacgccatcatgaaggagacgatgcggatgcacccggtggcgccgctgctgataccccggatgtctcgcgaggacgccaccgtcgccggctacgacgtccccgccggcacgcgcgtgctcgtcaacacgtggaccatcagccgcgacccgtcgctgtgggactcgccggaggagttccggccggagcggttcgtgggaagcgagatcgacgtcaaggggcgagacttcgagcttctgccgttcggcacgggccggcggatgtgccccgggtacagcctcggtctcaaggtcatccagctcgccctcgccaacctgctgcacgccttctcctggaacctccccgacggcatcgctgccggcgagctgagcatggaagagatcttcgggctcaccatgccgcggaagatccctctcctcgccgttgtcaagcccaggctgccggaccatctctatgccgagccatgatgcatgacgcaccatgcgtcgatgcgtgcgtgcatgcatgcgcgtcttctgcattcgacgaagctataggctccagttcaaggatataaaactccctagtgcgtcgaataatagaactagggtggtttaaataatcgtacagtagctctgcaagatatgcaagctcaaaatgttatcacctgcactatagatgtatgatggtaagtcatttgttgagacggatatgtccagtccatcaatggctccatcctaaataaaggaattttatgtttgccacaagtcgatgatcaaatttatttttatgtttattttattctttatctttatctttacggattagatacctacttaaaatatccgtaaagtttttgccaaaattttgacagttcactgctagagaaagggggttttactcccggttggtaacccccaatattcccggtatgcaaccggcaccatgaatccgggaggtgaaataaccgggattaaaaattcatttttagttccggttagtgttaccaatcgagactaaagatggagccaagccaggtccggttgccagtttttttcttttctttcattgtttttaacattgaaaattgatttcactccatcccaaaatcatccccaaattgtgaaatcccaaatcgatcctcacaaatcacagaacaaaaggatcatctccaaatcctcaaatcgatcatctccacacacacatcacaaattcataaaaaaaaattacatcacaagttctaaaaatatcatcacaaatacatcacatattcacatcgcacacaaatcaaatacatcatagattaatcacaaatcaaatctgcattggaatcacaaattctaaaaaaaataactcagatccaaccgaggcgtaggccgttggccaccggccaccaccgcgcacgtcgccgcccgccgcgcctccctctgtcgccggcctcgctagctcccttgcgtgcccgcctgctcgctcacttgagaggataagttagaggaaaagagcgagaggaaagggagaagataagaaaagagtggacgaggataagggtagaggtggttggaggataagtgctcgggattatatattatccgccaattttaagtcccggttggtgtttccaaacgggaataaaacgggtaggagggcggacactttttcaaccgggactgaaaatgatatgtagtcccagttgatgttatcaaccgggactaaagatcataaaatggttatgggcttttcaaccagggtaaagatgatttttagtcctggttctttttgtaaccgggactattgtgatttttggttgacccaacaaaaattagttctccagtagtgatttgatccttttagaaaatttatttcaagaataggccatgtcaaaaacatattgcaaaaatagaccaaaaccttagcgcctgtggtattggcgctcagatccaatgatatgatgtatagtggctactcggataggtttttagcgccaaaatatgtggcgctgagatattataactcagcgctaaacccattagcgctgaggttttgatatatttttgtaataaatttttgacatggtctattcttcaaataagttttttaaaaggtcaaattgccaaaatttatccgtcgactgctacagcgtgtcgctcctcgcgggcgcgtccgttcgggagtccggatcctgtatgctcagattgtactcccctcccggctcattgctcccgtacatccgatactgccccaatcggacaatgtacacatccatagaatgccaaaaggcctggggccggacggcccagccctagtacaacacggcttaactgggtcagtcctgtgcaggcccgacccaaccattgggttgtcactactacagaatagattttcctggacgccccccccccttttcccatacggatcgtaagtgaaaccgcaaggaaaaataggggacaggctccaggctgtcgcccatacgtgcagatccagcggaggggggttgggggcagtggatccggcggcgctcgccccctcccctccttccccttgcagatccgggggagggggcggtggatcgggcggcacatggcgggaggagagcacgcggcggccacgggtgacagcggcggcggcgcgcgccccctcccctccgttcccgtgcagatccggcgaagggggggggcttgggggtggcggatctggcggcgcctgccccctcccctccttccccttgcatatccgggggagggggcggc

SEQ ID NO: 21392 - DNA, 1950 bp, Oryza sativa
ttcatgtgagatgtgttcatgtgatgtgttcttgttgatgtgtgatgtcttctcttgatgtgttctgcggcgggcgaccgcgagggcgacggcggtgatgggcgaccgcgagggtgacggcggcgggcctcggctaggcggcggcagattagggttagggttagggtttcttttttcatttttttgtttctttttttgttaatcggttttcccagacgattgggtgcatgcgggccgcccacccacaggcgaaaattggctagcccgcacggaaaaattggtgctgtagtagtgtgtgcatggtcctctacctcgacaaggtggactggccccgcacggcaaggtccaatgatcagggaggcaaaatagacttatttcagccaataagcatggcccaaagaaatgagggacacgtaatagactttttccagccatgcaagctaaatagatttattctaaggaggagcacggtgggtttttgtgcctaggccgctaatgcagcccgtgggcaggcactacccggcccagtaggttgcgccgtgccagcccgactattctcaggctcaggcctggtcatgcccaagccaggccaggccgaccggcccatttggccatctatatacacatcctcaaactcatgtcctgctatgctgccctcgagtctgcgctaggacaaagtcatggatgccataattgttgaaatgcacgcagctaagttgtaatgctctactttatttcttttacatcaatcgttcttatctttaactggttagattggcaaattttgagccttttggagagtttagttttcctagctgttagacgatcggtactcctagcggctcacccacaaggccactagacacgctccacatctaacttccgttgtcatagccttagctcctctagcgaggaggagtggcaccccttttttgggattcggccaggcagcgggtgcacggaaacaaggtgataatcgtgcagagtatagggataggctgtttagacaggttcaggccgcttcaatgttcttgctctatatgatgaagcttacaattagttcttagtgttgatataagtagtagaggatgaacccttcagtgttatgaggctagaatctaacttagctcctctcttttttaagtggcctttggtctttcctttatagttgcaaggggatatcacaatgatcggtttcttacaaatgggcctcaacataggggttaggtatatgttggtcgtggttcttcttggtgagtgggcctggtcgtcaagcctagatggaacggagaccttgccgacccgccgcgtgtcctgagcatgctagcaaagcttagagtagaagcctgaaacacggttgacgcccgtgggcccgcctatcagccacggataagagaaactgcgagatggttgtggctccagtctcgcggcatggcagtcaatcatactgcctgacagtccacccttatccacacaagggtggtgaaagcctatcgcgaggctggtgtgcattgtcttgtcacgtgtcgttctggtggcgtgccgacactagtggagaaaccgtttgtagtcccggttggtaacccctttagtcccggttgtccaaccgggactacgaatccgggactaaagatagctatctttagtcccgagtgaaataaccgggactaaagatcgatctttagtcccggttcgtgttaccaaccaggactaaagatcggtcagccacgtggccggccaaaccatctttagtcccggtttgtgttaccaaccgggactaaagatcggtgcaccatttttttttatttacatggccctgtttgctgcatggttgattatatatatacatgtatgtatatgtatatatacatgtatgtatatgtatatgtatatatacatgtatgtatatatataggtatatatacatgtatgtatatatatatatgtata

SEQ ID NO: 21393 - DNA, 9307 bp, Oryza sativa
caggttattttacatagcgggcagagagcctcataaaaagcttgattctagtgatcaatatcaggaatccaaattccagagattcgtgcgggaacgtccactttgcattttaaagaaagggggctatggatggcaagagaagccctcatacccactcttctctcccctccccatacccatcaactactaggttgtggagagggcctcggtatcacttcactatatacctacacctacaaaatcacgaaagagatttgctttttttcggcttgcggcccccttagaagagttcttcgagttccctatacaaaggagctccattcctcccgggattttccagaaagtaccgctccttcttgagttgaactaccccctcggcactgggagctcctgataatccttttttggaaaggaacacgtccaccgtactggctattttcgtttcgtgtataacgtatctatcggcacggcgtcggccttcataaagcaaccgaattaaatcctcctttattttgaattctgtttcaaaataagaaagaatcatttcttgttcctgcagattgcgttcaacaatgcccctagaagacgcgtaaagagaacttgtgagatttgaatagaatgattcattctggaaaaaaaggactctctattctgtcattgtacaggcgcctatgactcatttctgaaatgccattaacgaaatgatttcgctttttgaggatccttgtttatgcactccggaatagaagaaagggctgcaccgacccccgcagagttactcggggccggcggcggagtagtacctgactgggtcgagcaggcgccctcctcagggctgagtggcacaagaatcaaatcgtccaagctgcgaagggttggtggtccctgtagctccaagggctccatcggagcttttctcttgcctttagaaagctcctctttcggggactccacactccccccacttggtgctcttctccaaacggcatggcttcctctgagtaaagaatgaaaaaaagagtaaaggtggttatgagcattccaagaataaatccaataagtttggcacgttcataactaccttttggggaagaagaggttgaggactaggctctcccccctgccttcatctgccactttgtggcatgtcttgttctcggtttttcgacccgaacaaccgctgggattcttggccgttccagaatccctgttttcgtgatcgaatgacgaaaaataaaaaggtctatctaattaatctccttcgcagtttgttttaaagaagcatcaggttcaatctttctttcgttagttaatccccctttttcgttgaaggattttagtaattctggattaatagtacttagaatggctttttcatattgagaaattctgtctagtggcattcgatcacagaagccgttgacagcagcataaatcacaacaatttgtttttcaattggaagtggttcatattgtggttgtttgggcacttctgtaagccttgcacctctattgagtaatgcctgagtcgtagcatcaaggtctgacccaaatttagcgaaggcggccacttcgcgatattgtgccaattccagttttgaactaccgcagacttgtttcatagctttcaactgagcggcagacccgacgcgactgacggataagccaacgttaatagcaggtctaattccgcgataaaagagctctgtttccaaacagatttgtccatctgtaatggagatcacattggtggggatataggccgatacgcctccagcttgtgtttcaatcacgggtaacgcagtcaagctacctgcacctgtctggtccgatcgtttagcggctctttctaagagacgggaatgtaaatagaaaacatcccctgggaaagcctcacggcctggtggtcggcgtaacaataatgacatttgtcgatatgccaccgcctgtttacttagatcatcatatataattaatgcgtgcattccattatcgcggaaatattcccccatggcacaccctgaatatggggccagaaattgcagaggagcaggatccgaagcggtggctgctacaagaatggaatattccaaagcattcgcttctgaaagaatttgaactaattgtgccacagtcgagcgtttttgtccaatcgcaacatagacacaatacaatgtctcactctcatttgtgccccttgagttcatttgcttttggtttaatatagtatcaatagctattgctgtttttccagtttgtctgtccccgattataagttctcgttgaccacggtctataggaaccaggctatccactgcttttaagcctgtttgcatgggttcgtgcacagatttacgttcaataatccctggggctttcacttcgacacgtcttcgttcgtgatcgcttagagccccttttccatcaataggtattcccaaggcgtcgaccacacggcctaacatggcctttcctgcaggaacatccacaatagatccagtgcgcttgacaagatctccttctttaatagcggtatcactaccaaagacaacaatacctacattctcattctcaagattcaaggctattcctttcacaccgctggcaaattccaccatttctccagcttgaatctcgttcaatccataaacacgtgcaatcccatctccaactgagaccactcgaccgatttcatccacttgaaaattcgtgtaaaagttggtcattctactttctaatagagtcgtgagttccgcagctctgggtgagaattccatactttaacaaagacgatggatgagagaagggagaaatccgcttttcaaaaagccttagactgaacaccacacaatcactcactccactagatcataaatgccattatcgaatggggcagacactcccatgagctatttcaaccacttactaacacagggacaccaccattttaaagctgaactatgatcttctttcgtgcacatctcgctttttttttcatttatgcgaatgaattgcagaaccaaactaaaatgggttgatcggagctattctctagaatttcaaacttgagatgacttgcttgaaggaaatgcttacactgaagcctattaccctttctggcttatagggattagggagaagagaaccaattccagtgcctaggactcacattttcattttcctagtatggattcgtattacttaactagttagttatcttactagtctataaaacatgaacttcttattctaaagtaatttatccaaatatttattaatattcaagatgaaaggaaaggcacgccaacaactacaactagccagcaccctattgactcgcttgtggaaggacttataggacgaataaaagcaactagctcgtttggacccccagcaacttcaaatgaaactggatagctggcaactggcactgcaattagatggctgagaactctttctacaatagaagggaaggccttggtaatataacgagattgctaacttgcctaagatatctacttacttaaaggactacagttagctttacgggaaatcaacactttgttgaaggtggaatgtgaatacagggacagagactatccatattaccccctgccttacccttaagggctaagaactgaataggctgactctagattctaactgaaaatactcaaaattggactctgcaggctttcaagcagattgatacctactttacttgccaaaaatatttgatgagtaaaagctttcaaactcagttgcagtagagaccttcctaagggcgaagaaatgagagagcagctttgagcgaaatgcggggattagtggaaggcgggatgaaactgtttcttaatttccaacactctgatttgagcagaaactctatggagtgtgttcattgatataccaatacctcttcatttcttgatttaccagattggtcttatgagtggagcaagaaaacggatgcgcgtgctaacgctttcgcgctagtgcgctcaatccggtgcttgttggttagttggaacaactagtaggaaagctacttctacttggacagctcagcagccctatattcccttgttccagcaagcaaacaaatagaatagttggaacgaatagacaagtaggacagtgctaccagctagttaactcagttcattcttgactttcggcttgtagctttgctacacaacctcgcattcgaaattagtacttacttggacagcaggtaaagcagggacagtagtatatggtagtcagctttgaattgttctctgtgtagaatgcctattggtttttcacgaaacagtactatatgtggacagtacataggtatcaagaaagagggctagctctgtttgaatagttaccagccaagaaaagactactcaaaaatctgctacttcgtttccaagcatacttatttctttctcactcactacttttttctattttcttttgtctatcgaaacagcctagattcaatttgatttatcctagtggtgacagcttatgcttcatttccttcgaattcttctttcgatatgagcgagcttacccaaaacctatcacttataccagtgcagatcttatttatgtgcatccctcgctgtgactactattcttgtctacaaacctaaggtggataaacctctatggtgcatatctgtttcgcctaacttgtcttagtcattcccacattgaatcgaaactctcaatgcccattgactcatcatatctcgactgagcggaaccaatccaataggataatcaatatgttctgctattccttatatacctcagcttgttcgattgagccgataccgagcccttatcttttcagaagatgtgcaaccacccttgcttttggtttattttcagtcaaccaatagtagatataggaggaggtggtattagagaacaattagttgatttgcaataccctttgctttcatttcacttcgagggaagaccttactttcattcagcattcgcttaaggataggaatagtcatatctcgctcgtagtcatatcagcctctatcgtaggagtggtattgaaggaaaaccgtaccgggccaaatagattggtttttaaaataggggttcaaatcattccgcaaatccagaaactgaaatggggtattgctgccaataaggataccactcttactagcaaggtgaaagacacatcaacccgcatacccttttaccacacctaccccttgttgggcacgtttacgcatctcttgacccatccacatgacccgcttggctaactaaaagaagcttctcggagcatctatgcatatgagaacggatgccgagtaaagggtggccagcttcgacctttgctttgaacaggggttagcattatcaaaaaccattgctcataaaagggatctctttcctaaaaggcatatctcgtacgctagggaatgtgcttcggcttcagcctagctacttttttgattggtgactaaactactaaaagaaaactttagctatcaattcttttctctatgttcagaaatcattaacggatgcagaactggatactctgcttaaagcaataagcctcccttggatagatcgaagaaagaagcactgtgcgttaccaggtgtagtggagaaagcaagggcaaaggtttcatcagaaagagatgctcgagcgataccaggatcacgatacgattaatctgatggcgcagcacgaacaggaaatagataacctagccctgggaaggaaagggaacagtttagtccctccgatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacactccctgtggtgctttcagtgggggattcgttatggaaagcgggaaactcaagtaagtactgcttttcgatagctaattcgagttgggatgaccacctggaaccaaaacaaactctataacttgtttaaaacaagctagaacagcatcaattgaattcaaggtataagcacactgataagaaatacatggggccttatgccccgctatgcactctaccacttcaattcaatgattgacttcaccgataccagacctcacttgagagagatctatcactggcatgtggtaaaccatactagtgaatgagccatatcgagctgtggtcttactctagaactcaagttcgatgagctcttagcggagttgtgcctactatctactaagtgtgtgctagggaaagaaagcagagcagttctcactctgtccggtgaccaagaaagaaagcttcaagaataccgtaaacagatcagagaaacctcataccgaatcgccacgtgaaagcgggttaaggtaaggcaggaaagactgacgccgaaagatatgttttgaagagagctccatcgggttgaagccgaattgcagagaatcaagatcttctacctttgtttgttccatcaatgcccttcggactggcctaagagttgggccctgtctgtaattatgtggctaggtaacccatttatggcttgtggtctttctgcttatgacgtagcactattccatcttgtaaataacgccttctttaaggcgctactatttctagcggcataggtgctttatcacaatacgaaacatgtacatacgaggactacgattcctatttagagatattcctacgagcgatagacgtagtaaagaaattacgtacgccaataataataatatgactacgatttatcgcaatacgaattagcgttgattgctcctctccctctggactaggccgatccaactcaattagaaaaatcggggaatcgaatcctattctcggaacttcccgcatccctagtattgtcctcgggtaatgcaaagaaaagataagggcacgggttccgctaagccaattgatctgctccttaacggatttgatagttgtagcggtacctagcccttctgagttccaatctaattataattaataatagtttcggttccggaaatcctatcgttatcttcggcttcaaagcaaagggagggatatcagtagcagtgaatatgtcttgtttcggatccgtgaatccaaagcttccgggtatatgaggccgcctatacggttcctaatctaactgcagcgtaccatgatggcaagctaaattcaatcaaaggaatctcacctaatgctagctccggcaatcctgggacgagtccatacgctagagtagagaaaagacgagcgctatccctttttttctaaaatcccaatcctagggtcaaacctatccttggtttaggcaatgccaacctttcctttcgaacaacggtacttactgcccgtaaaacagatcggcacctatcctcggtctcggctatctttacggcataccccgaagacgaatcagaattatcgactttaacagatcgatgttttgtcgttcaatcaaaagcatgattcaattaatagctcggctttcgagtcctatcctactcggcttctccccatttttcagacattttcctatcagtctcaccgtcaagatcgcagttcacaaagcacaccaactatatgtgaccccttgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactgcagtgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaatagggatatgatgcagggaaatcatcaaagaagagctgaagtggttcatttgcataaagcgagcatttataaatagagattgaaagatttaaacagttgtaataattaattaatattaactatccactgtccaacgctaacccacgttgcgacaggcccaaccatccacctaaactatccaaattaaaggattacactaaggtgaaactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccattcgcatagccccctctaaccaagcacaccacacctcaggtttcacccccactcctcgcaaggcagcgggcagtcccctctcgtgcctaggtgaatccggaagccgcataggccatcgcaggacccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattatcataagaaccaacagtctaaacattaatatgattttccccatggtgaactagttgaactaagcatggctaagcaattcctagtccaaactctaatcatgctataaccgggaccacgcgggtgatccaccgccggtccacgggatcgacggcccggatcggcccggggccgatcggacggtgcggcggcggccaggctaggctcggctcggcacaaagccggccgagcggtcacggtgacggcgcgcgcacgcgcacgcgcgttgccgacgacggcaaacgccggcggagacggcggcgcaaggcgccgaagggcggtgatgctaaagcgacgactaacgggcggcggcgctaaagcggcggctaggagggagagggaggggaaaaaaaaagggagggggtgcctcaccgagggtggccggcgcggaggaagacgatggcgaacggcgacggcaagccacgggaggacgacgtcggcgggcggacgagcttcggggtgcc

SEQ ID NO: 21394 - DNA, 1598 bp, Oryza sativa
  unsure (1)..(1598): unsure at all n locations
ggctagcggcggccggagtagcgcaaaaggcggtggcaaggggttgcacggcgcgggagcgatgggaggctcgagagagtgtggcgaaatggggataaagtgagaggggacgacggcgatgcttaaaaagggggagagggaaccggacgtggccgagagaggcgggaatcgccggccgacgtggggagtgggggaggagagagaggcgggattcgaaaatcgaatcccggccatctcgggcgcggacgcgagcgggagagggagaggagtgggcgcgggagacgcggcgcacgcgcgggcgtggtcgacgtggcccggaggaggtggagacgagggcgcggcggcggttgcgggcgcgacggcgcgagcgagatcagcgggaggtgggggaaggacccgacaggtgggccccacctgtcggcgaccccgagagaggaggcggcggggcggcctggctgggccttggcctgcggccggcccagcaaggaggaggggaggaaggagggaatgggccggcggcccattcgaaaaaaaaggaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcctgatttcacctgcattttcttagggtcatttataaaaattacaattttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcgctggtatcaagtatacgaaccggcttctccacatatgttaggtcctcctggatatcaatgtgttccgaatcagcctgttcttcaggtacccttaagcacttctttagttgggacacgtggaacacgtcatggatgccgatcatgttggatggaagttctagctgataagcaacttctccccttcgttccaagattttgtatggtcccacgaagcgtggtgccaacttgcctttcgtctgaaaccggtgtactccccggagcggagtgacacgaagatacacgtaatctcctacctcaaaagtgagctcccttcgacggttatccgcgtagctcttctgtcgagactgggcaattctcaacctttccctgatgatcctgactttctcttctgcttccgctaatacctctgttccgaacagttgacgctcgcctgtctgatcccagaagagaggtgtgcggcacttccggccgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21395 - DNA, 925 bp, Oryza sativa
tattccttgtcccaggaggcaaggtacaccaaaaggtgatacaattcagagtttaacaagcggaagcgtaaatagttaattattacatgggcagcgacggcccagcacactcaaagacaatgaaaaacaacggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcttaaatacaaaggagtacaatggagttatagtataggggctaggttttgcaataaacagcatttaaaggacccttagttgctcaaagctaaatttaaaacacgatcctagaactatttaatattattaaacaaggctgtgaacccacacgaacctgccttaacccaaggcctacgatgattcagaccgaactggcaacccgaccctgggtcccagctcgtcccaagccaacccaggccaaccattccacattttagttattaagcaagttttaagaattaaaaacactaacttgggtacattgctaggcttgcccataaccgagggcacggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtactgacccaacccacctacggctggaacccccggacaggcaggcagaattgagcccctagcagcaagacaccagccctgtgccatgacatctcgactaccgggccgcagcccgtgtagccttcatttgtcctagagatgtccatcgacccccgactt

SEQ ID NO: 21396 - DNA, 947 bp, Oryza sativa
gagaacgccttacccaagcgccagtgtccggttcctcgaaagaagcaagaaatctttcatacgcctattcaagagataccatccttgacgtgttgttgggtgatacgtataaccgggtacgacttacaacgtttggataccagattcagagacatttcattactgttctgaatatacaaggcaatgtttcaagactgacattcaatgggaaagaccaacatagttaagttggtaataggtcataggtaaccaaatacatagatagtacttctatatcgttcgtgcagaaaaaagagtatccttagggtactaattagataaaatatattatcccccatacttttagtagaaggttgcatttcatatccggtgagacaagaaaaggccttcggtactattatagtatagaagttcggtacccttttaataccatgctatttcaatacctgactatttaaatagctgacttttaggcttgcactatcgatcaaatgacggacgactataaaaatagaatcagaggattgcttacccttcttactttctatcggttctatctgatcttgtctttcctacgagtatacatgcagctggcttttttggtaatctgacctttccttccttcccgctagcaacaagcaaccgatttcactcacaactcttattgcagggatctcctacactactggcacttggtagcaaggcgctacgcgtacgaaaaccacccactatcagaagatggatatatagcggtactagggcggagccccctccttagattcccaatcggcatcattgatgaatcacctatccaacatccttaaacaaagattgccccccccccccgaattgggggaagccgtaggtattattgcggttcaatctattgaagagcctagcactcaactaacattaagaacttatcatacaggcggtggattcacagg

SEQ ID NO: 21397 - DNA, 315 bp, Oryza sativa
ttgttcggtgtcccgtcgaggtcgatcatcgccgcgtcgacttcgccctggtcctcggcatcgaaaccgttcagcagttcggcgatttcgccattcaccgcgtcaacggccttgccgacgcccttgccgagccaggcaccgccaccgtcgcgcagctcgaccgcctcgtaagcgcccgtcgaggctcccgacggcactgccgcacgcccgaagctgccatcttccagcatcacatcgacttcgacggtggggttgccccggctgtcgacgatctggcgggcgtgaatgtcgaggatggcggtcattgcgtgtcgg

SEQ ID NO: 21398 - DNA, 657 bp, Oryza sativa
caatttttaagaaaaaatcggaaaaaaaatcttacgatggcacgattaattataagaaacgggaaaagaaaacacgaggaagaaaaaagcactggtcgatctgccattaactcctggagcttttgggttgttggcggatgtggcttcatcttctgctgctgcttcttcttcttcttcagctgcgaagtgcagtggccccacatgcagtagaaggaggaacagtggtacagtactacagtgtagctgtgtagtggctgctgctagctaatctgaatgtcgaaagggaaaaaaaaaagggtcatggcagtagtccacccaacgctatggataggtagactgttgttgttaatggctacttcgaggaggaggaggaagaggacgacgacgatgatgacaactgccagcggctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgaaaagttaatttgtcggcccactttaacgctcggtcgctccgccttcgggggc

SEQ ID NO: 21399 - DNA, 629 bp, Oryza sativa
cgcctgcacggccggcctattatgccaccgttgttgggtgtctacatcttcaccgccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattatgccgctgttgttgggcgtctacgacttcaccgccggcttgccttcaccactgccgaccggtgcttccgcctgcacggccggcctattatgccaccgttgttgggtgtctacatcttcaccaccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattattccgttgttgttgggcgtctacgacttcaccgccggcttgccttcgccaccgccgactggtgcttccgcctgcacggccggcctattatgccaccgttgttgggcgtctacatcttcaccgttagcttgtcttcgccaccgtcgactggtgcttccgcctg

SEQ ID NO: 21400 - DNA, 671 bp, Oryza sativa
aagtcgtagacgcccaacaatggcggcataataggctggccgtgcaggcggaagcaccagtcagcggtggcgaaggcaagccggcggtgaagtcatagacgcccaacaacagcggcataataggccagccgtgcaggcggtgacaccagtcggcggacgaaggcaagtcggcggtgaagtcgtagacacccaacaacagcggcataataggccagctgtgcaggcggagacaccagtcggcggcggacgaggcggccgctcggtgaaaacgtagacgcccaacaacggcggcatattaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggcggtgaagtcgtaaacgcccaacaacaacggaataataggccagccgtgcaggcggagacaccagtcggcgacggacgaggcggccggtcggtgaaaacgtatactcccaacaacagcggcataataggccagccgtgcaggcggtgacaccagtctgcggagaccaaggcaatccgggggtaaagatgtaaacacccaacaacggtggcttaataggcccgccgtccaggcg
